United States Patent 10,696,975 (GENES AND USES FOR PLANT ENHANCEMENT) - sequence listing, part 10

SEQ ID NO: 41730 - protein, 2216 aa, Candida albicans SC5314
MAQLSVPITPPMESTGDVLMTLETQDGIALQGYSFGAAKPAAGEVVFQTGMVGYPESITDPSYEGQILVITYPLVGNYGVPDRELLDEDYEPALPKYFESNKIHIAGLVVAHYTEEYSHWLAKSSLGKWLQEQGIPAIYGVDTRSLTKRLREKGSTLGRLAIQNSDYKSEEIISQSKSNPQNWKKFFNVPEFDDPNVKNLVAKVSTDKPILYTPKKTNENIKLGKNGKPIRILAVDVGMKYNQIRCFVRRGVELLVVPWDYDFTTEEYDGLFISNGPGDPAVMDKTVERLQKILKEGKTPVFGICLGHQLLARATGASTLKLKFGNRGHNIPCTSTISGRCYITSQNHGYAVDTATLSNGWKELFVNANDGSNEGIYHESKPFFSVQFHPESTPGPRDTEFLFDVFIKSVVDFNQSGGVYKQVEFPGGKLAENRAAHPKVDVKKVLVLGSGGLSIGQAGEFDYSGSQAIKALKEEGIYTVLINPNIATIQTSKGLADKVYFLPVTPEFVRKVIKHERPDGIYCTFGGQTALSVGIALKDEFEGLGVKVLGTQIDTVITTEDRELFASAMAEINEKCARSEACNTVKEAVDAANAIGYPLIVRAAYALGGLGSGFADNEEELVALCNKAFATSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEIKNSVTKSTSACFEPSLDYCVVKIPRWDLKKFTRVSALLSSSMKSVGEVMAIGRTFEEAIQKAIRSTDYHNLGFNKTAALMSIDIDQELQTPSDQRLFAIANALSDGYSVDKVWKLTNIDKWFLNKLDGLIKFGNKIASYGAKEDVPMSILRQAKQLGFEDRQIAKFLGSNEVAIRRLRKDAGIIPFVKQIDTVAAEFPAFTNYLYVTYNADSSDVKFDDNGVIVLGSGVYRIGSSVEFDWCAVRAIRTLRENNVKTVMINYNPETVSTDYDEADRLYFEPINLERVLDIYDLEQSSGVIISMGGQTSNNIALPLYRQNVKILGTSPEMIDSAENRYKFSRMLDRIGVDQPAWKELTSIDEAEDFAEKVGYPVLVRPSYVLSGAAMNTVYSKDDLASYLGQAVDVSPDYPVVITKYIENAKEIEMDAVAKDGKMIMHVVSEHVENAGVHSGDATLIVPPQDLDPETVRRIVEATAKIGKALDITGPYNIQFIAKDNDIKVIECNVRASRSFPFVSKVVGVDLIEMATKAMLDLPIVPYPGERLPEDYCAVKVPQFSFSRLAGADPVLGVEMASTGEVATFGKNKYEAYLKSLISTGFKLPKKNILFSIGSFKEKQELLPSIAKLHELGYKIFATAGTADFIKEHGIPVHYLEVLSKDEDQKSEYNLSQHLANNLIDLYVNLPSANRFRRPASYMSKGYESRRMAVDYAVPLVTNVKNAKLLVEAIARNISLEVSNRDAQTSHGTAILPGLINITSFATSFDDFEQTTKESLAAGFTFNAFLPHTQAGASVTDYRSLIDAIDAVGASAYTDYSVSIAASETNSQSVSDAADNAGSLFLPFNDFANSKVSALTAQFSSWPNNKPIITDAKTTDLASVLLLASLYNRSIHITGVSSKEDLDLIKMAKEKTLQVTCDVAVHSLFLSKDELDYPFLPNKQDQEYLWENLKDVDCFSIGVLPYLIAKASGTEIAPGMGIKEAVPLLLTAVKAGKLTIGDIVSKFHDNPAKIFNLPKQDAQVVLDLDRFATVEPVYPEFSKLRLRGAVERVSFHNETVVLDGSVLSQIALGKNEVVPRSRFGSTAGIPESPRLGNKRVSFSSDMRRPSLAPETPEPQPAIFEKLGSELVSQPIAGSLGEIAALSDYIRHNNTFLRNNIISVKDITRSDLHSLFTVAQEMRLAVERQGVLDLLQGRVLATMFYEPSTRTSTSFDAAMQRLGGRVVAVDHGSSSVKKGETLQDTIRTLSCYSDAIVLRHPSEESADIAAKYSPVPIINAGNGTKEHPTQALLDLFTIREELGTVNGITVTFMGDLKYGRPVHSLCHLLRHYQVRVQLVAPKELQIPAEIRQQLIDNNMLIAESEELTKEILARSDVLYCTRVQEERFADKEQYQRLKDTYIVDNKILSNAKQHMCVMHPLPRTNEIREEVDFDQRAAYFRQMRHGLFIRMALLAMVIGVDF

SEQ ID NO: 41731 - protein, 291 aa, Xylella fastidiosa Dixon
MSKALFTRWCQRTDSYLERTLSILTQAPQRLHAAMRYTVLSGGKRIRPLLVYAAGHLFHVDEPLLDVPAAAVELIHAYSLVHDDLPAMDDDLLRRGRPTVHIAFDEATAILTGDALQTLAFECLADAPADASLRIAWLQTLTHAAGVAGMCGGQALDIDATGQSQTLKALEAMHALKSGTLMRAAVRMGALAGDPSPEDLHSLDTFAATLGLAFQVRDDILDIESSSEQLGKTTGKDAIQQKSTFPALLSVEGAKCYLQELAERLYTQLHPYGERAAPLTALARLAVERAH

SEQ ID NO: 41732 - protein, 314 aa, Physcomitrella patens subsp. patens
MGRLLALELLTAAFLLAAVADAELRYGYYDSLGCAGVEDRVRTLVRRSFLTDATSSAAMLRLAFHDCQVGPGGCDGSIMMEGDGGEMDAGSNFGVKRLDIINSVKSDMEDMCPLTVSCADIIAMAGRDAVAYNGGPEIQIPLGRKDADFSSATEAEAKLPPATSNVDRVLNVFAPFGMSIAESVAILGAHTLGVGHCKNIQDRLQLNSPTAPNSVVYRTQLRAACAVNVFDIAILNNDASQFTFDNQYFQDIQNGRGLFTVDDQLSTDPRTAPIVTLYASNQGAFFSAFQSAYVKLTSRAMTGNQGSVRSTCTL

SEQ ID NO: 41733 - protein, 537 aa, Zea mays
  misc_feature (273)..(273): Xaa can be any naturally occurring amino acid
MLRAALFRSAPGLRRSPATAHLSTVAAAAAAWLSNGPASTPPRVRLLIGGEFVESRADEHVDVTNPATQEVVSRIPLTTADEFKAAVDAARTAFPGWRNTPVTTRQRVMFKFQELIRANMDKLAENITTEQGKTLKDAWGDVFRGLEVVEHACGMGTLQMGEYVSNVSNGIDTFSIREPLGVCAGICPFNFPAMIPLWMFPVAVTCGNTFVLKPSEKDPGAAMMLAELAMEAGLPKGVLNIVHGTNDVVNNICDDEDIKAVSFVGSNTAGMHXYSRASAAGKRVQCNMGAKNHAIILPDADRDATLNALIAAGFGAAGQRCMALSTAVFVGGSESWEDELVKRANGLVVSSGMVNDADLGPVISRQAKDRICKLVQSGVDSGARILLDGRKIVVPRYEDGNFVGPTILADVKSDMECYKEEIFGPVLLLMKAESLEDAIQIINRNKYGNGASIFTTSGVSARKFQTDIEAGQVGINVPIPVPLPFFSFTGSKASFAGDLNFYGKAGVQFFTQIKTITQQWKESPVQRVSLSMPTSQK

SEQ ID NO: 41734 - protein, 421 aa, Mycobacterium tuberculosis H37Rv
MALVVQKYGGSSVADAERIRRVAERIVATKKQGNDVVVVVSAMGDTTDDLLDLAQQVCPAPPPRELDMLLTAGERISNALVAMAIESLGAHARSFTGSQAGVITTGTHGNAKIIDVTPGRLQTALEEGRVVLVAGFQGVSQDTKDVTTLGRGGSDTTAVAMAAALGADVCEIYTDVDGIFSADPRIVRNARKLDTVTFEEMLEMAACGAKVLMLRCVEYARRHNIPVHVRSSYSDRPGTVVVGSIKDVPMEDPILTGVAHDRSEAKVTIVGLPDIPGYAAKVFRAVADADVNIDMVLQNVSKVEDGKTDITFTCSRDVGPAAVEKLDSLRNEIGFSQLLYDDHIGKVSLIGAGMRSHPGVTATFCEALAAVGVNIELISTSEIRISVLCRDTELDKAVVALHEAFGLGGDEEATVYAGTGR

SEQ ID NO: 41735 - protein, 325 aa, Spinacia oleracea [sequence omitted]

SEQ ID NO: 41736 - protein, 287 aa, Pantoea agglomerans
MEGYQVDYTVLNAFTHSPLEGNPVAVFHDTEKLSEAVMQAIARQLQLSESTFISEKTVDGQARVRIFTPVNELPFAGHPLMGTASAYSRRHGLDQFVFHTALGAVSISVEHHTETLSTVKIEVPLARTVPFKEEKRLLKALGLEQSVLPVEMYDAGARHVLVSVDSIETLRELRPDHQVLAEFENLAVNCFAWCGFQAENRMFSPAYGVKEDAGTGSVVGPIALHLMKHGQLKANEKIMIEQGILLNRRCVMYGEIKQENEIASHIELSGQVTLFSDCRALLSNSGK

SEQ ID NO: 41737 - protein, 226 aa, Glycine max
MEVIRVLTAAITVAVLAAALPADAGDDNRVFAPCSDTRVQRSDGFTFGIAFAPKDKFFYNNNNSVQLSPCDTRLSLSNANSQISVFRPKVDEISLLTVNSSSFVADSYGYMVAFAGHRYAARSPPAFVANGTYTVTSFTLVLEFKRGRLQNLYWKRDGCAKCSSNSKAVCLNNQDCALQTSTCKSHGGTVDCSIGIQLAFSGTDRHLAVLNSWYEVKNLRQYSLYG

SEQ ID NO: 41738 - protein, 540 aa, Novosphingobium aromaticivorans DSM 12444
MQLSHLSLHLDRNGQCAYRPAMSIQPSESILIVDFGSQVTQLIARRVREAGVYSEIAPFSQAEAAFHRMKPKGIILSGSPASVPADGSPRAPQVLFDSGLPILGICYGQQVMSEQLGGKVEPGDSGEFGRAFLTVTEPCVLFDGLWAVGERHQVWMSHGDKVTQFAPGFRIVAVSDGAPFAVIANDEKKYYGTQFHPEVVHTPDGGKLIANFVRHVCGCAGDWSMAEFRRTKIAEIREQVGDSRVICGLSGGVDSAVAAVLIHEAIGDQLTCVFVDHGLMRMGEAEQVVSLFRNHYNIPLVHKDVSALFLGGLAGVTDPEAKRKFIGKTFIDVFEAEARQVGGADFLAQGTLYPDVIESVSFTGGPSVTIKSHHNVGGLPERMNMKLVEPLRELFKDEVRALGRELGLPEIFVGRHPFPGPGLAIRIPGEVTKERCDILRKADAIYLEEIRNAGLYDAIWQAFAVLLPVKTVGVMGDGRTYDSVCALRAVTSTDGMTADIYPFDAGFLSRVATRIVNEVKGINRVVYDYTSKPPGTIEWE

SEQ ID NO: 41739 - protein, 346 aa, Nocardia farcinica IFM 10152
MKALQYRTIGAPPEVVTVPDPEPGPGQVLLKVSAAGVCHSDIAVMSWPESEFPYELPLTLGHEGAGTIAALGDGVRGFAVGDSVAVYGPWGCGTCHPCEGGRENYCVRAGELGIFPPGLGAPGAIAEYMIVDDVRHLESLDGLDPVRTVPLTDAGLTPYHAIKRSLPKLVPGSTAVVIGAGGLGHVAIQLLRALSPARVIALDIGEEKLELARRVGAHETVTSDEHAADRVKELTGGRGATAVFDFVGVPPTTATAAGCVAMEGDLTIVGIGGGSVPVGFGTTPFEVSVTAPYWGSRGELREVLDLARAGAVEVHVETYALDDAPEAYERLHKGQINGRAVILPNG

SEQ ID NO: 41740 - protein, 383 aa, Mycobacterium tuberculosis CDC1551
MPAVQPWLYSNMPAIRGAVLDQIGVPRPYWRSKPISVVELHLDPPDRGEVLVRIEAAGVCHSDLSVVDGTRVRPVPILLGHEAAGIVEQVGDGVDGVAVGQRVVLVFLPRCGQCAACATDGRTPCEPGSAANKAGTLLGGGIRLSRGGRPVYHHLGVSGFATHVVVNRASVVPVPHEVPPTVAALLGCAVLTGGGAVLNVGDPQPGQSVAVVGLGGVGMAAVLTALTYTDVRVVAVDQLPEKLSAAKALGAHEIYTPQQATAGGVKAAVVVEAVGHPAALHTAIGLTAPGGRTITVGLPPPDVRISLSPLDFVTEGRSLIGSYLGSAVPSHDIPRFVSLWQSGRLPVESLVTSTIRLDDINEAMDHLADGIAVRQLISFTGDL

SEQ ID NO: 41741 - protein, 300 aa, Zea mays
AEAMESPFRADVVKDKAALVTGGGSGICFEIAAQLARHGAQVAIMGRRREVLDKAVAALRSQGLRAVGFDGDVRNQEDAARVLAATVAHFGKLDILVNGAAGNFLASPEDLTPKGFRTVLEIDTLGTYTMCYEALKYLKKGGPGKGPSTGGLIINISATLHYSASWYQIHVSAAKAGVDSITRSLALEWGTDYDIRVNGIAPGPIQDTPGLRKLAPEEMSKGLREMMPLFKFGEKRDIAIAALYLASDAGKYVNGTTLVVDGGLWLSHPRHIPKEEVRELSKVVEKKVRASGVGVTSSKL

SEQ ID NO: 41742 - protein, 413 aa, Vibrio cholerae O1 biovar eltor str. N16961
MFNKVSVIGLGYIGLPTAAVLASRGLDVVGVDVNAHAVDTINKGEIHIVEPDLDIVVRSAVMTGKLKATLTAEPADAFLVAVPTPFKGDNHEPDLSYIEAAAKTIAPVLAKGNLVVLESTSPVGTTEKLAQWLAEARPDLTFPQQKGIAADVKIAYCPERVLPGYVLQELVSNDRVIGGVSKACSEKAVALYKTFVKGECIVTNARTAEMAKLTENSFRDVNIAFANELSLVCNKLKINVWELIRLANRHPRVSILNPGPGVGGHCIAVDPWFIVNSCPDEAQLIRTAREVNDGKPHWVVDQVKQAADQFKKPIIACLGLAFKADIDDLRESPALDITKHLAESKVGQLLAVEPNITELPSKLAKQGIELVSLERALELANIVVVLVDHKEFKAADKTEFAKKVVIDTRGVVA

SEQ ID NO: 41743 - protein, 184 aa, Vibrio cholerae O1 biovar eltor str. N16961
MSSPWELIKADLYRHTGQVSIGLVVKHLLLNAGFAYMFWFRLCRSKNVLIRTVARLMHRILSVRYQIQLPKETQVGPGLYLGHATGVIVNSTAKIGANCNLSPFTVIGSNQGQAATVGDCVYIGPHVSIVEDITIGDGSIIGAGSVVIRDVPPNSVVVGNPGRVLTRPSHKTYIRHPAPLESKS

SEQ ID NO: 41744 - protein, 111 aa, Hypocrea jecorina
MADAPYDPYVPKAGADQSGGQSRTQALQGEIDATVQVMRKNIENVAQRGDRLDVLQDKTDNLAESAQGFRRGANRVRKQMWWKDMKMRVCIVVGIILLLVVIIVPSVVATR

SEQ ID NO: 41745 - protein, 271 aa, Pseudomonas fluorescens Pf-5
MSTEDPRFAGVARLYGIEGLERLRAAHVAIVGVGGVGSWAAEAIARCGVGEISLFDLDDVCVSNSNRQLHALDSTVGKPKVEVMAERLRGINPDCKVHAVADFVTRETMAEYITPDIDCVIDCIDSVNAKAALIAWCKRRKIQIITTGGAGGQIDPTLIQVCDLNRTFNDPLASKVRSTLRRDYGFSRTVTRHYSVPCVFSTEQLRYPKPDGSICLQKSFVGDGVKLDCAGGFGAVMMVTATFGMVAATKAVDKIVAGVRRPSERSKPAAP

SEQ ID NO: 41746 - protein, 295 aa, Burkholderia pseudomallei
MLKVTKAVFPVAGLGTRFLPATKASPKEMLPVVDKPLIQYAVAEAINAGITEMIFVTGRSKRAIEDHFDKSFEIESELEARGKEKLLELVRGIKPSHVDCFYVRQPAALGLGHAVLCAEKLVHGEPFAVILADDLLHGDQPVLKQLVDVFNHYHSSVIGVETIEREDSRSYGIVEGREWEEDIIKLSGIIEKPAPEHAPSNLGVVGRYVLMPSIFEHLLQIKRGAGGELQLTDAVQSLLTEEQVLAYRYYGTRFDCGSKLGYLKATVELALRHPEVGREFEAYLRNCLPALAAVA

SEQ ID NO: 41747 - protein, 667 aa, Schizosaccharomyces pombe 972h-
MSSPSENHLLGPKTSFIDNRTSTSRPLHEIPSYQSLARRSSTWKRANIPQQKPSLVRRINYYIPVLHWLPNYSLRNIIWDVLAGCSTACLSVPIALSFAQTFLGVPPIYILTGTAIGPILYCLFTACPLISIGPEAGMCLLIAENIHQRVLSKADVPQETAILVTGLIAFIAGIINLAAGLFRLGFLDALVSPVLLRGCILSISMIIMINQGSVFFGFSGVKYKGSDFPIDKLMFLIRNMSKANIYTTILSCITISLLIGCRNLKSKLSAKYPRIVSIPDAVIILLLGSFLSKKFDWHSNYGIAILGEIKTTILLPKLPLPEKNKLHFITQSLQTGVMCSFLAFIDTVIAVKAISLQTNNLIRSNRELISLGAANIGSSLFCGLPICGGYLRTKCNIMSGARTQVATIACSVLILLATFFIMPVFSTVPTCMLASMVVSLGVSLFADAAVEIFKLARIRVWWELGIIFSIATCTMMFGLETGIIFGLSITVMQIIRHSTRSRIMFRSPTSNGTAEFILEDAASTLSHRTNPSSTAVESAPRILVVRIPEPLFFANVSQLEDRLNRLEKYGHPRMHPGETPYRRIEDIEVVVFDMVGVSSIDSSALFAFQRILKEYVEHQVEVHLVSLDPQVLHIFEKHGLLDLIGGYDHVQDSIKKVDALCDIELGV

SEQ ID NO: 41748 - protein, 271 aa, Brassica oleracea var. botrytis
NWGFFELLNHGIPYDLMDNIERMTKEHYKEFMEQKFKEMLRSKNLDTLETEVENVDWESTFFLHHLPQTNLYDIPDMSDEYRAAMKDFGKRLENLAEELLDLLCENLGLEKGYLKKVFSGTKGPTFGTKVSNYPPCPKPEMIKGLRAHTDAGGLILLFQDDKVSGLQLLKDGVWVDVPPLKHSIVINLGDQLEVITNGKYKSITHRVMTQKEGNRMSIASFYNPGSDAESSPAPSLVEKDSDEYPSFVFDDYMKLYAGVKFQPKEPSFEAM

SEQ ID NO: 41749 - protein, 143 aa, Vibrio cholerae O1 biovar eltor str. N16961
MWLYRVGHFFHKRRIPLLPQVCNGLIRLVHNCAVYSQSEIGKGTVFGYGGIAVVIHKRCVIGKECVIGSNVTIGGRSRSHNVPVIGNYVYIATGAKVLGDIRVGDGAVIGANAVVLEDVPPYSVVVGMPAKVIKTNINPKDFY

SEQ ID NO: 41750 - protein, 906 aa, Staphylococcus aureus subsp. aureus MRSA252
MNNKKTATNRKGMIPNRLNKFSIRKYSVGTASILVGTTLIFGLSGHEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTLNRMAVNTVAAPQQGTNVNDKVHFSNIDIAIDKGHVNSTTGKTEFWATSSDVLKLKANYTIDDSVKEGDTFTFKYGQYFRPGSVRLPSQTQNLYNAQGNIIAKGIYDSTTNTTTYTFTNYVDQYTNVSGSFEQVAFAKRENATTDKTAYKMEVTLGNDAYSEEIIVDYGNKKAQPLISSTNYINNEDLSRNMTVYVNQPKNTYTKETFVSTLTGYKFNPDAKNFKIYEVTDQNQFVDSFTPDTSKLIDVTDKFKITYSNDNKTATVDLMNGQTNSNKQYIIQQVAYPDNTSTDNGKIDYTLDTDKTKYSWSNSYSSVNGSSTANGDQKKYNLGDYVWEDTNKDGKQDANEKGIKGVYVILKDSNGKELDRTTTDENGKYQFTGLGNGTYSVEFSTLAGYTPTTVNAGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLKQTGTNTTEDDKDADGGEVDVTITDHDDFTLDNGYFEEETSDSDSDSDSDSDSDSDSDSDSDSDSESDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 41751 - protein, 859 aa, Legionella pneumophila subsp. pneumophila str. Philadelphia 1
MSGILIMQQVVIKFGGTSVSTRATWNNIAAITQKHLNTGVQPVIVCSALTQISNKLEKAIEAALLDEHHSLFNDIQSSHLNLAEQLEVNHQLIANDLHQLQQWLTGISLLKQAPAKTHAQILSLGELMMTRLGHAFLEKQGIKVKWYDARELLTSTPTLGGETMNYLSARCESEYDSALVEKFLSSGAQAIITQGFFAANPHGETVLLGRGGSDTSAALLAGKLQAASCEIWTDVPGIYTANPHQLPHARLLKQLNYDEAQEIASMGAKVLHPNCIPPVRKANIPMVVKYTHLPEHSGTLITKDIDESAPLIKSIQVKHSILLISIDTLNMWQQVGFLADVFAAFKKHGFSVDLLSSSEFNVTLSLDVNAKIHDRPAINALLDDLNQFGRAKLIEPCSAVSLVGHHIRTVLPHLGPALEVFEAKQVYLMSLASNDLNLTFVVDESHADKLCQRLHHLLIESNPQIFYYSKSWHEEFGKPNVRPTPWWEIERDRLLTTSAIHSPCYVYHSPTQATRARQLSALESIDSLFYAIKANPFPTILKTLEKEGIGFECVSIQELELVLKLFPNIKKERILFTPNFAPKSEYEFALQTGCYVTIDSLYPLENWPDLFKDREVIVRIDPGTGAGHHKHVSTGGNESKFGITQNDISKILSLTKVNHIKVIGLHAHSGSGILSTDLWQQTAVMLASLTDQFPEVRSINLGGGLGIVEKPGQHPIDFAALDAQLMAVKSQYPGLAIWLEPGRFFVAESGVILAKVTQCKEKGKVKFIGIETGMNSLIRPSLYGAYHEIVNLTRLHEEKAGFAHIVGPICESGDTLGYDRLLPVTREGDVILIANTGAYGHCMSSHYNLRPPAQEIVLE

SEQ ID NO: 41752 - protein, 1137 aa, Staphylococcus aureus subsp. aureus MRSA252
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 41753 - protein, 159 aa, Brassica napus
MDPREKKRGSLKEKFQLLRSITNSHAENDTSIIMDASKYIKKLKKKVERFKGDTTAGQSSSEPTDPTIPMVTVETLEKGFMINVLAGKNQPGMLVSVLEAFEDIGLNVLDARVSCTDSFSLHATGVENEDGEGMDSEAVKQAVTDAIRSWSESNDLQIS

SEQ ID NO: 41754 - protein, 326 aa, Triticum aestivum
MATLQHQNQGAAAPMTTTGGGLRAMDLYEKLEKVGEGTYGKVYKAREKATGRIVALKKTRLPEDDEGVPPTALREVSLLRMLSQDPHVVRLLDLKQGQNKEGQTILYLVFEYMDTDLKKFIRGHRQNHEKIPAHTVKILMYQLCKGVAFCHGRGVLHRDLKPHNLLMDRKTMALKIADLGLSRAFTVPLKKYTHEILTLWYRAPEVLLGATHYSTPVDMWSVGCIFAELITTTALFPGDSEVQQLLHIFKLLGTPNEDVWPGVGKLPNWHEYPQWNVSKLSSVIPSLDADGIDLLEKMLQYEPAKRISAKKAMEHPYFDDVDKALY

SEQ ID NO: 41755 - protein, 523 aa, Saccharomyces cerevisiae
MTKEEIADKKRKVVDEEVIEKKKSKKHKKDKKDKKEKKDKKHKKHKKEKKGEKEVEVPEKESEKKPEPTSAVASEFYVQSEALTSLPQSDIDEYFKENEIAVEDSLDLALRPLLSFDYLSLDSSIQAEISKFPKPTPIQAVAWPYLLSGKDVVGVAETGSGKTFAFGVPAISHLMNDQKKRGIQVLVISPTRELASQIYDNLIVLTDKVGMQCCCVYGGVPKDEQRIQLKKSQVVVATPGRLLDLLQEGSVDLSQVNYLVLDEADRMLEKGFEEDIKNIIRETDASKRQTLMFTATWPKEVRELASTFMNNPIKVSIGNTDQLTANKRITQIVEVVDPRGKERKLLELLKKYHSGPKKNEKVLIFALYKKEAARVERNLKYNGYNVAAIHGDLSQQQRTQALNEFKSGKSNLLLATDVAARGLDIPNVKTVINLTFPLTVEDYVHRIGRTGRAGQTGTAHTLFTEQEKHLAGGLVNVLNGANQPVPEDLIKFGTHTKKKEHSAYGSFFKDVDLTKKPKKITFD

SEQ ID NO: 41756 - protein, 359 aa, Arabidopsis thaliana
MSCFKSKFADELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTTGLDGLGDRCKKYYEAGARFAKWRAVLKIGNNEPSELAIHENAYGLARYAVICQENGLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 41757 - protein, 188 aa, Triticum aestivum
  misc_feature (30)..(30): Xaa can be any naturally occurring amino acid
IVAHAPPRGGLVGTPGGSFQGVKSTAGLPXSRRYKGGSLGSVSNGGRIRCMQVWPIEGIKKFETLFYLPPLSTEALLKQVDYLIRSKWVPCLEFSKVGFIFREHNAFPGYYDGRYWTMWKLPMFGCTDATQVINEVEEVKKEYPDAYVRIIGFDNMPQVQWVSFIAFKPPGCAPPPPGLNRSLTTGHI

SEQ ID NO: 41758 - protein, 194 aa, Saccharomyces cerevisiae [sequence omitted]

SEQ ID NO: 41759 - protein, 361 aa, Pyrococcus furiosus DSM 3638
MQAVVLAGGKGTRLLPLTVYRPKPMIPFFNRPIMEYIVESLVKFGVDEIIVLVGYLKERIFEYFGNGEEFGVEIKYSNGENLKLGTAGALKKAEKLIQDTFLVVSGDILTNLDFRSLVEYHKKKGGPATIALTKVEDPSAYGVAVLDKEGRISYFKEKPKREEAPSNLVNAGIYVFEPEIFDLIPKGKNFDFSLDLFPKMLNENIPIYGYPFDEYWNDIGRPSTYLQATEDVFLGKLRLPQINVGSLKGNIEKGGSLFTGSRCILRRPRIIGFAVLGNNVEISKDVTIERSVIFSNVTIEEGAEIREAIIGENVYIGKGVVIEPGSVIGDNSIIEDFSKVGANVKIWADSRIGKESIILPD

SEQ ID NO: 41760 - protein, 546 aa, Enterococcus faecium
MNKFKINIQGMTCTGCEEHVAVALENVGAKNIEASFRRGEAVFELPDDIGVESAKKAIDEAKYQPGEIEEVQSEEKIVLGDEGDYDLLIIGSGGAAFSAAIKSVEYGAKVAMIERGTVGGTCVNIGCVPSKTLLRAGEINHLAKVNPFIGLQTSAGKVELAPLVKHKDELVSELRNQKYVNLIDEYGFELIEGEAIFVDENTVEVNGKKLSAKRFLIATGVSPSLPPISGLEKVDYLTSTTLLELKTVPKRLTVIGSGYIGMELGQLFHNLGSEVTLMQRSERLLKEYDQEISEAVEKALIEQGINLVKGATFERVEQEGQIKKVHVTVDGKKKVVESEQLLVATGRKPNTDALKLSAAGVEVGKRKEILINDYARTSNEKIYAAGDVTLGPQFVYVAAYEGGIVADNAIGGLNKKLDLSVVPGVIFTNPSIATVGLTEEQAKEKGYEVKKSVLPLDAVPRAIVNRETTGVFKLVADAKTSKLLGVHIVSENAGDVIYAATLAVKFGLTVEDLKDSLAPYLTMAEGLKLAALTFDKDVSKLSCCAG

SEQ ID NO: 41761 - protein, 364 aa, Coccidioides immitis RS
MKALILVGGFGTRLRPLTLTLPKPLVEFANRPMILHQVESLAAAGVTDIVLAVNYRPDIMVSTLKKYEEEYNVKIEFSVESEPLGTAGPLKLAEKILGKDDSPFFVLNSDVICEYPFKELAEFHKKHGDEGTIVVTKVEEPSKYGVVVHKPNHPSRIDRFVEKPVEFVGNRINAGIYILNPSVLKRIELRPTSIEQETFPAICKDGQLHSFDLEGFWMDVGQPKDFLTGTCLYLSSLTKQKSKLLSPSTEPYVHGGNVMVDASAKIGKNCRIGPNVTIGPNVVVGDGVRLQRCVLLENSKVKDHAWVKSSIIGWNSSVGKWARLENVSVLGDDVTIGDEVYVNGGSILPHKSIKQNIDVPAIIM

SEQ ID NO: 41762 - protein, 450 aa, Clostridium symbiosum
MSKYVDRVIAEVEKKYADEPEFVQTVEEVLSSLGPVVDAHPEYEEVALLERMVIPERVIEFRVPWEDDNGKVHVNTGYRVQFNGAIGPYKGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 41763 - protein, 404 aa, Salinibacter ruber DSM 13855
MSSSPHSVRFNDRVAAMQPSATLAMKSRAEERRRQGHPVVALSAGEPDFETPKPISDAGVQAIRNGFTNYTENPGTLELREAICSKLDRDNDLSYTPEQVVCSNGAKQSLALAIHALCDEGDEVLIPAPYWVSYPEMARFSGAEPVPVPTDVDNGYRLTPAALEKAITERTRLLILCTPSNPTGTVYSPDELAALADVLRDHDGIYVVSDEIYEYVLYDAEHRAFASLPDMKERTVTVNGFSKGFAMTGWRLGYMAAPGPIAEAAGKIQGQFTSAPSSITQKAGVAALEMDKEPVEEMVSAFRRRRDVVLERLRAIDGVQCPTPEGAFYAYPDVSAFFGATAPDGSTIEDGGDLCFYLLEEQDVALVPGPAFGEPDGLRLSYASSMEDLETGLDRIEAGLAALR

SEQ ID NO: 41764 - protein, 369 aa, Lentisphaera araneosa HTCC2155
MKSKAAVAFAAGKPLEIVEIDVEGPKAGEVLIRNVASGVCHTDAFTLSGDDPEGEFPVILGHEGGAIVEAIGPGVTSVVPGDHVIPLYIPECGVCKFCTSGKTNLCQAVRATQGKGVMPDGSSRFSYKGQKLLHYMGTSTFSEYSVVAEISVAKINKAAPLEKVCLLGCGITTGIGAVLNTAKVEPGSTVAVFGMGGIGLSCVQGAVMAGASRIICVDINEDKFEMAKQLGATDFINPKKHGASIQDVIVELTDGGVDYSFECIGNTQVMRSALECCHKGWGKSVIIGVAGSGQEISTRPFQLVTGRQWMGTAFGGVKGRSELPGLVDDYLAGKIEIDSMITYSMPIEEINRAFDLMHEGKAIRSVVTF

SEQ ID NO: 41765 - protein, 401 aa, Pseudomonas fluorescens Pf-5
MLVASPWRADFPAIAALHRQDQTYLDNAATTQKPQALLDALAHYYANGAANVHRAQHLPGAHATQAFEDSRSKVGQWLNAGDSGQIVFTHGATSALNLLAYGLEHQFSPGDEIVISALEHHANLLPWQQLAQRRGLKLMVLPLDPDGLIDVDAASRLIGPRTRLLALSQLSNVLGAWQPLTPLLAMARAQGALTVIDGAQGVVHGRHDVQALGCDFYVFSSHKLYGPDGVGVLFGRHAALKGLRHWQFGGEMVQDADYQHASFHPAPLGFEAGTPPIAGVIGLGATLDYLAGLDQQALADHEAALHAYLLHGLQARNGIRLLGSPQVALVSFVVDGVHNADLAHLLTEQGIAVRAGHHCAMPLMKSLGLAGAIRVSLALYNDSEDLERFFEALDQALELLR

SEQ ID NO: 41766 - protein, 459 aa, Debaryomyces occidentalis
MIKNGLPHEPEFQQAYNELVSALEESTLFTEKPEYKKVIPVVSIPERIIQFRVAWENDNGDVEVNNGFRVQFNSSLGPYKGGLRFHPSVNLSILKFLGFEQIFKNALTGLSMGGGKGGCDFNPKGRSDGEIRRFCVAFMRQLARYIGADTDVPAGDIGVGGREIGYLFGAYKQMQNNWYGVLTGKGLTWGGSLIRPEATGYVSFTTLKKMIEKATNGKESFKGKRVELSGSGNVAQYAALKVIELGGIVVSLSDSKGSIVSKNGIVPEQVLEIAAAKLKFKSLEEITKESVKLFSGENSVEYLAGVRPWAKVGHFDVALPSATQKEVSGEEEAKALVEAGCKYIAEGSNMGSTKEAIDVFEANRSNNVWYAPGKAANCGGVAVSGLEMAQNSQRVQWSAEEVDAKLKNIMYTCFDNCYDPAIKYSAEKNADGLPSLLKGANIASFIKVADAMFDQGDVY

SEQ ID NO: 41767 - protein, 391 aa, Rhodococcus sp. RHA1
MLDLEQARRDTPGCLDKVFLDSAGSSLPPTPVLDAVFAHLRREADVGGYVAAAERADDLAAVKSSLGRLIGASADSIALVDSATTAWNDFFHAVPLEAGDRVLISEVEYASNAIAVLQRARSVGATVDVIPSDPAGQIDVAALETLLDDRVRLVSLVHVPTNGGLVNPVREVTELAHSHGALVLLDACQSVGQIALDVSELGVDALSATGRKWLRAPRGTGFLYVRPELAATLEPAALDLHSAEWTAADAYRLATDASRFEFWECDVAARLGLGVAADYLLDLGVAEVEEAVAAGAEHLRSGLAAIPGVTVRDLGARRCGIVSFTVDGFDPGDVRKQLAARNVTVTASLRGSTLLDMSARGLDAVVRASPHYFCSPDDLDRFLAEVRTLAN

SEQ ID NO: 41768 - protein, 357 aa, Legionella pneumophila subsp. pneumophila str. Philadelphia 1
MTIEDTVIKLIGSLKDPLLDLTGKEMNLQYKITTSNQAMHVVLTAGYPTSLLETSYKPIVQKIVQDEFPNYQVTISIQQFIKAHKTQLTGKALRGVKNTIAVASGKGGVGKSTVTVNLAAALAKLGARVGILDADIYGPSIPLMLGETKPVQVKDNCYIPVEAHGMQAMSIGYLTDTNQALIWRGPMLAKSLIQMLDITLWNELDYLFIDLPPGTGDIQLTLVQKIPLTSAIVVTTPQNVATLDAQKAITMFSRTGIDVLGIIENMSTHICSHCGHQEAIFGRGGAAALCDAYQCTLLGQLPLDSHVRRHCDEGVPTATHSSNQLTDTFIKTAMRTAIELSKKPINYADRFPKIVVE

SEQ ID NO: 41769 - protein, 396 aa, Bacteroides thetaiotaomicron VPI-5482
MAEKRDYYEVLEVTKTATVEEIKKAYRKKAIQYHPDKNPGDKEAEEKFKEAAEAYDVLSNPDKRSRYDQFGHAGVSGAAGNGGPFGGFGGEGMSMDDIFSMFGDIFGGRGGGFSGGFGGFSGFGGGGGGSQQRRYRGSDLRVKVKMTLKEISTGVEKKFKLKKYVPCNHCHGTGAEGDGGSETCPTCKGSGSVIRNQQTILGTMQTRTTCPTCNGEGKIIKNKCKECGGDGIVYGEEVVTVKIPAGVAEGMQLSMGGKGNAGKHNGVPGDLLILVEEEPHPDLIRDENDLIYNLLLSFPTAALGGAVEIPTIDGKVKVKIDSGTQPGKVLRLRGKGLPNVNGYGTGDLLVNISIYVPEALNKEEKSTLEKMEASDNFKPSTSVKEKIFKKFKSFFD

SEQ ID NO: 41770 - protein, 332 aa, Gibberella zeae PH-1
MSFGRTVTLNSGWKIPQIGYGTWQAAPGEVGNGVYEALKAGYRHLDLAKIYQNQREVGEGIKKALSEVPGLKREDIFITGKLWNNKHRPEEVAGALDDTLEELGLEYIDLWLIHWPVAFKNGNQLFPLKEGDDGKTALDQEVTLSQTWEAVTKLPKEKVRSIGVSNFNKEMLEQIIKDTGVTPAMNQIERHPRLPQPELVKYLQEKGIFLTAYSAFGNNSWGEPLLINTPEVKAIAERLSKSKGKEVTPAQVILAWSTLDNHVVIPKSVTPARIRSNFEEVELDEEAVKELSKFGEKPQRFNIPKTYKPDWDINVFDDEKEKSATHQVVLKL

SEQ ID NO: 41771 - protein, 96 aa, Glycine max
  misc_feature (51)..(51): Xaa can be any naturally occurring amino acid
MASSLGFEFLTKKPYSPPSWASHSTLYLPTSSLLPIWNLPNLPTNGSSCVXRDDLSGMQLSGNKVRKLEFLMADAIAQGADSIITIGGIQSNHCRA

SEQ ID NO: 41772 - protein, 400 aa, Campylobacter upsaliensis RM3195
MFDEIHFNTIERLPNYVFAEVNAIKMAARRAGEDIIDFSMGNPDGKTPQHIIDKLCESANKDKTSGYSTSMGIYKLRLAICNWYKRKYSVNLDPESEVVATMGSKEGFVNLARAVINPGDVAIVPTPAYPIHTQAFIIAGGNVTKMPLFYNDHFELDENAFFESLNRALYESVPRARYVVVNFPHNPTTITCEKSFYERLVAMAKKERFYIISDIAYADLTFDGYQTPSILEVEGAKDVAVETYTLSKSYNMAGWRVGFVVGNKRLIAALKKIKSWFDYGMYTPIQVAATIALDGDQKCVEEICQIYDKRKDVLLDSFANAGWNLQKPKASMFIWARLPENKRHLKSLEFSKQLLQKANVAVSPGLGFGEAGDEFVRIALIENENRIRQAARNIKKFLKD

SEQ ID NO: 41773 - protein, 161 aa, Mesorhizobium sp. BNC1
MTISVGERLPNVTIKKATPNGAEETTTRDFFAGRKVVLFGVPGAFTPTCSNSHLPGFIENYDAIVSRGIDAVAVVSVNDAFVMGAWARFTGAEDKLVFLADGSGDFARAVGLDLDLSARGMGLRSQRYSMIVEDGIVKAINVEEVPGQAVTSGAARILEQL

SEQ ID NO: 41774 - protein, 196 aa, Triticum aestivum
  misc_feature (168)..(168): Xaa can be any naturally occurring amino acid
ELVGALVYYDGQHNDARMNVALAMTAACYGATVANHCEVVDLTKDDKGKVNGAKLRDTLNGDEWIVKAKGVINATGPFTDGLRKMDDAQNLDIVAPSAGVHIILPNYYSPRNMGLLDPATSDGRVIFFLPWQGNTIAGTTDSPTEVTQNPMPKEDEINWILDEVSHYXSADVKVRRSDVLAAWSGIRPLVRDPHAK

SEQ ID NO: 41775 - protein, 199 aa, Triticum aestivum
  misc_feature (98)..(98): Xaa can be any naturally occurring amino acid
  misc_feature (171)..(171): Xaa can be any naturally occurring amino acid
MATAFDSPTSSPAAAPFFYDPFLSFADSPTPAAGDVNVSGDDFPASPDPYAFRHDTAAAHPFGMGVFYGNGMHHHVKYGGGFTDSGPVLPDPAQMGAXDVFLLREWRRQNALLLDEKEKLENELNSQIILEDEQYKKAFVENLKLNLEDGKDHKREIGNRLLSNHDNFYKXAGEQYWNGISGLLPHEIGTIVKKHGHHP

SEQ ID NO: 41776 - protein, 312 aa, Pyrococcus furiosus DSM 3638
MIYAIGEILIDFIAKEEGKLKDVREFEKHPGGAPANVVVGLRRLGAKSALISKVGDDPFGEFLIEELKKERVETKYIIKDTNKHTGIVFVQLIGAKPEFILYDGVAYFNLRKEEIQWDFMRDAELLHFGSVLFAREPSRSTVFEVLRAVKGKVPISYDVNIRLDLWRGREKEMLKDIEEALKLADIVKIGDGELEYLNKNGIALEDFNFALVAITRGAEGSTIIHKDIRVDVPSFKVEPVDTTGAGDAFMAALLASLFYMGKLDILEFSKEELKELGSFANLVAALSTTKRGAWSVPSLEEVLKHRKFSFLP

SEQ ID NO: 41777 - protein, 696 aa, Aspergillus nidulans FGSC A4
MTLNLDSKDHSNFRLPHFPPPLHTRSGNEAFDRPSTPRDDGFTSPISTPLGSPSKSRMPPGALDLPSVFDNALKLQPSSPTKNAHNNFNHPMFTLPNQSGETFNESVIRPASPSRRPKNENTLPQSAPLTKDLGRNPAAAAISRQEQYHTRDLESVQRRQVPMRGLTPEELEKLQNPRVKRLVNVTQLYFLDYYFDLLSYVHNRQTRYSQFCAANPEPPATPIEEYEPALSKYLGRERAHLRKRRTRLRQGDFQILTQVGQGGYGQVYLASKKDTKEVCALKVMSKKLLFKLDEIRHILTERDILTAAKSEWLVKLLYAFQDETQIYFAMEFVPGGDFRTLLNNTGVLHNRHARFYIAEMFCCIDALHALGYIHRDLKPENFLIDSTGHVKLTDFGLAAGMLNPRKIESMRVKLEEVGNTPVPFGRPMEQRTMAERRQGYRSLRERQVDYAKSIVGSPDYMAPEVLKGEEYDFTVDYWSLGCMLFEALAGYPPFAGSTVDETWQNLKNWQKVLRRPVYEDPNYFLSKRTWNFITTLVASREHRFKNISEIHAHEYFSEVDFSRLREQRPPFVPQLDSETDAGYFDDFENEADMAKYKEVHDKQRALEEMAERDEKMAKGLFVGFTFRFVPCFLLVNDESNQLQTSQAEHRRNWASLSPQADTNRGLWYYLLGLMTLLSPLSLLWSGQAGLEWPLSD

SEQ ID NO: 41778 - protein, 236 aa, Brassica napus
  misc_feature (74)..(74): Xaa can be any naturally occurring amino acid
MSSQICRSASKAARSLLSSAKNARFFSEGRAIGAAGAVTASGKLPLYASNFARSSSGSSKSWITGLLALPAAAXMVQDQEVFAAEMERTFIAIKPDGVQRGLISEIISRFERKGFKLVGIKVVVPSKDFAQKHYHDLKERPFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 41779 - protein, 267 aa, Glycine max
MRSTIVLRLGRRARIPFQRALATQSNNNNTLVFIPLPRCLSATRSFHFQRNSPFGFSSGHGQRRSMFIQTQPTPNPSSLMFYPGKPVMEVGSSDFPNPRSAMNSPLAKSLFAIDGVTRVFFGSDFVTVTKSEEAAWEFLKPEVFAAIMDFYSSAQPLFLDSQAAAAMDTAIHQDDSETVAMIKELLETRIRPAVQDDGGDIEYRGFDLDTGIVKLRMQGACSGCPSSSVTLKSGIENMLMHYVPEVKGVEQELDAEDDGAALSGEIK

SEQ ID NO: 41780 - protein, 471 aa, Prochlorococcus marinus str. MIT 9301
MDNSNVNIVKNICCLGAGYVGGPTMAVLASKCPNIKVTVVDIDLNKIAAWNNQNLDKLPVFEPGLDKIISKVRGKNLFFSNDIEKSIKDSELVFISVNTPTKIKGFGAFYASDLKWVESSARQVAKYASGHTIVVEKSTVPVKTAELIKKILKSSNSSNKKKENSFSVLSSPEFLAEGSAINDLINPDRVLIGGDNEESIKKLCAIYENWIPKEKILVTNIWSSELSKLTANAFLAQRISSINSIAAICEKTGAEIKEVSAAIGSDTRIGNKFLLSSPGFGGSCFQKDILNLVYLSRYYGLDHVAKYWENVISLNNWQKERISEVIVDKLFGTITGKKIVLLGFSFKANTNDTRESPSIDIAKNLLENGAKLVINDPRVSNKQIELALNQPSKEIDHNVEGIWYYEEDILEAVKSADAIVILTEWQEYKNLNWELISKSMRKPSWVFDTRGIINRREIDVTPINLWTLGKG

SEQ ID NO: 41781 - protein, 344 aa, Prochlorococcus marinus str. MIT 9301
MKKDKPSILITGAAGFIGSALAIKLLEENNHVIGIDNINNYYSTSFKKERLSNIIKSPNSSKYWNFHKISIENKNQIFNIFEKYRPKIVVNLAAQAGVRYSLENPEAYIKSNLVGFFNILEACKSFDVENFIYASSSSVYGGNKKVPFKENDSSNHPISLYAATKRSNELMAHSYSHLYDIPSIGLRFFTVYGPWGRPDMAPMIFANAIMNQLPINIFNFGKMKRDFTYIDDVVESIKRCCFKPATVSNTFDKFDPENSCSFAKHRIFNVGNSKPVELEIFIELLEDALGKKAIKKYDELQKGDVISTLSDTSLLTKWIDFTPSTSIQDGILYFAKWFENYYEH

SEQ ID NO: 41782 - protein, 772 aa, Novosphingobium aromaticivorans DSM 12444
MADAATEARTEGRTVRLQVAGARQEESGHGIARISRHVMSQLGVTEGDVIEIVGKRATAARVIQPYPEDEGLELIRLDGLQRANADVGSGEHVEVRKIDSRPAQRVVFAPAQKDLRLQGPAVALKRNFAGRPLVTGDLVATAGQQQVNRTDMPPQLRQMLNAPAFALTQIRLTVVSTSPKGVVHIDENTEVELRPEYEEPRSSRADVNYDDVGGMGDTIRQLREMVELPLRYPELFTRLGVDPPKGVLLHGPPGTGKTRLARAVANESDASFFTINGPEIMGSAYGESEKRLREVFEEATANSPSIIFIDEIDSIAPKRSEVHGEAEKRLVAQLLTLMDGLHSRSNLVVIAATNRPDAIDEALRRPGRFDREIVVGVPDESGRREILGIHTRGMPLAEDVDLQELARTTHGFVGADLAALAREAAIEAVRRIMPRLDFEQQTIPQDVLDSLRVERDDFLEALKRVQPSAMREVMVQAPTIGWADIGGLDEAQEKLREGVELPLKNPEAFHRLGIRPAKGFLLYGPPGTGKTLLAKAVAKEAEANFIAIKSSDLLSKWYGESEQQIARLFARARQVAPCVVFIDEIDSLVPARGSGQGEPNVTARVVNTILAEMDGLEELQSVVLIGATNRPNLVDPALLRPGRFDELVYVGTPSMSGREHILGIHTRNMPLAPDVDLALVARATDRFTGADLEDVVRRAGLNAIRRGGGNVDQVKASDFDEALEDSRATVTEQMEEEYGRMKGELKKRAMNPGPLGFIVPGMVQPTRESKHG

SEQ ID NO: 41783 - protein, 287 aa, Nicotiana tabacum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAIFYIVMQCLGAICGAGVVKGFMVGPYQRLGGGANVVNHGYTKGDGLGAEIIGTFVLVYTVFSATDAKRNARDSYVPILAPLPIGFAVFLVHLATIPITGTGINPARSLGAAIIYNTDQAWDDHWIFWVGPFIGAALAAVYHQIIIRAIPFHKSS

SEQ ID NO: 41784 - protein, 342 aa, Oryza sativa Japonica Group
MANVALLSAASPSTSSAAPRLRHVARRRPSRRSACPRSAASRLSIMAALGEDPIRQWILTEGKATKITGVSSIGGGCINSAQCYKTDASSFFVKTNGRIGPSMFEGEALGLKAMYDTNSIRVPLPYKVGSLPTGGSFIIMEFIEFGCSRGDQSALGRKLAEMHKAAKSDKGYGFYVDNTIGSTPQINTWTADWIEFYSKHRLGFQLELITQRFGDSAIYDKGQRLIENMHPLFEGAVMEPCLLHGDLWSGNISSDTNGEPVILDPACYYGHNEAEFGMSWCAGFGGEFYSSYFEVMPKQPGFEKRRDLYLLYHYLNHYNLFGSGYRSSAMSIIDDYLRMLKA

SEQ ID NO: 41785 - protein, 422 aa, Zea mays
MIRPGSRDSQNYDNNNQRVHPQPVDENMNQNGDSVDTMIGRIFNNISSLKSAYIQLQEAHTPYDPDKIQEADKLVIEELTNLSELKHAYREKHPKPIAASPQDSRLLSEIQEQQNLLKTYEVMVKKFQSQIQTRDTEITHLQQQIDEAKLRKSKLEKKLKQRGLLNRESEESDEEENYFSIELTPSLFTSAVDNAYQSIHEFSKPLINMMKAAGWDLDGAANAIEPGVVYTRRAHKKFAFESYICQRMFSGFQEESFSIKDSNISVSNEAFFHQFLAVRAMDPLDVLSQNPDSVFGKFCRSKYLLLVHQKMEGSFFGNMDQRNYVMSGGHPRTPFYQAFLKLAKSIWLLHRLAYSFDPKAKVFQVKKGSEFSDIHMESVVKNIILEEGAERPKVGLMVMPGFLIGTSVIQSRVYLSDAKCAD

SEQ ID NO: 41786 - protein, 521 aa, Burkholderia thailandensis E264
MSFSRTEAAPAATLPDLAATLAAPRDGAFLQLGAAFLTRQPAAPLPAPYVVGFSDDAARMLGLDPALRDAPGFAGLFCGNPTRDWPQASLPYASVYSGHQFGVWAGQLGDGRALTIGELEHDGRRYELQLKGAGRTPYSRMGDGRAVLRSSIREYLCSEAMHHLGIPTTRALAVIGSDQPVVREEIETSAVVTRVAESFVRFGHFEHFFANDRPEQLRALADHVIDRFYPACRDADDPYLALLAEATRRTAELVAQWQAVGFCHGVMNTDNMSILGVTIDYGPFGFIDAFDAKHVCNHSDTHGRYAYRMQPRIAHWNCFCLAQALLPLIGLHRDAPSEDARAERAVEDAHAVLGRFAEQFGPALERAMRAKLGLELEREGDAALANQLLEIMDASRADFTLTFRHLARVSKHDARGDAPVRDLFVDRDAFDRWANLYRARLSEEARDDAARAAAMNRANPKYVLRNHLAETAIRRAKEKDFSEVERLAAVLRRPFDEQPEHDAYAALPPDWASTLEVSCSS

SEQ ID NO: 41787 - protein, 535 aa, Legionella pneumophila subsp. pneumophila str. Philadelphia 1
MAKLTTQINTSSQEFKNNQANMQALVTDLREKIHQISLGGDEKARTKHQQQGKLLPRERLHQLLDPGSPFLELSQLAAYQVYEDTIPAAGIITGIGRVAGNECVIVVNDATVKGGTYYPLTVKKHLRAQEIALINHLPCIYLVDSGGAFLPLQDQVFADKEHFGRVFYNQAQMSALNIPQIAVVMGSCTAGGAYVPAMADESIMVKNQATIFLGGPPLVKAATGEVISAEELGGAEVHCRHSGVSDHYAENDAHALHLARVAISNLNRKKPDSIHRVDTVPPLYDSEDLTGIIPTDPRKPFDIREIIARVVDGSEFDEFKALFGTTLVCGFARLYGYPIGIIANNGILFSESAQKGSHFIELCCQRKIPLVFLQNITGFMVGSKYEASGIAKHGAKMVTAVANANVPKFTIIVGGSFGAGNYAMCGRAYAPRFLWAWPNARISVMGGEQAANVLAQITREKYAKQGKEWSLEEEEQFKTQMRSQYETQGNPYYASARLWDDGVIAPQDTRKILGLGLSAALNAPIEDTRFGVFRM

SEQ ID NO: 41788 - protein, 309 aa, Geobacter metallireducens GS-15
MAQIYENLTDLIGKTPLLRLRKVAAGIEADIVAKLESFNPGGSVKDRIGVSMIRDAEGRGLINKDTVIIEPTSGNTGIALAFVCAARGYRLVLTMPDTMSVERRNLLKAYGAELVLTRGAEGMKGAINKAEELAADIPNSFIPQQFRNPANPHIHRFTTAEEIWTDTDGKVDVFVAGVGTGGTVTGVGEVLKKRNPGVKIIAVEPFDSPVLSGGHPAPHKIQGIGAGFVPEVLNREAIDEIFTVRNEEALETARRLAREEGLLVGISAGAAAFAALEVARRPENKGKRIVVVLPDTGERYLSTVLFQDQ

SEQ ID NO: 41789 - protein, 270 aa, Burkholderia thailandensis E264
MKIAFIGGGNMAAALIGGLVRRGVAASELLAVDINEDARQRAQAQFGVRTAAAIDATLAGYDAIVLAVKPQVLKEIATALAPHLSTQLVVSIAAGIRGADLSRWLGDYARVVRTMPNTPALVGLGVTGLSALPGVDAAGRDLASKVLGAVGETVWFDDESQLDAVTAISGSGPAYVFYFIEALQEAARQLGMNDEQGRALAVATFAGAAQLAVQSGEPASVLRERVTSKGGTTAAALASFDAQHVKDSIVRGVLAAQARAKEMGDELGAA

SEQ ID NO: 41790 - protein, 153 aa, Streptococcus pneumoniae
EHFIRGQYRSGKIDGMKYISYRSEPNVNPESTTETFASGAFFVNSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 41791 - protein, 2014 aa, Synechococcus sp. WH 8102
MKSDSDTEGTELWKDSTTGSLFIVDDGKEKSDRKQILDQGGWEPQLEFSDNWEGGSHTSTVFAVEATNNGYALVIKHEDTFNDHDTISGGEGYDTISGGEGYDTISGGEGYDTISGGEGYDTISGGEGYDTISSGEAEDTIFGGESNSVPPPSEAPTPFVQAKPDEDDSNSMVFWEILNLDSEARIDWSQISAFTESIAGYEKVFNQDLDLDGKIGVDIGALSSLQTDTTGYQLKVSTAGTVHIWDGTNSESIVDVTDINGGTPSMVVSDDWGEYGSFNIAPYAVVKIDGGSSLDYYQLAVKIHDVYSYYEGSILVSEERVEWEIYKVSLDGVIDSSEKTHAFSIIPWEPKFGQDMNGDDDFSGTVNIKYRRTDSSGVDGVSIGEADGQLYIINGATQIAVQDPWIEDNVNWGDGGYQSTALAAELNDNGTTVTTDDYYQLAVKQTNTWTDYWGGGQTQTDINWQVYAIDSAGRIDWEKTIWTQSIAGFENFFGEDLNNDGTKGIDSGNLKDAELDKYGYRLKKDSDNLLYIVDENGENTMPVKDEYGGFPSFDHSHSYWGGSHLSSAIAVEQNADLSFSLAVKRQDSWDGETNTSWEVLNISQAGVLSWDNAQWLDDITLLETTLFNDDLDGDGATGLDLSALNVLSTDIETTSGRLYSNAAEDRYYIRDGNSTLAIAHEWGEPIDFSGKENWGSFEFSREPIAAESHSFTGSDGSTYDGYILAIKNTFVDSSGSELVENIDWEIEYVKPSGVVDDMLRTHTNGIKGKEKLFAQDLDGDTQIGLDITKLVSVSTDTTGDLLKTLGESLYIFNDKNTTTTDDDVVIEVVDASGFTPWFDWQETWGYGDYAQVESASAYSVESLEDSEGNTNFLLGIKISSTYAGVEDTFWETFKIKESNPGEGDWYLDWDTGSFSKGSRRLESIFNQDLNGNGVVDSGSVSTQNVSTDTSTSGSRGAALAIDDEGSLYIKRGTNNPILIEDDNGPVTFDWNDAWGGYTRTSSAFAVEGLLNDAGTAIGSYKLAVKYQETDQRTDTTSTYWETFIVSSEGKLDWGSATWGKIKRHEGDLNEDMDGDNAIWSEANVQYTAVDTDTIGSKPYLDPENYLYVQPSGSTTKSAVLTESGDAFLATESFSYGNFAFSQAPLAVKDVTIGSGESALSYYKLLFEQTITEGSSDPVKEYMTLNIDQVSMKVDWATETYFFSHETLEDQFRLDLNDDGSVFEVNANSTTAIATDTAGAKLRQTSDGSLFIKDGENSAFAVTYADGLPVDLDVQETLSDVLSRSTKAIAVQKSGDLYKLVVKETTGLTVDGVETSSVVYVVYDVTTAGIFKPSSALYRTEAELNETTWSQDITGDGVVSQGSTSSASDAFADAVGTDVSQEVVDKFQNSSASDILSVKAADGSNPLSIFVPTGSGAKSNVDLTVKQVQSVDAPLMAKAVYDAGLTAQVQSRRAKTTDTSYEAVTGLLDTQITVTNQAKFGKIQSVSWVLPEDVGADPTYIAKNSVTGEFTNLQYDAETGEGAQWDETDRTLTLFVRDNGKNDESDDQGTIRTPGFVAARSSGTTSDSTTPTPTPSVTPTPTPSATPTPTPTPTPTPTPTPTPSATPTPSPSATPTPSPSATPTPSPSATPTPTPTPTPTPTPSATPTPSPSATPTPSPSATPTPSPSATPTPSPSATPTPSPSATPTPSPSATPTPSPSATPTPSPSATPDPTPTASDELPVDVSDLGSDDISSLTPDAVSELTAEQVNDLSPSAVQGFTAEQVSELSEETVAGFTAQQVQKLAPEAVAGFSKSQVSELTPTSLKGLSSEQMRVLPASAVEGLTAKQVSKLSEEAVSAFTPKQFKKLAPEAVAGFSKAQVSELTPKTIKVLGSEQVEQMPKRSFQALDTAQLAKLSKDAVTGLTSGQLRTLSGAEISAFKPAKIKSLDADAISGFKPATLNDFSRRQVKALSDDQLAGLTKKQIKKAGDFVDALTDRQIGALSFDPGRSNRLIDPLDDQNYSSLLSGLDLETLA

SEQ ID NO: 41792 - protein, 153 aa, Streptococcus pneumoniae
EHFIRDQYRSGKIDGMKYISYRSEPNVNPESTTETFASGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 41793 - protein, 475 aa, Schizosaccharomyces pombe 972h-
MLSIIVFGASGDLATKMTFPALFALYVRKIIPEDFQIIGYARSKLSQEAANKIVTAHIPIDDTVGASQKALNTFVEHYKYVPGTYDKPESFEMLNSIIAEKETAPASECTRIFYLVLPPHLFAPVSELIKSKAHPNGMVTRLIVEKPIGFDYKSADAILSDLSKHWSAKDTFKVDHFLGEDMIDGFTAIRFANSMFEPIWNREHIESVRVDFREDFGCEGRGGYFEGAGILRDVVQNHLLQLLTLLCIEEPKSQDAEDIIKCKVDFLKSLHPVSKEDIVYGQYTKSANGKVPGYRELDGVADDSEVSTFCALQLRSEAPRWKGIPIIISAGKGLDRDYFEARITFKRREGGMFPTVDSSNVLVLRVYPKEFIALKGHIKQPGFSRQIVPVTLDVKYPEAFPDTWIHKAYEVVIADAINGKHTHFISDDEVRTSWKIFDDVLDTTGDLSPLPYAFGSHHGPDATLEFFKKRNLEWD

SEQ ID NO: 41794 - protein, 338 aa, Bradyrhizobium sp. BTAi1
MADDPILVTGAAGFIGFHLAQRLLAEGRQVIGIDNINAYYDPKLKQARLDRLAAQPGFIFHKLDLVDRAGVKALFAAHHFPAVVHLAAQAGVRYSLDNPHAYVDANLEGFINILEGCRHHGCAHLLFASSSSVYGANTKLPFSVKDNVDHPISLYAASKKANELMAHSYSHLYRLPATGLRFFTVYGPWGRPDMAMFIFAKAILAGQPVRLFNHGQMRRDFTYIDDIVQAIHRLIGRPPQGNPDWDGTRPDPSSSRAPWRIYNIGNNHPEQLMDVITLLEKEFGRPAIKEMLPMQPGDVEATYADVSDLERDIGFRPATPIADGIARFARWYREYHQI

SEQ ID NO: 41795 - protein, 522 aa, Mycobacterium tuberculosis
  misc_feature (22)..(22): Xaa can be any naturally occurring amino acid
  misc_feature (126)..(126): Xaa can be any naturally occurring amino acid
  misc_feature (203)..(203): Xaa can be any naturally occurring amino acid
MAELNNKLAAAALGGNERARKXRHVSRGKLLPRERVDRLLDPGSPFLELAPLGRWRHVRRRNSPGAGIITGIGRVSGRQCVIVANDATVKGGTYYPMTVKKHLRAQEVALQNMLPCIYLVDSGGAXPDPRQDEVFPDREHFGRIFYNQATMSAKGIPQVAAVLGSCTAGGAYVPAMSDEAVIVREQGTIFLGGPPLVKAPARXEIVSAEELGGGDLHSRTSGVTDHLADDDEDALRIVRAIADTFRPVRTRPMGCAPFGRWPKYPQAELYDVVPPDPRVPYDVHEVVVRIVDGSEFSEFKAKYGKTLVTAFARVHGHPVGIVANNGVLFSESALKGAHFIELCDKRKIPLLFLQNIAGFMVGRDYEAGGIAKHGAKMVTAVACARVPKLTVVIGGSYGAGNYSMCGRAYSPRFLWMWPNARISVMGGEQAASVLATVRGEQLSAAGTPWSPDEEEAFKAPIRAQYEDQGNPYYSTARLWDDGIIDLRTPERLLGLPFRCVPTSAGSGWLRRLPDVRRCLTPY

SEQ ID NO: 41796 - protein, 101 aa, Triticum aestivum
MAEATLEGSEPVDLSKHPSGIIPTLQNIVSTVNLDCKLDLKAIALQARNAEYNPKRFAAVIMRIREPKTTALIFASGKMVCTGAKSEQQSKLQQEAVLSEL

SEQ ID NO: 41797 - protein, 427 aa, Bradyrhizobium sp. BTAi1
MSHGRKIAVIGLGYVGLPVAAAFARAGGPVLGFDIDAKRVAELRDGQDRTCEVDAADLRHPGLRFTSDPADLGSADFFIVTVPTPIDSARRPDLGAMLAATRSVAAVLKRGDIVVYESTVYPGAVEEDCVPLLESGSALKAGTDFNVGYSPERINPGDKTHRFETITKVVSAQNPHTLQIVAEVYGSVVIAGIHRAPSIKVAEAAKVIENTQRDLNIAFMNELSLIFQALEIDTGDVLAAAGTKWNFLPFSPGLVGGHCIGVDPYYLTYRAEKAGYHPEVILAGRRINDEMGRRIARECIRGLLKRRGRSGVVTILGMTFKENVPDIRNSRVIDIVRELQSFGVEVQVADPLADAAAVHEEYGIDLTAFAALRPADAVVLAVSHDQFLAGGWSLVQALLREGHGLVLDVKMKLDRASKPGAIELWRP

SEQ ID NO: 41798 - protein, 430 aa, Mesorhizobium sp. BNC1
MGVEVSRLSNGLTVATETLPHLESVALGVWVKSGSRNEREDEHGIAHLLEHMAFKGTTKRTALQIATDIEDVGGEINAATSVETTAFYARVLRDDMSLAIDILADILTDSKFDPHELEREQHVILQEIGAAHDTPDDAVFDRFTETAFRHQAIGRSILGTPDTVASFTSQQLRRFMERQYGADRMVVVAAGGVTHDEFVREVEARLGSFRDKADTAVPQYSNYVGGDYREHRDLMDAQIILGFEGRAYHVRDFYASQMLSMILGGGMSSRLFQEVREKRGLCYSVYAFHWGFSDTGVFGVHAATGQSDLGELMPVILGELQKAGERIDQAELDRARAQYRAGLMMSRESPASRASQVARQLLLYGRPIETEELMDRLAGITVERLADLSNRLFSSKPTVTAIGPVGSLAPFEAIRDTLVTSRPVLRKLAV

SEQ ID NO: 41799 - protein, 192 aa, Chlamydomonas reinhardtii
MLSRGVGWLARTGSVQHLGEQASCMVLGSSVLRSFSAQPQPSTSGSADVAVGSPKVQKLAEEIMGLTVLECSMLSEILRKKLGVQQPAFSMGAMPFAAAPAAPAAAPAAAAAPEKKEEKKEKTEFDVKLESFSAEGKIKVIKEIRALTTLGLKEAKELVEKAPVVIKVGVSKADAEAMKKQLETAGGKVSYE

SEQ ID NO: 41800 - protein, 623 aa, Arabidopsis thaliana
MQSAMALSFSQTSFTRPNHVLGSSGSVFSTPRSLRFCGLRREAFGFSTSNQLAIRSNRIQFLSRKSFQVSASASSNGNGAPPKSFDYDLIIIGAGVGGHGAALHAVEKGLKTAIIEGDVVGGTCVNRGCVPSKALLAVSGRMRELQNEHHMKSFGLQVSAAGYDRQGVADHANNLATKIRNNLTNSMKAIGVDILTGFGSVLGPQKVKYGKDNIITAKDIIIATGSVPFVPKGIEVDGKTVITSDHALKLESVPEWIAIVGSGYIGLEFSDVYTALGSEVTFIEALDQLMPGFDPEISKLAQRVLINPRKIDYHTGVFASKITPARDGKPVLIELIDAKTKEPKDTLEVDAALIATGRAPFTNGLGLENVNVVTQRGFIPVDERMRVIDGKGTLVPNLYCIGDANGKLMLAHAASAQGISVVEQVSGRDHVLNHLSIPAACFTHPEISMVGLTEPQAKEKGEKEGFKVSVVKTSFKANTKALAENEGEGIAKMIYRPDNGEILGVHIFGLHAADLIHEASNAIALGTRIQDIKLAVHAHPTLSEVLDELFKAAKVESHATTRTGDAKIKLNTNQEDRKGRRRGGDDEKQPSVSKDLKDISTRPSSFFENISVGVLSLLSLIFV

SEQ ID NO: 41801 - protein, 690 aa, Staphylococcus aureus subsp. aureus MW2
MLRGQEERKYSIRKYSIGVVSVLAATMFVVSSHEAQASEKTPTNAAVQKETLNQPGEQGNAITSHQMQSGKQLDDMHKENGKSGTVTEGKDTLQLSKYQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 41802 - protein, 199 aa, Wolbachia endosymbiont of Drosophila ananassae
MNLVTKSAIDFTASSVLSDGEIVDDFCLSKRIKNKYAVLFFYPLDFTFVCPTELISLNNRITEFAKRGVEVIGISVDSKFSHYKWRNTPVNDGGIGEISYTLVSDIKKSISRDYGVLYDDSIALRATFVIDDKFIVRHQSINDLPLGRNIDEFVRIVDAIKHNEEHGEVCPAGWKKGKPAMQASDEGVADYLNSYSEEL

SEQ ID NO: 41803 - protein, 176 aa, Rhizobium etli
PIENTIAGRVADIHHLLPDSRLHIIGEYFMPIRFQLMVLPGVTKDEIRTVHSHIHALGQCRKIVRAHGWKPVIAGDTAGAAKLVKETGDRSMAALAPRLAADLYGLEIVAENVEDTENNVTRFVILSRDEEWAQRTSAEEKVVTTFVFNVRNIPAALYKALGGFATNNINMTKLES

SEQ ID NO: 41804 - protein, 194 aa, Oryza officinalis
VLYARVRTNGVVQIQFSPVGENKRGREVYRLYDVGGQRNERRKWIHLFEGVNAVIFCAAISEYDQMLFEDETKNRMMETKELFDWVLKQRCFEKTSFMLFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGI

SEQ ID NO: 41805 - protein, 580 aa, Pyrococcus furiosus DSM 3638
MSFFQGRKMEVEKLALKYALINAIEHDGKANPKAVIGKILGENPELRKKAREIVPIVNKIVEEVNTLSLEEQKKKLEEIYPEYFMEGTKKEKEEKKQLPPLPKAEKGKVVTRFAPNPDGAFHLGNARAAILSYEYAKMYDGKFILRFDDTDPKVKRPELIFYDMIIEDLEWLGIKPDEIVYASDRLEIYYKYAEELIKMGKAYVCTCPPDEFRKLRDQGIACPHRDEPVEVQLERWKKMLNGEYREGEAVVRIKTDLNHPNPAVRDWPALRIVDEPNHPRTGNKYRVWPLYNFASAIDDHELGVTHIFRGQEHSENETRQRYIYEYFGWEYPVTVHHGRLSIEGVILSKSKTRKGIEEGKYLGWDDPRLGTIRALRRRGILPEAIRELILEVGLKKSDATVSWDNLAAINRKLVDPIANRYFFVADPIPMYIEEAEEFEAKIPLHPDHPERGYRVLKFEPGKPIYVSKDDLSLLKPGGFIRLKDLFNVEILEVGDTIKARFHSHEYEVARKNKWRMIHWVPEGKECEVIIPEGEELIIRKGLLEKNANVKEGEIVQFERFGFVRIDKIENDKVIAIYAHK

SEQ ID NO: 41806 - protein, 183 aa, Rhizobium etli
EVQKQAARCMDCGIPYCHGPTGCPVHNQIPDWNDLVYNNNWEAAIQNLHSTNNFPEFTGRVCPAPCQEACTLNLEDAPVAIKTVEQAIADKAYELGFIRPQPATVHTGKKVAVIGSGPAGMAAAQQLGRAGHEVHVYERETKPGGLLRYGIPDFKMEKNFIDRRVEQMKGEGVTFHCGVNVGV

SEQ ID NO: 41807 - protein, 298 aa, Oryza sativa Indica Group
MALLLSTSVLLVMCLLPVDPAAPPVAAIPHRRSGRHYVPFGRHAAFGPFATEVELLLHGGGAVPDIRTFRDTLDRLPDWSHFDAELGPLERYFGSDGELNVKERLLYLFPMLHRAPKDGGVSCGELEAWLRRQAADRLDAVARRELKRHDKDGDGSAAAPDNTSSQGSGMDHDRDGKLSLDEFISQFHMIDHNSIVEHSADDDTSCAEAEKKFRELDSNNDGYLTVEEARPVIQSLISGEFSYAKSHAKLLMKADDNKDNKLSLEEMLNHYLSFYNIVYMDDHYDYDDIGNNIHDELR

SEQ ID NO: 41808 - protein, 315 aa, Nostoc sp. PCC 7120
METITLGKNGPTVTPLCIGTWAWGDKLFWNYGNGYGSEQLQEAFTAALEAGVTFFDTAEVYGLGLSEELLGQFVKQAKQPVQIATKFGPLPWRFSGQSVSDALTDSLKRLQLERVDLYQVHWPFTFLLSQETLMNTLADEVKRGRIAAVGVSNYSASQMRQAHQILAARGVPLAVNQVRYSLVSRQIETEGIVATARELDVTILAYSPLAQGLLTGKYSADSDEVPTGARSIDPRFKKEGLQKIAPVISLLRSLGEKYDRTPAQVALNWLIAQGNVIPIAGVKTAQQVRQNAGALGWRLNDEEVQELEKVSRPWK

SEQ ID NO: 41809 - protein, 289 aa, Rhodococcus sp. RHA1
MSPHPETAQENHAMTDTHSPGLVPNTADEFEGRVAVVTGGGSGIGRAVAMRWAAAGGTVVVFGRRQNTLEDTVRAAEGVGGKAQAVVCDVRDSDAVDAAIDGVVDRYGRLDALVNNAAGNFVVPSEDLSPGGWKAVVDIVLNGTFYCTRAAGRHMLATGRGTILNTIASYAWHGHPGTVHSAAAKAGVVAMTRTLAVEWGGRGVRINCIAPGPTETEGAGAALWPTEQDRARVLSSVPAARFTTPEEVAESAAFLLSDRSGYITGEVLVTDGGQWLGKSVYTDSQAAAR

SEQ ID NO: 41810 - protein, 752 aa, Oryza sativa
MAATPDRANADLRRRLAVDAPPPPPQIAKDKQGLDTEMPLSPQWLMKVGENKEPSLLGVRSDGSKIPGNDEDTSFSVKRKDVFRASVLDGETGCRERWRDDEREPNSAPRWNRWRETDKEHGDTRKLERWSDDSSKYSVDGRRPPQERWSDSGNKEGNYDQRRDNKWSARRGPNDKESENWRDRWGDSGKDGDAAREKGFSHYIAHGKDGNSHEKDAERDDNISRSWKSSYPVGRGRGDSSHHPSQNTQKSSATYGYGRGRPGNEIASFPGSRGKFTSGSTNTASSGSSRPFHLGLLSDRPGGTSGDRTAFRYSRIIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNLPKDIANRHVLLLDPILGTGNSAVQAISLLLKKGVQETNIIFLNLISAPQGVHVVSKRFPRVKIVTSEIEFGLNDDFRVIPGMGEFGDRYFGTDDYQSSTPFFCDEKNRVRLL

SEQ ID NO: 41811 - protein, 253 aa, Triticum aestivum
  misc_feature (188)..(188): Xaa can be any naturally occurring amino acid
  misc_feature (191)..(191): Xaa can be any naturally occurring amino acid
  misc_feature (216)..(216): Xaa can be any naturally occurring amino acid
  misc_feature (221)..(221): Xaa can be any naturally occurring amino acid
  misc_feature (227)..(228): Xaa can be any naturally occurring amino acid
  misc_feature (238)..(238): Xaa can be any naturally occurring amino acid
HYRTSLYKKAGWHRSGIPGISSTHASGIIKHKKNKRAWDEQTNSWKRTYGYDRVNDDRDVPIIEAKLTDEPGVDPFAQRREEKKGRVDKQEKNRLGNLKNAAKVGALPSHIQLAATSVPITGTKADLPRKGKKEDLENVAGMASAATAIGGKFDKKLPGEKPLKKAGKNRKFLPVVEGKGMGNLEKQXNDXILNSLLAKNFEEPLDVSKAITMYKXEEGQXRRRKDXXSSSSSGSNKXKPQKKIHKKSSKKSA

SEQ ID NO: 41812 - protein, 429 aa, Pseudomonas fluorescens Pf-5
MAKIVDIKGREVLDSRGNPTVEADVLLDNGIIGSACAPSGASTGSREALELRDGDKSRYLGKGVLKAVANINGPIRDLLLGKDPIDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLNTAVGDEGGFAPNLASNEDALKVISEAVANAGYTLGTDVTLALDCAASEFYEDGKYNLSGEGQVFTAEGFAEYLKGLTQRYPIISIEDGLDESDWAGWKILTDKIGEKVQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRGEFRG

SEQ ID NO: 41813 - protein, 326 aa, Rhodococcus sp. RHA1
MTANWIDNQKNLMLFSGRAHPELAEQVAKELDVRVTPQTARDFANGEIFVRFEESVRGSDAFVLQSHPAPLNTWVMEQLIMIDALKRGSAKRITAILPFYPYARQDKKHRGREPISARLIADLLKTAGADRIITVDLHTDQIQGFFDGPVDHMHAQGQLAEYIRGNYGTDNIAVVSPDSGRVRVAEKWADTLGGAPLAFIHKTRDPLVPNQVKSNRVVGDVEGHTCILIDDMIDTGGTIAGAVKILKEAGAGDVIIAATHGVLSDPAAERLAACGAKEVIVTNTLPIDESKKFPTLTVLSIAPLLARTIKEVFENGSVTSLFNGNA

SEQ ID NO: 41814 - protein, 153 aa, Streptococcus pneumoniae
EYFIRGQYRSGKIDGMKYISYRSEPNVNPESTTETFASGAFFVDSDRFRGVPFFFRTGKRLTEKGTHVNIVFKQMDSIFGEPLAPNILAIYIQPTEGFSLSLNGKQVGEEFNLAPNSLDYRTDATATGASPEPYEKLIYDVLNNNSTNFSHWD

SEQ ID NO: 41815 - protein, 280 aa, Haloarcula marismortui ATCC 43049
MSNGWFAGLDPDDDAAAVEQIEAGRADTPEDWPQQAVEAGFADDEAAYYDRLHEVTMAATSAAVAEQEGADDQQLVHAVRAMADCERTANELAERVAEWGGSRHGDSGSGVEYARSLADREDEDEGDRALRSLAEQTAALADEADSIRAYIERTAPAVAPNLSMLAGPVLAARLISLAGGLEALAKKPSGTVQVLGAEDALFAHLKGSAPSPKHGVIFTHEYVRGTRREDRGSAARAFAGKLSIAARIDHYSGDRRPDLQVELDERIERIQARAEEGDDE

SEQ ID NO: 41816 - protein, 604 aa, Gibberella zeae PH-1
MSSNGTQEAPIEVRRICCVGAGYVGGPTAAVVAFQNPQIQVTVVDRDVNRIRRWNSRHPPIYEPGLHDIIRIARDGGRPGKISGEPTTDSEGSSAEEGEITINERKPNLFFSTDVAKHISEADVVLVAVNTPTKYRGVGAGSATDMTAFEAVTGVVAQYAREGAIIVEKSTVPCRTAQLVADTLNMYRPGVHFEILSNPEFLAAGTAVNDLLYPDRILIGSAPTPSGKRAAEALVKVYNAWIPRERILTTNVWSSELAKLVANSMLAQRISSINSISAVCEQTGADVDEVAKAVGVDPRIGNKFLMAGIGFGGSCFKKDVLNLVYLAETMGLPEVAEYWRQVVKMNEYARDRFSNRVIKCLNNTLVGKKVTILGFAFKKNTSDTREAPALEMIKTLLEERPREIAVFDPCCNPLVIKSEIKELLGPLAEGHNITVHGNAYDACEKSTAIIIATEFDEFRNQPPPPPAPQPTVQPKTIGRKPNPKTDPRPFKEGGSPNELLALHKHLVQRPDVSSQDPLDRFNVEPNCDDDCPDCIQERESKESGFATGMGSSEEYKPKERVDWVRISESMAKPRWVFDGRGVIDSREMVKLGVRVESVGRQHQF

SEQ ID NO: 41817 - protein, 466 aa, Shigella flexneri 2a str. 2457T
MGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDPWLTWLVIGFITFVLVVMLFRPAQQLEVISTGLLAIGIICTVPIMARWKKLVLWQKTPVHNTR

SEQ ID NO: 41818 - protein, 483 aa, Schizosaccharomyces pombe 972h-
MLSANMLRRMHHGVAVTRMLLVSNGKVQVKKSALYPVMAKLARTYATKNYPAHTVINMPALSPTMTTGNIGAFQKKIGDKIEPGDVLCEIETDKAQIDFEQQDEGYLAKILIETGTKDVPVGKPLAVTVENEGDVAAMADFTIEDSSAKEPSAKSGEEKSAPSSEKQSKETSSPSNVSGEERGDRVFASPLARKLAEEKDLDLSQIRGSGPNGRIIKVDIENFKPVVAPKPSNEAAAKATTPAASAADAAAPGDYEDLPLSNMRKIIASRLAESKNMNPHYYVTVSVNMEKIIRLRAALNAMADGRYKLSVNDLVIKATTAALRQVPEVNAAWMGDFIRQYKNVDISMAVATPSGLITPVIRNTHALGLAEISTLAKDYGQRARNNKLKPEEYQGGTFTISNLGMFPVDQFTAIINPPQACILAVGTTVDTVVPDSTSEKGFKVAPIMKCTLSSDHRVVDGAMAARFTTALKKILENPLEIML

SEQ ID NO: 41819 - protein, 182 aa, Photobacterium profundum SS9
MHSALRSYKGITPTLHENVYIDSSAVLIGDIELNTDTSIWPLVAARGDVNHIKIGARSNVQDGAVLHVTRKTPDNPTGHPLIIGDDVTIGHKAMLHGCHVGHRVLVGMGAILLDGAIIEDDVIIGAGSLVPPGKVLKSGFLYIGSPVKQARPLNDNERTFLPTSADNYVRLKNEYLAESENL

SEQ ID NO: 41820 - protein, 228 aa, Parvularcula bermudensis HTCC2503
MSDDKKQRAAAAALAHVRPGMTLGLGTGSTAAHFVKLLGDQGFEGQAIPTSEETARLAEAVGISLITPDETTRIDLAVDGADEADPSGALIKGGGGALLREKIIAQQAQTFIVIADDGKDVVQLGQFPLPVEVTGFAVGLTIQAIRSTLAALGYEDPSLTLRRGEGGFFQTDGGHLIVDIALGRIDEAEPLDAALTMIPGVVTTGLFVGLTDLMIFGTESGVREAVPT

SEQ ID NO: 41821 - protein, 472 aa, Triticum aestivum
MAAVVSDLVDFLNASPTAFHAVDEAKRLLKAAGFEQLSEREEWSGLQPGRKYFFTRNHSAIVAFAIGAKYVAGNGFHIIGAHTDSPCLKLKPVTKITKGGYLEVGVQTYGGGLWYTWFDRDLTIAGRVLVREKKDGVVSYGHKLVRVQEPIMRIPTLAIHLDRTISSEGLKINNQNHLVPVLGTLIKHEMQKLVEGNVPGESSGGENTKHHPLLLQLIAKEANCEVDEICDFELQLCDTQPSVVAGAMKEFIFSGRLDNLCMSFCSLKALVESTSTDHSLDHESGVRMVALFDHEEVGSDSAQGAGSPAMLDALTRITGCFNHSNSKLLEKAIQRSFLVSADMAHALHPNYMEKHEENHQPKLHGGLVIKHNANQRYATNAVTAFIFREIAERHQLPIQDFVVRNDMACGSTIGPILASGVGIRTVDIGAPQLSMHSIREMCAVDDVNYSYEHLKAYFEEFTELDNKVKVDC

SEQ ID NO: 41822 - protein, 457 aa, Parvularcula bermudensis HTCC2503
MAYDYDLFVIGAGSGGVRAANRSAKFGAKVAIAEQADVGGTCVIRGCVPKKLMVYASEFNDMIGDAAGYGWEIPDARFDWATLRDRIQTELGRLSSLYIKGLEGNGVTLFQCRAIVKDPHTVHLASENRDVTAEKILVAAGGVPFRDDEADPDRLGIVSDDVFHLDKRPDRLVVAGGGYIAIEFAHIFARLGTEVTLVYRGHRLLRAFDREISERVEQDLIASGIRYIPNTIFARIDRDGDDKTVELTTGEVLRTDEILWAIGRRPRTSGLGLEDCGVEKTANGAVIVDQDYRTACPSIFSLGDVTDRINLTPVAIREAMAFASTQFGGEPKRMDYRHVPKAVFCQPPVGSVGMTEDECLDEGHRIDVFEADFRPMKNVLAGNDKRMLMKLIVDAETDRVLGCHMVGEAAPEMVQIAAIAVKAGLTKAQFDETCALHPTSAEELVTLSSSRPGKAST

SEQ ID NO: 41823 - protein, 346 aa, Debaryomyces hansenii CBS767
MSIPKTQKAIIFETSGGELKYADIAVPKPKPNEILINVKFSGVCHTDLHAWKGDWPLPTKLPLVGGHEGAGEVVAIGENVQGWEIGDLAGIKWINGTCLNCEFCQNSNESNCAKADMSGYTHDGTFQQYATADAVHAARIPKGTDLASVSPILCAGITVYKALKTSGAKPGQWVAISGAAGGLGSLALQYAKAMGFRVLAVDGGDKGEFVKSLGAESYVDFTKSKDVVKEILETTGGGPHAVINVSVSVAAMNQSTEYVRSCGTVVLVGLPHAKLEAGIFNTVVKCVSIKGSYVGNRADSAEAIDFFARGLIKCPIKVVGLSELASIYKLMEEGKILGRYVVDTSK

SEQ ID NO: 41824 - protein, 417 aa, Zea mays
MGSSPMWWSGPPPSPWSRGLGKWWALVGPFVVKAVGFLLLAGLLFRVLWSFPSSPAPALQITKGKCSLFNGEWIPNPSGPAYTNASCRFIDDHQNCMMNGRPDKEYLHWKWKPYGCDLPPFDAVRFLDSVRNKGWGLIGDSILRNQVQSLLCLLSKAEEPVEVYHDNEFKNRRWHFQSYNFTVSIVWAPFLIKSGIFENEDGVSTSEIQLHLDILDANWTSQYESFDYIIISGGQWFLRTAVYWENGAVVGGHNSQNKNVAELGFEHLYQKTLQNVFNFIVSAKHKPVIFFRTWSPDHFEDGEWFSGGSCRRKLPYNKGEYREGNIERVMRQIELESFNKAVAALRGSADMDRLRLMDTYSLSSLRPDGHVGPYRTPYPFARGSSKSTPVQNDCLHWCVPGPIDAWNDLVMKMALDP

SEQ ID NO: 41825 - protein, 202 aa, Saccharomyces cerevisiae
MGIIEEKALFVTCGATVPFPKLVSCVLSDEFCQELIQYGFVRLIIQFGRNYSSEFEHLVQERGGQRESQKIPIDQFGCGDTARQYVLMNGKLKVIGFDFSTKMQSIIRDYSDLVISHAGTGSILDSLRLNKPLIVCVNDSLMDNHQQQIADKFVELGYVWSCAPTETGLIAGLRASQTEKLKPFPVSHNPSFERLLVETIYS

SEQ ID NO: 41826 - protein, 234 aa, Vitis vinifera
MSQVPSVTAVQVENVLFPPSVKPPGSTNDLFLGGAGVRGLEIQGKFVKFTAIGVYLENSAVPTLAVKWKGKTVEELADSVDFFRDVVTGPFEKFTKVTTILPLTGRQYSDKVSENCVAFWKSVGIYTDAEAKAIEKFNEVLKDETFPPGNSILFTHSPLGALTMSFSKDGSLPEVGNAVIENKLLTEAVLESIIGKHGVSPEAKKSLAARLSELFCKEAGDEKIEAEKVAPVAC

SEQ ID NO: 41827 - protein, 343 aa, Synechococcus sp. WH 8102
MSRRLLLLATGGTIAGQASDPTRLNDYTAGAMAGDALLAAVPQLQNLATISVEQVANVDSAELLFEHWRALVARIRAVFAADAELTGVVITHGTNTLEETAWLLQLLIDDPRPVVLVGAMRPATALSADGPLNLFQAVQVALSPEARGHGVLVVMDGQIHPSRHVGKVATQGVGAFASPGYGPLGCVDDMGVHLPTATGSRQVPFAALALPEQWPQVPIVYGCVEPDPLILQACLNAGAPGLVFTGTGAGQLSAGERSVLQAWAGSRPLMLRANRCGSGPVHHHHEDERLGLLPAGNLSPQKARVLLLLALIAGLSRDDLAELISAAPVTATPIIATPIIATP

SEQ ID NO: 41828 - protein, 359 aa, Saccharomyces cerevisiae
MALVSRRSTRSESTSITKEEHTGEGSLTKLFFRWLVTLEGDQDINDGKGYISLPNVSNYIFFLGGRFMTVKGAKPLWLGVLLAIVCPMVLFSIFEAHKLWHTQNGYKVLVIFFYYFWVITLASFIRTATSDPGVLPRNIHLSQLRNNYQIPQEYYNLITLPTHSSISKDITIKYCPSCRIWRPPRSSHCSTCNVCVMVHDHHCIWVNNCIGKRNYRFFLIFLLGAILSSVILLTNCAIHIARESGGPRDCPVAILLLCYAGLTLWYPAILFTYHIFMAGNQQTTREFLKGIGSKKNPVFHRVVKEENIYNKGSFLKNMGHLMLEPRGPSFVSARKPHEAGDWRFMDLSPAHSFEKIQKI

SEQ ID NO: 41829 - protein, 456 aa, Xylella fastidiosa Dixon
MVIHSSVLELIGNTPIIKAQRLDTGLCDLFLKLESANPGGSIKDRVGLSMIEAAECRGHIKPGATLVDGAASSTSMGLAFVARQKGYRLILVVPDNMGWEKISNLKAMGAEVILTRSDVSKGHPEHYQDLAEKLAAETPGAYFINQFGNADNPAAHEFGTGPEILKQMGGHVDAVVLGCDSAGTITGLSRAFDSVASDVELILADPVGSILTQYINEGTRSDKSGTWLVEGIGSDCLPPISDFRRIKKTYAISDAESFHTARELLSKEGILGGSSTGTLLAAALKYCREQIERKRVLVFVCDTGNKYLLNMYNDDWMLDNGFLKRPHYGDLRDLILHPYSQRHTVVVDPNDLLTVAYQRMKRYGVSQLPVIEDRQLVGILDESDVLLHVYGDETRFCDPVSTAMVSKLHRLDVKSPIEALLPVFERGQVAIVMEDDQFLGLITRIDLLNYLRRRMQ

SEQ ID NO: 41830 - protein, 163 aa, Marinobacter sp. ELB17
MRRIISVLLENEPGALSRVVGLFSQRNYNIETLTVAPTEDPTMSRLTVTTTGSERVIEQITKQLNKLIEVIKLVDLTEGAHIERELMLVKLKATGSQRAEIKRTVDIFRGQIVDVTSSVYTVQLAGDSAKLDGFIQAIGATGVLEVVRSGVSGIARGEKVLSL

SEQ ID NO: 41831 - protein, 887 aa, Mesorhizobium sp. BNC1
MTKWVYSFGDGKAEGRASDRNLLGGKGANLAEMCSLGLPVPPGFTITTEVCTHYYANGRAYPAELEAQVNAALDEVGRIAGRRFGDPDRLLLVSVRSGARASMPGMMDTVLNLGLNDETVGALAAESSDERFAYDSYRRFIQMYGNVVLDVEHEVFEEILADEKARRGYDVDTDFTAADWKEVVDLYKEKVESELGRPFPQDPHEQLWGAISAVFSSWMNPRAITYRRLHDIPESWGTAVNVQAMVFGNMGQTSATGVAFTRNPSTGEKALYGEFLVNAQGEDVVAGIRTPQCLTEAARREAGSDKPSLEKVMPQAFAAFVDIAEKLEQHYRDMQDLEFTIERGKLWMLQTRSGKRTTKAALKIAVDMANEGLISKAEAICRIDPASLDQLLHPTIDPSAKRDAIAVGLPASPGAATGEIVFSPDEAEEMAGRGKKVILVRVETSPDDIHGMHAAQGILTTRGGMTSHAAVVARGMGKPCVSGAGTLRVDTRAGTMVSMGRSFQRGDVITIDGSTGQVLVGAVPMQQPELSGDFSTLMGWADELRRMKVRSNAETPADARTARSFGAEGIGLCRTEHMFFDGDRILAMREMILSDTEEQRRAALAKLLPMQRADFTELFEIMAGLPVTIRLLDPPLHEFLPHGEAEIGEVAAAMGVDREKLRQKAESLHEFNPMLGHRGCRLAISYPEIAEMQARAIFEAAVDAAEKSGSPVVPEIMVPLVGISSELSFVKAIIDDVAKKVQAERGAAIEYLVGTMIELPRAALNAGEIAREAEFFSFGTNDLTQTTFGISRDDAAGFLEVYRKKGLIEHDPFVTLDVDGVGALVRIAAEKGGAARKGIKLGICGEHGGDPASIAFCEEVGLDYVSCSPFRVPIARLAAAQAACRKG

SEQ ID NO: 41832 - protein, 669 aa, Arabidopsis thaliana
MKFFVLVLLLVLQFFSNKALSQSEEGEFGFNGYLYDNSGIAITNSKGLMKLTNSSEFSYGHVFYNSPVRFKNSPNGTVSSFSTTFVFAIVSNVNALDGHGLAFVISPTKGLPYSSSSQYLGLFNLTNNGDPSNHIVAVEFDTFQNQEFDDMDNNHVGIDINSLSSEKASTAGYYEDDDGTFKNIRLINQKPIQAWIEYDSSRRQLNVTIHPIHLPKPKIPLLSLTKDLSPYLFDSMYVGFTSATGRLRSSHYILGWTFKLNGTASNIDISRLPKLPRDSRSTSVKKILAISLSLTSLAILVFLTISYMLFLKRKKLMEVLEDWEVQFGPHRFAYKDLYIATKGFRNSELLGKGGFGKVYKGTLSTSNMDIAVKKVSHDSRQGMREFVAEIATIGRLRHPNLVRLLGYCRRKGELYLVYDCMPKGSLDKFLYHQPEQSLDWSQRFKIIKDVASGLCYLHHQWVQVIIHRDIKPANVLLDDSMNGKLGDFGLAKLCEHGFDPQTSNVAGTFGYISPELSRTGKASTSSDVFAFGILMLEITCGRRPVLPRASSPSEMVLTDWVLDCWEDDILQVVDERVKQDDKYLEEQVALVLKLGLFCSHPVAAVRPSMSSVIQFLDGVAQLPNNLFDIVKARENVGAIEGFGEAAESLAEPCSVATLTFTEPFVSHGR

SEQ ID NO: 41833 - protein, 1431 aa, Anabaena variabilis ATCC 29413
MAALMRSRDWSQTSLGAVETWSQSLKTAVRIMLTCRQAMFVWWGNNLINLYNDAYRAILGGKHPEALGQRAAVVWQEIWDQVGPRAETALFQNQGTYDEALLLIMERNGYPEETYYTFSYSPVPNDDGGIGGIICANTEDTSRIIGERQLALLKDLAAKTADAQTFDEACIFSTKCLATNPYDLPFAMIYLVDPKQQCVTLAGTCGIERGHQAVPETVALEENSFWRFAEVLTTHKPYLISDLQLQFPDLPTGAWNRPPHQAAVVPIAPSGRMGKAGVLVAALNPFRLFDDNYQGFLNLVSAQIAASIGNAQAYEEERKRAEKLAELDRAKTTFFSNVSHEFRTPLTLMLSPLEELLTADDLSQEQRQEMTLIHRNGLRLLKLVNTLLDFSRIEAGRVQAVYEPTDLSTFTAELASIFRSAIEQAGLQFSVTCEPLPELVYVDRQMWEKIILNLLSNAFKFTFSGAIALTLRQVQHQVEITVTDTGIGIPQAELPHLFERFHRVEGARGRTQEGSGIGLALVQELVRLHGGQVQVDSLEGLGTTFTITVPMGIAHLPPERIQATRTLVSTALGAAPYIEEALSLLPAIKNSEASYLSPLTHNLSSSARILLVDDNADMREYVKRLLSRHYVVETATDGLAALEALADHLPDLVLTDVMMPRLDGFGLLSALRSNNRTREIPIILLSARAGEEAKVEGLEAGADDYLIKPFSARELLARVEATLKLAQLRRDAMEQQQTLRQEAETAKQNVETILSSINDGFYVLDRDWRFTYVNDRLCKIISMEREDILNHSIWDLFADTIGTDIDLQFQRAFNEQTSVQFEYLYVTWNRWYEHRVYPSPDGLTVFAADITERKQAELEREQLLALERHYINQLQGLTRAALAINSALSVEQVLQVITDQAASIIGSHQSVTSMTIGQNWSQAISAIFLSDKYTQWQNYDVKPDRSGIYGCVGHLNRPMRMTQAELEAHPQWRGFGKEAKNHPPLRGWLAAPLVGRNGQNIGLIQLSDKYDGEFTAADEAVLVQLAQMASVSVENVRLYEAEKQARSAAEASREEAEAANRIKDEFLAVLSHELRSPLNPILGWSRLLQNGKLDEAKAKQAVNIIERNAKLQVELIEDLLDISRILQGKLSLTSSPINLASVIKGAIETVRLAAEANSIRIEVNLDGEIGLVSGDSTRLQQVMWNLLSNAVKFTPTGGLVEIRLEQVGNQAQISVSDTGKGISPDFIPYVFDYFRQADSATTRKFGGLGLGLAIVRHLVELHGGTIHAESQGEGMGATFTLKLPLLPTQLTVNPDSPLLELSLGLHGIQVLVVDDDTDTREFVAFLLEQAGARVITAVSALEALQVFTQSPPDILLSDIGMPDMDGYMLMRQIRALPPDQGGKIPAIALTAYAGEIDEKRALKVGFQRHISKPVDPDNLIRAIVNLIDIKI

SEQ ID NO: 41834 - protein, 505 aa, Xanthomonas oryzae pv. oryzae KACC10331
MCGCSRICVQGCHTTARSRCRQCSAVCAAAGSARISGSWTCRCICLFYRPALRLRATHELAPADHPQNHRSGRRAVPSAAAGSGIFQRAAPHLRTSTQPRPRGRGGGADARCADRAAGARIRRRRASLRAGSGQGPHRCGRNARAGRRPRAQGRSRLRRTPGPGAARDDARSHLYESPILVGTGTRPLPRAPGRRRAGRDGRGAVADRTPGRIDAARRFLRRPLAGRLVHCARVAGAQPMIRIPMELRETVIAIACDAGAAIMEVYAQDFAVELKDDASPLTQADLAAHRVIVEGLRRVTPDVPVLSEESAHVAWEERQYWTSYWLVDPLDGTREFVKRNGEFSVNIALIHMGAPVLGVVQAPVDGRVWYAARGENAFRRDGDRDEMLHTRTPAAKPLRVAASRSHRDARTTAALDRMGEIDVVAQGSSLKFCRIAEGNLDVYPRFGPTSEWDTAAGQCVLHAAGGVLLACTSGKPFRYNRRDTLLNGDFIALGDPNLPWRNWLA

SEQ ID NO: 41835 - protein, 267 aa, Enterococcus faecalis V583
MDFNMDMFRLDGKVALITGAVYGIGFEIAKSLAAAGATIVFNNLTQESVDEGSANYKAEGIEAKGYVCDVTDEKAVQAMVKQIKEEVGSIDILVNNAGIIKRIPMTDMSATDFRQVIDVDLNAPFIMSKAVIPEMIEKGGGKIINICSMMSELGRETVSAYAAAKGGLKMLTKNIASEYGQFNIQCNGIGPGYIATPQTAPLRELQENGERHPFDQFIVGRTPAARWGDPVDLAGPSVFLASQASDFVNGHVLYVDGGILAYIGKQP

SEQ ID NO: 41836 - protein, 333 aa, Enterococcus faecalis V583
MANILTLGEIMLRLSTDIGVRLNETQQLICHYGGGEANVAISLANFGHQVSFASKVPDNSLGQAAVKHLRRNGVMSDFVQLGGARLGTYYMETGIGERAASVTYDRAGSSFAEVTEFPWSYEKLFSGIELFHISGITAALSVQWCQWTVELVKAAKKFGVLVSFDINYRGKLWSQAAAGKALKEILPYVDYCSAGELDARYLLEIPEDRMNSGFVYYYQQMQQQFPNIKCFYSTKRIVSSASNNQLVGTLWLENTYYESEVHKINPIVDRVGGGDAFAAGILHGLISDFDGQRTVEFATAASALKHTVHGDCNQFSEIEIEQFLTAGSGRIVR

SEQ ID NO: 41837 - protein, 444 aa, Coprinopsis cinerea okayama7#130
MSITKIHARQIFDSRGNPTVEVDVHTAKGLFRAAVPSGASTGAHEAVELRDGDKNAYVGKGVSKAISNVNDIIAPELIKSGLKVTQQKEIDDFLIKLDGTPNKGKLGANAILGVSIAVAEAGAGEKGVPLYQHLADLAGVKPPFVLPLPCFNVINGGSHAGNKLAFQEFMLLPTEASSFTEALKIGTETYHTLKKVITAKYGIDAVNVGDEGGFAPNVSGADESLELLTEAIKKAGYEGKIKIALDVASSEFYKDGKYDLDFKNPNSDPTKWITGKELADLYLSYVEKYPIVSIEDPFDQDDWEAWTHFTSKSGIQIVGDDLTVTNPLRIKTAIEKKACNGLLLKVNQIGTISESIQAAQLSQSDGWGVMISHRSGETENTIIADLAVALGVGQIKTGAPARSERVAKYNQLLRIEEQLQGSGAIYAQGKGLSAGSTPPALLKK

SEQ ID NO: 41838 - protein, 492 aa, Vitis vinifera
MPNFSTSVKLKYVKLGYQYLVNHILTFLLIPIMVGVVIELLSLGPDQIYEIWNSLHFNLLQVLCSSFFIIFIATVYFMSKPRSIYLVDYACFKPPVTCRVPFATFMEHSRLINSDNPKSVEFQMRILERSGLGEETCLPAANHYIPPKPTMEASRGEAELVIFSAIDDLLKKTGIKTKDIDILIVNCSLFSPTPSLSAMVINKYKLRSNIRSFNLSGMGCSAGLISIDLARDLLQVHPNSYALVISTEIITPNYYSGNQRAMLLPNCLFRMGAAAILLSNRRRERRRAKYRLVHLVRTHKGADDKAYRCVYEEEDPQGKVGISLSKDLMVIAGEALKSNITTIGPLVLPASEQLLFLFTLIGRKIFNPKWKPYIPDFKEAFEHFCIHAGGRAVIDELQKNLQLSSEHVEASRMTLHRFGNTSSSSLWYEMSYIEAKGRMKKGNRVWQIAFGSGFKCNSAVWKCNRTITTPTDGPWADCIDRYPVYIPEIVKL

SEQ ID NO: 41839 - protein, 330 aa, Prochlorococcus marinus str. MIT 9301
MHCKRIVVTGGAGYIGSHFCKTAFLKGHKTFVIDNLITGNYDFIKWGEFYKLDIREESSFKELLLKIKPDYLVHFAASAYVSESIFKPLDYISNNIDGMRSVCKICSEIKIPIVFSSSCSVYGEAKNVPINESEPLNPLSPYGETKLFCEKILKWCSNAYGLRWVSLRYFNAAGADEDLEIGEKHDPETHIIPLAIRALGDSGETLKIFGRDYDTFDGTAVRDFIHVMDLASAHLKAIEYLAEGGMSNIFNLGSGNGTSIKSIINGLENISSKQVKLKYCERREEDPSCLFADISKAKSILNWQPEFSNLDNILRSAWKWHKKLNVNFSK

SEQ ID NO: 41840 - protein, 370 aa, Pseudomonas fluorescens Pf-5
MIKSRAAVAFEAKKPLEIVEVDVAMPKAGEVLLRVVASGVCHTDAYTLSGADPEGIFPAILGHEGGAVVEAVGEGVTSVAVGDHVIPLYTPECGKCKFCLSGKTNLCQAIRATQGKGLMPDGTTRFSYKGQPIFHYMGTSTFSEYTVLPEISVAKIPKEAPLEKVCLLGCGVTTGIGAVINTAKVKAGDTVAIFGLGGIGLSAVIGAVKAKAGRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRSELPSYVEMSQTGEIPLDTFITHTMGLEDINKAFDLMHEGKSIRSVIHF

SEQ ID NO: 41841 - protein, 495 aa, Artemisia annua
MKSILKAMALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENIFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKALEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 41842 - protein, 243 aa, Zea mays
  misc_feature (113)..(113): Xaa can be any naturally occurring amino acid
  misc_feature (132)..(132): Xaa can be any naturally occurring amino acid
  misc_feature (137)..(137): Xaa can be any naturally occurring amino acid
  misc_feature (144)..(144): Xaa can be any naturally occurring amino acid
  misc_feature (166)..(167): Xaa can be any naturally occurring amino acid
  misc_feature (178)..(178): Xaa can be any naturally occurring amino acid
  misc_feature (180)..(180): Xaa can be any naturally occurring amino acid
  misc_feature (194)..(194): Xaa can be any naturally occurring amino acid
  misc_feature (208)..(208): Xaa can be any naturally occurring amino acid
MALTSCLKTGVVPMSPTTGLYLSGSLLKSDSGFAVPTKLQSVRKSDRERLRIQAVFSFPPAFLTRNGRAEKQKQLKQDLLESIEPLERGATASPDDQLRIDQLARKVEAVNPXKEPLKSDLLNGKWELIYTXSASIXQAKKPKXLRSITTTESINVIPSKVQNMEXXPFFTRVLGDIXPXNSRKVAVQLKVFKXLALIPVNAPETARXELEITYVDEELRLSRGDKGNLFILKMFDPTYRIPL

SEQ ID NO: 41843 - protein, 157 aa, Pseudomonas fluorescens Pf-5
MRIGHGYDVHRFAEGDFITLGGVRIAHHFGLLAHSDGDVLLHALSDALLGAAALGDIGKHFPDTDPQFKGADSRVLLRHVVALIHAKGWKIGNVDNTIVAQAPKMAPHIETMRALIAEDLQVELDQVNVKATTTEKLGFVGREEGIAVHSVALLQRP

SEQ ID NO: 41844 - protein, 333 aa, Coprinopsis cinerea okayama7#130
MSDYQKLTPTEYKPILDFIVTVARKAGALILEGSAAIQTVSSQETGVNEKKNSVDLVTEYDVRVEELLLKELKNGYPNFKFIGEESYSAGKREPLTDDPTFCVDPIDGTTNFVHGIPFVCVSIGVIYERRPIIGVIYNPFLDHLYTAAKSHGAYLTRNNGTPQRLPLASPPKPLSSLHGAVIGVEWGSERSSESMAGKSSSFVKLAGDPERGVPGGKMAHSLRSFGSGALNCAMVAQGALDMYWEIGCWPWDVSAGIIIVQEAGGIITGSHKVLSDTINAEQFGDVTEDILFGRKYLLIRGIADTPTESGRDAQKRLLKEFYDTVVDVEPQYD

SEQ ID NO: 41845 - protein, 565 aa, Schizosaccharomyces pombe 972h-
MPAGTKEQIECPLKGVTLLNSPRYNKDTAFTPEERQKFEISSRLPPIVETLQQQVDRCYDQYKAIGDEPLQKNLYLSQLSVTNQTLFYALISQHLIEMIPIIYTPTEGDAIKQFSDIYRYPEGCYLDIDHNDLSYIKQQLSEFGKSDSVEYIIITDSEGILGIGDQGVGGVLISVAKGHLMTLCAGLDPNRFLPIVLDVGTNNETHRKNHQYMGLRKDRVRGEQYDSFLDNVIKAIREVFPEAFIHFEDFGLANAKRILDHYRPDIACFNDDIQGTGAVALAAIIGALHVTKSPLTEQRIMIFGAGTAGVGIANQIVAGMVTDGLSLDKARGNLFMIDRCGLLLERHAKIATDGQKPFLKKDSDFKEVPSGDINLESAIALVKPTILLGCSGQPGKFTEKAIREMSKHVERPIIFPISNPTTLMEAKPDQIDKWSDGKALIATGSPLPPLNRNGKKYVISQCNNALLYPALGVACVLSRCKLLSDGMLKAASDALATVPRSLFAADEALLPDLNNAREISRHIVFAVLKQAVSEGMSTVDLPKDDAKLKEWIIEREWNPEYKPFV

SEQ ID NO: 41846 - protein, 513 aa, Pneumocystis carinii
MGFLKTILKVLGIENFTLSFVIIILTFFFLLHIFPQLYQKDSSKPPVVFHWLPFIGSTIQYGMDPYKFFQKQKKKHGNIFTFILLGKKMTVALGPKGNDILFNGKLSSLSAEEAYTHLTTPVFGTDVVYDVPNHVLMEQKKFVKTGFTIETFRAYVPLIIEEVKTYLETSPIFGKDKLSGVSSLMKALPEITIFTASRTLQGKEVRSNFDASFAKLYHDLDGGFTPINFLAPWLPLPKNRLRDAAQKKMAQIYMNIIKQRRKTCQHEEEDMIWNLMNQHYKDGRKLTDKEIAHLMIAILMAGQHTSAATGCWALLHLAEKPEYIKLLLEEQKRVFGDNLDDLTYDNLKDMELLSYVIKETLRLHPPLHSIIRKVKSPILIENSPYIVPKNHYLLAAPGVSSVDEEYFENALEFIPERWKCEKNTEDSDKIDYGYGLVTKGAFSPYLPFGAGRHRCIGEQFAYMQLGTIITIFVHELEWTLPKNQITIPKPDYTSMVVLPERPSNIEWRRRQKR

SEQ ID NO: 41847 - protein, 455 aa, Gibberella zeae PH-1
MARSKRGVRFPNRSDGRRSSFSSEDGGSPTKLKSQSSGQLETVSEKQPPAVGEKQAEYEKKKANFITRTFWTFVMFALFFTALFMGHIYIITIITAIQIVSFKEVIAIANVPSRARSLRSTKSLNWYWLATTMYFLYGETVIYYFKHIILVDKVLLPLATHHRFISFILYVFGFVFFVTSLQAGHYKFQFTNFAWTHMALYLIVVQAHFIMNNVFEGMIWFFLPAALVITNDIFAYICGIMFGRTQLIKLSPKKTVEGFVGAWIMTIIFAMILSNIMMRSKFFICPVNDLGANIFTGLKCDPNPVFLPKTYEMPELFFLPDTANFSFTIAPMQIHALNLATFASLIAPFGGFFASGLKRTFKIKDFGDSIPGHGGITDRMDCQFIMGFFAYMYFHTFVAIHKVSLGSVLETAITSLNPEEQVELVKSMGHYLRNQGIVTEDSFSAKLYVYMLRVL

SEQ ID NO: 41848 - protein, 455 aa, Geobacter metallireducens GS-15
MNTSDTKTLREYDRAHVWHPFTQMKEWEESDPVVIVRGEGTWIVDSEGNRYLDGVAAIWTNVHGHCKREINEAIKAQVDTLEHSTLLGLANDKAVLLARRLVEIAPPGLCKVFYSDNGSTAVEISVKMAFQYWQHQGKPEKTKFISFKNAYHGDTIGAVSVGGIDLYHAVFRPLLFPTIQAPAPYCYRCEFGERDRANCGMRCLKELERLMEIHAHEVAGLVIEPLVQGAGGMIVQPDGFVRRVRELCDRYDILMIADEVAVGFGRTGAMFACEREGITPDIMALSKGITAGYLPLAATMTTQKIYDAFIGEYREMKTFFHGHTFTGNPIACAAALASLDLFENERLLDSLTNKIGYLAERLQALNEVRHVGEVRQCGMIAGIELVKDAETREPFPWEERVGIQVCLEARNRGIFLRPLGNIIVVFPPLSISLDELAFLMDGIEASIRAITELRT

SEQ ID NO: 41849 - protein, 417 aa, Geobacillus stearothermophilus
MMKGCRVMVVLLGLWFVFGLSVPGGRTEAASPRANDAPIVLLHGFTGWGREEMLGFKYWGGVRGDIEQWLNDNGYRTYTLAVGPLSSNWDRACEAYAQLVGGTVDYGAAHAANDGHARFGRTYPGLLPELKRGGRVHIIAHSQGGQTARMLVSLLENGSQEEREYAKEHNVSLSPLFEGGHRFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPELGMNAFSAIVCAPFLGSYRNAALGIDSHWLGNDGIVNTISMNGPKRGSNDRIVPYDGTLKKGVWNDMGTYKVDHLEVIGVDPNPSFNIRAFYLRLAEQLASLRP

SEQ ID NO: 41850 - protein, 342 aa, Oryza sativa Japonica Group
MERRRWLQAAVLCCLLVLCSGRELKTKHTPIYNSTLARTLAEYTSAVYTADLTQLFSWTCERCCDLTEGFEVIELIVDVKNCLQAYVGYASDMNAVVVVFRGTQETSIQNWIEDLFWKQLDLDYPGMPQAKVHSGFYSAYHNTTLRDGVVNGIKKTREAYGNIPIMVTGHSMGGAMASFCALDLVVNYRLKDVTLITFGQPRIGNAVFASHFKCHLPNAIRVTNAHDIVPHLPPYYHYFPQKTYHHFPREVWVHNVGLGSLVYSIEQICDDSGEDPTCSRSVSGNSVQDHINYLGISMHAEASGSCRIVTGDNKLQYKMDSDGNIVFSKQPGLSVDQLHSSQ

SEQ ID NO: 41851 - protein, 610 aa, Schizosaccharomyces pombe 972h-
MMDGASPVDRDVSPVGLPKKRIKQNHDQVFLHNLPDAPRYTKSYMHNAEIYKCFPTKSNYILSVSYDGYVKFWHKTPNGVEYIKEFHAHNAMLLSAELSQDERLFITGADDKSLKVFDVESIDLVNIIDLEFLPKAICCFNSPSLKTSLIAVSSAESPLIFFFESGGDGEVLYTVKKHTAPVHCLRYLSTLDCFLSIDIGGMVEYWSPEEPFQKPDTAELFNMKSQTDLYIFKKQKSVPTSLEVSHFENFWSTISYPDCKVRVFDTKSGRAILELDENPSNAAKKVEALFEKEDTESSYYMSHVELGRRIAIERDIEKHGLTVGTTAIFDESEKYLLYGSIVGIKVVSIDNGTVVRIYGKDEAVRFTRLSLYQQAPKKSNLPSLDVIASNNPLVEESFQKDPTLFATAWKKQRFYLFSNMSTKFTLSDRDVYNEQVLPVTNNEGRQENGNILLGKAAIIHTTQGDISIKLYPEEAPKAVQNFTTHAENGYYDNTIFHRIIKNFMIQGGDPLGDGTGGESIWKKDFEDEISPNLKHDRPFTVSMANSGPNTNGSQFFITTDLTPWLDGKHTIFARAYAGLDVVHRIEQGETDKYDRPLEPTKIINISIVYT

SEQ ID NO: 41852 - protein, 369 aa, Anabaena variabilis ATCC 29413
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSLNGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVKVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 41853 - protein, 329 aa, Mesorhizobium sp. BNC1
MTVLVTGGAGYIGSHMVWELLDHGEEVVVLDRLSTGFDWAVPEAAELVVGDIGDQALLEETIKRRNVDAVIHFAGSIIVPESVADPLGYYLNNTVKSRALIESAVRCGVKHFIFSSTAAVYGTPRKNPVTEDEPLLPESPYGTSKLMTEIMLRDTAAAHDFAYTALRYFNVSGADPKRRTGQSTKGATHLIKVACETATGKRASMEVFGTDYPTPDGTCVRDYIHVSDLVNAHYLALQRLRSGGGSLVANCGYGRGYSVLEVIDAVKQVSGKDFKVVESGRRPGDAVAIVASAERCFAELGWRPEHDDLREIVSDALRWEEILAKRNRV

SEQ ID NO: 41854 - protein, 146 aa, Brassica napus
IEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 41855 - protein, 367 aa, Shewanella sp. ANA-3
MALHSIEEIIEDIRQGKMVILMDDEDRENEGDLIMAAELVTPEAINFMAKYGRGLICQTMTKARCQQLNLPLMVTNNNAQFSTNFTVSIEAAEGVTTGISAHDRAVTVKAAVAKDAKASDLVQPGHIFPLMAQDGGVLTRAGHTEAGCDLARLAGLEPSGVIVEILNEDGTMARRPDLEIFSELHGIKIGTIAALIEYRNTKETTVVREAKCKLPTRFGEFDMVTFRDTIDNQLHFALVKGEVKPDCLVRVHLQNTFNDLLHSERDQQRSWPLEKAMERISAEGGVLVLLGNQEHTCEILSKVKAFEAEDQGQAPASAKWQGTSRRVGVGSQILASLGVTKMRLLSSPKRYHSLSGFGLEVTEYVAE

SEQ ID NO: 41856 - protein, 494 aa, Mesorhizobium sp. BNC1
MLTLSTYREEWFHNIRGDLLAGLVVALALIPEAIAFSIIAGVDPKVGLYASFSIAVIIAFTGGRPGMISAATAATAVLMVTLVKEHGLQYLLVATILAGVLQIVAGLLRLGDLMRFVSRSVITGFVNALAILIFMAQLPELIGVPWMTYVMVAGGLAIIYLFPYVTKAVPSPLVCIIVLTAIALFFGMDLRTVGDMGELPSTLPVFLLPDVPLNFETLRIVFPYSAAVAVVGLLESLMTASIVDELTDTESNKNRECVGQGIANFATGFLGGMAGCAMIGQSVINVKSGGRGRLSAFAAGVFLLILCVGLGDWVSIIPMAALVAIMIMVSIGTFSWASIKNLRHHPRRSSVVMVATVVTVVATHNLAIGVLVGVLLSGLFFASKVAQIFRVTSSLSEDQKERTYVVEGQVFFASSERFLKSFDFREAIEKVHIDVSRAHIWDLTGVGALDTVVLKFRREGTEVELVGMNEASATLVDKLAIHDKPDALERLVSQ

SEQ ID NO: 41857 - protein, 372 aa, Chlamydomonas reinhardtii
MNAAAPDPLKGHGRYAKVQPLSSGSFGFVHLCKNLQTGELVAIKFLERGERVNKYVETEVLNHRMLRHPHVIEFKEVFLTPEYICICMEYASGGNLFGYVQRAVRLKEPAARWFFQQLCIGLDYCHRRGVVNRDIKLENTLLTMVPGLPLPLLKICDFGYSKAHFMSAPKSKVGTLAYMAPEVIRATDQYAGQAADIWSCGVMLYVMLFGAYPFESPQSRHQQGKARMDSMMQRILRMEWSIPADVEVSPECRDLLCKLLVGDPRHRLTMAQIQQHPWFLTNLPPDALAMNDNFLAHTDYTGVQSEEDIKKVLASAAIPAPMSKYAFATGGDDENYEDLDAAIDDEMGHAGAGCKPAAAGRPAGNGGAAPGR

SEQ ID NO: 41858 - protein, 640 aa, Arabidopsis thaliana
MVERGKRTHNRFRDNNNDNNRNQRRRLSYESEEKKIDNKDDLVVVYRILCPSGVMGSVIGKSGKVINLIRQETRARIKVVDPFPGCSERVITIFCSVSEKKDIVDIEYSELDYSVPLCSAQAALLKVHDAIVASLATAAENTKIDRDDFRECRLLVPSSQCSIVIGKSGSIIKNIRGRTRANVKVVSKDVSDPSHTCAMDFDNIVMISGETESVKKALFAVSAIMYKVSPREQIPLDTTVQEVPASIIIPSDLSIYPQAGLYPSQDSIFQHGANVSSFIGTLPQGYGENAANPVPVFSASALPVVHGFGGSSRSEKLAIKVICSSSKIGRVIGKGGLTIKGIRQASGSHIEVNDSRTNHDDDCVITVTATESPDDLKSMAVEAVLLLQEKINDEDEDKVKMQLLVSSKVIGCIIGKSGSIISEIRKRTKADIHISKGNNTPKCADPNDELVEISGEVSNVRDALIQIVLRLRDDVLRDRETGSRNQPPARSENNNFFSSSSSNTGLALPQSFMSSVPQVASVDFNRRPETGSSMSMLPSSGGIYGYGSFPVGNTSYGSNSSYSSNLYGGLPQSTTMEVRIPANAVGKVMGRGGGNLDNIRRVCLIFIFIFPSSLLSDCHSFIRLFFPLSYITFSHGKKKT

SEQ ID NO: 41859 - protein, 180 aa, Shewanella sp. ANA-3
MTVVSCRHFSPKPGALAKLGKKMNVVQGNIEAKNAKVAIVISRFNSFLVESLLESALDTLKRFGQVSDENITVVRVPGAVELPLAARRVAASGKFDGIIALGAVIRGGTPHFDFVAGECNKGLAQIALEFDLPVAFGVLTTDTIEQAIERSGTKAGNKGGEAALSLLEMVNVLQQLEQQL

SEQ ID NO: 41860 - protein, 402 aa, Synechococcus sp. WH 8102
MAKRSLASLNAGDLSGKRVLVRVDFNVPLNEAGAITDDTRIRAALPTINDLIGKGAKVILSAHFGRPKGQVNDAMRLTPVAARLSELLGKPVAKTDSCIGPDAEAKVNAMADGDVVLLENVRFFAEEEKNDAGFAEKLAGLAEVYVNDAFGAAHRAHASTEGVTKFLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQDALGDCQTVIWNGPMGVFEFEKFATGTNAIATTLAELSGKGCCTIIGGGDSVAAVEKAGLADKMSHISTGGGASLELLEGKVLPGVAALNDAA

SEQ ID NO: 41861 - protein, 171 aa, Oryza sativa Japonica Group
MAYGSVGGTTVSGSQTRWSRKSVLQCYHLNEWSVKRAQKKKLMSTVTRAYLDQKLALAKRCSRVYLGSHTLVVEIVAEATLAGAKAAAVATVASAVPTLASVRMLPWAKANINPTGQALIICTAAGMAYFVAADKKILSLARRHSFENAPEHLKNTSFQGTGHPHPAFFRP

SEQ ID NO: 41862 - protein, 353 aa, Cryphonectria parasitica
MGCGMSTEEKEGKARNEEIENQLKRDRMQQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 41863 - protein, 765 aa, Zea mays
MRRHGEVRVILAMAAAAAAALLASAAVAGRDGRQTYIVHMSHSAMPDEFAEHEEWYAASLQAVSDAATVLYTYSTLLHGYSARLTRAEAAALESQPGVIVVNPEVRYELHTTRTPEFLGLDGTDALFPQSGTGTDVVVGVLDTGVWPERPSYDDTGFGPVPAGWKGKCEDGNDFNASACNKKLIGARFFLTGYEAAKGPVDTSKESRSPRDNDGHGTHTSSTAAGGAVQGADLLGYAAGTAKGMAPRARVATYKVCWVGGCFSSDILKAMEVAVTDGVDVLSLSLGGGTAEYYRDSIAVGAFSAMEKGIFVSCSAGNAGPGAATLSNGAPWITTVGAGTIDRDFPAYVTLGNGKNYTGVSLYSGKPLPTTPMPFIYAGNASNSSMGQLCMSGSLIPEKVAGKIVLCDRGTNARVQKGFVVKDAGGAGMVLANTAANGEELVADAHVLPGSGVGEQAGNAMRDYAMSDPKATATIVFAGTKVGVKPSPVVAAFSSRGPNTVTSSVLKPDIIAPGVNILAAWSGSVGPSGLPGDGRRVGFNIISGTSMSCPHVSGLAALLRAAHPEWSPAAIRSALMTTAYNEYPGGGNGILDVATGRPATPLDVGAGHVDPAKAVDPGLVYDIAAADYVDFLCANNYEAAQIAALTRQHASEGCSANRTYAVTALNYPSFSVAFPAAGGTAKHTRTVTNVGQPGTYKVAASAAAGGTPVTVTVEPSTLSFSRAGEKQSYTVSFTAGGMPSGTNGFGRLVWSSDHHVVASPIAATWT

SEQ ID NO: 41864 - protein, 353 aa, Ustilago maydis
MGCGASKVDKEGQARNDAIDAQLKKDRLAQKNEIKMLLLGAGESGKSTILKQMKLINHGSYSAEERESYKEIIFSNTVQSMRVLLDAMERLDIPLADATNAPRAEIILGLSPSIESSVLPRQVADAIHALWGDAGVQACFGRSREYQLNDSAKYYFDSIQRMAEPSYLPTDQDVLRSRVKTTGITETHFKIGELNYKLFDVGGQRSERKKWIHCFENVTAIIFLVAISEYDQLLYEDENVNRMQEALTLFDSICNSRWFVKTSIILFLNKIDLFKQKLPISPMADYFSDYTGGADYNSASEYIVNRFVSLNQSDAKTIYTHFTCATDTSQIKFVMSAVNDIIIQVNLRDCGLL

SEQ ID NO: 41865 - protein, 295 aa, uncultured archaeon GZfos13E1
MNGKKATGKEKGKTKRKREKIGIIGVGNIGASILRGLLTAEPTSKIFITDAENEKRRFFEADLGTDSGVVVCKTNEEVAENAEVTILAVKPNDMLVVVKEIAPFMNEDKILISVAAGVPTAAIDGYLGEAKARGRKVIRVMPNIGACVREAVCAICKGKYADEADEEIAKEILSAIGTVHSVNEGDMDVITGLSGSGIAFVATVIDAMADGAVYEGLPRELSLTIAAQTAIGAAKMILEGKQPSEIVTMTASPGGTTIRGIYTMESRNVKAAMMEAVIEATRRATEISKQGSMKN

SEQ ID NO: 41866 - protein, 200 aa, Chloroflexus aurantiacus
AGGIAKMAGLDKNARNVMDDLDAVGNTTKAVTKGIAIGSAVIAAVALYGSYFTDVNKVLQQMINEGRQGIELLASINVAAPPVFIGLLIGGAVPFLFSALTIRAVSRAAAQIVNEVRRQFRIPGLMEGKVQPDYARAVQISTTAAQKELISLGLIAVMVPIIVGFTLGVEALGGFLAGIILTGQLMAVFQANAGGAWDNN

SEQ ID NO: 41867 - protein, 189 aa, Agrobacterium tumefaciens
AGGIAEMAELGPEVRKTTDKLDSVGNTTAAIAKGFAIGSAALTALALFTAFAEEIAKNPKLTGLLVDGHLVVNLTEPGVIIGIFLGATLPFLVCAFTMEAVGKAAFEMIEEVRRQFREIPGIMEGTGRPDYAKCVDISTKAAIREMMLPGVFAVGAPLIVGFLLGAKALAGFLAGVTASGVLLAIFSPS

SEQ ID NO: 41868 - protein, 472 aa, Silene latifolia
MTEKGKGGKKALSVDEKYSQWKSLVPILYDWLANHNLVWPSLSCRWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANWGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYGPEEEVLAELDKFRSHVAACSPTPTKDVNHSA

SEQ ID NO: 41869 - protein, 251 aa, Wolbachia endosymbiont of Drosophila ananassae
MSTPITVAYGDGIGPEIMEAVLSILRGAEAKISIDIIEIGERVYSKEWSHGISPSGWESIERTKILLKSPTTTPQGKGHKSLNVALRKNLGLYANIRPCISYHPVIENKFGKFDIVVIRENEEDVYTGIEHRLTGDSYQCTKIITRSGSEKICRYAFEYAKKHNRKKVTCLTKDNIMKMTDGTFHAAFDRIAKEYQDIKAEHYIVDIGMARVATEPENFDVIVTENLYGDILSDIVAQTSGSVGLAGSSNI

SEQ ID NO: 41870 - protein, 428 aa, Silene latifolia
  misc_feature (276)..(276): Xaa can be any naturally occurring amino acid
  misc_feature (417)..(417): Xaa can be any naturally occurring amino acid
RWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDXRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVAACXPTPTKDVNHSA

SEQ ID NO: 41871 - protein, 159 aa, Oryza sativa
HEASCRIRHEGKAFSKMSIQLYNYGEGLMGKVASDKCHKWVFKEPSECEPNIANYWQSSFDALPPEWTDQFASGIQTIAVIQAGHGLLQLGSCKIIPEDLHFVLRMRHMFESLGYQSGFFLSQLFSSSRGTSPSPSSFPLKQRRRRTRGTVARRTWRST

SEQ ID NO: 41872 - protein, 209 aa, Nicotiana tabacum
MGSSSGSDVEAGFAKLQGEDFEYYMQTYSIILGRNSKKSTVDVDLSSLGGGMNISRHHARIFYDFQRRRFNLEVLGKNGCFVEGVLHLPGNPPIKLDSQDLLQIGDKEFYFLLPVRSILGGGPPIGPKQNVNYPVAAHYGGIGKKGGLFRGREREYYDEEEYDDDDDDDDGTGGKKMRRCDGAEGGGGYGGYGSCGSSGKASISGQLGQ

SEQ ID NO: 41873 - protein, 297 aa, Nostoc sp. PCC 7120
MMVNDIEYIRQAEATRVQVLSEALPYIQQFAGRTVVVKYGGAAMKDSHLKDQVIRDIVFLSCVGLRPILVHGGGPEINSWLDKLGIEAQFKNGLRVTDAPTMDVVEMVLVGRVNKEIVSLINQAGGLAVGLCGKDGNLITARPQGQEGIGFVGEVSNVNIKILETLASNGYIPVVSSVAADDSGQAYNINADTVAGEIAAALGAEKLILLTDTRGILKDYQDPGTLIPKVDIREARELINSGVVSGGMIPKVTCCVRSLAQGVRAAHIIDGRIPHALLLEIFTDVGIGTMILGSQYS

SEQ ID NO: 41874 - protein, 352 aa, Prochlorococcus marinus str. MIT 9301
MNKIILVTGGAGFIGSHTCLLLLESGYKVVVIDSFINSSLNSLERVKKILISDNNFFSNRLKIVKGDLRDFECINNIFLKYKINKEKIDGVIHFAGLKNIKESISDPISYWENNVTGTINLLKAMHHNNCNSIIFSSTAALYGKSESKVFKETSIKSPINPYGETKLAIEKLLNDLYKSNPNSWKIANLRYFNPIGCHNSGQIGESPLNKPTNIFPLIIKAASKEIKKISIFGNDWPTHDGTGIRDYIHVMDLAEGHIKAIEFLMSKNKGNLINLNLGRGVGVSVLELINTFTKVNNVNIEYEFAERREGDVPISIADNCLAKTLLNWCPKRDIEEMCIDGWKWKLLNPKGY

SEQ ID NO: 41875 - protein, 472 aa, Silene latifolia
MTEKGKGGKKALSVDEKYSQWKSLVPILYDWLANHNLVWPSLSCRWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVAACSPTPTKDVNHSA

SEQ ID NO: 41876 - protein, 563 aa, Zygosaccharomyces bisporus
  misc_feature (225)..(225): Xaa can be any naturally occurring amino acid
MSEITLGRYLFERLRQVDTNTIFGVPGDFNLSLLDKIYEVQGLRWAGNANELNAAYAADGYARVKGMAALVTTFGVGELSALNGIAGSYAEHVGVLHIEGVPSISSQAKQLLLHHTLGNGDFTVFHRMSANISETTAWLTDITTAPAEIDRCIRVTYLTQRPVYLGLPANLTDQKVPASLLNTPIDLSLKENDPEAEAEVVETVLELIKEAKNPIILADACCSRXDVKAETKKLIDITQFPSFVTPMGKGSIDEQNPRFGGVYVGTLSSPAVKKAVESADLVLSVGALLSDFNTGSFSYSYKTKNVVEFHSDHIKIRNATFPGVQMKFVLEDLLKKVPAAVKGYNPGPVPPAPSPNAEVAASTPLKQEWLWRQVGKFLQEGDIVITETGTSAFGINQSHFPNRTYGISQVLWGSIGYTTGSTLGAAFAAEEIDPKKRVVLFIGDGSLQLTVQEISTMVRWGLKPYLFVLNNDGYTIERLIHGEKAQYNDIQPWKNLELLHAFGATDYETHRVATVGDWDKLTTDSKFNENSRIRMIEVMLETMDAPSSLVAQAQLTAAINAKQ

SEQ ID NO: 41877 - protein, 573 aa, Vibrio cholerae O1 biovar eltor str. N16961
MISGILASPGIAIGKALLLQEDEIVLNTNTISDDQVEAEVERFYTARDKSSAQLEVIKQKALETFGEEKEAIFEGHIMLLEDEELEEEILALIKKEKMSADNAIHTVIEEQATALESLDDEYLKERATDIRDIGTRFVKNALGMHIVSLSEIDQEVVLVAYDLTPSETAQINLNYVLGFACDIGGRTSHTSIMARSLELPAIVGTNDITKKVKNGDTLILDAMNNKIIVNPTQAQIEEAKAVKAAFLAEKEELAKLKDLPAETLDGHRVEVCGNIGTVKDCDGIIRNGGEGVGLYRTEFLFMDRDALPTEEEQYQAYKEVAEAMNGQAVIIRTMDIGGDKDLPYMDLPKEMNPFLGWRAVRISLDRREILRDQLRGILRASAHGKLRVMFPMIISVEEIRELKNAIEEYKAELRTEGHAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANYAEIKAMAEEALALPTAAEIEACVDKFIAAKA

SEQ ID NO: 41878 - protein, 317 aa, Pichia guilliermondii
MSIKLNSGYDMPSVGFGCWKVDNATCADTIYNAIKVGYRLFDGAEDYGNEKEVGDGINRALDEGLVARDELFVVSKLWNSFHDPKNVEKALDKTLSDLKVDYLDLFLIHFPIAFKFVPFEEKYPPGFYCGDGDKFHYEDVPLIDTWRALEKLVEKGKIRSIGISNFSGALIQDLLRSAKIKPAVLQIEHHPYLQQPRLVEYVQSQGIAITAYSSFGPQSFVELDHPRVKDVKPLFEHDVIKSVAGKVKKTPAQVLLRWATQRGLAVIPKSNNPDRLLSNLKVNDFDLSQEDFQEISKLDIELRFNNPWDWDKIPTFI

SEQ ID NO: 41879 - protein, 334 aa, Nannochloris bacillaris
MLIYIKTPPIIIFLPYLIKNSYFLSLQVLEEDFAQDDGDGGPSTQEVALRASKLRKRPPVWQLIAKNIYMHRERKQLDEDEVMICQCKPIWGTDTTTIGCGENCLNRMLNIECVAKYCPCGERCTNRGFSKRAYAKLEIRRAGAKGFGLFAAEDVKAGQFIVEYVGEVLEEEEYARRKEFYIATGQRHYYFMNVGNGEVIDAARRGGLGRFINHSCEPNCETQKWVVRGELAIGLFALEDVPAGSVLTFDYNFERYGDKPMKCLCGSKACRGVIGGSQETAARMTETIVAPEEEEEQDLEPIMVTEKEADAAVSAILDRAVGLGWEDGFDARLQ

SEQ ID NO: 41880 - protein, 135 aa, Arabidopsis thaliana
MESELIFHEGGCHCGKIKWRVKAARSVIAWSCNCSDCSMRGNVHFIVPSSNFELLDDSKDFITTYTFGTHTAKHTFCKVCGITSFYIPRSNPDGVAVTVKCVKSGTLAHIEVKSYDGQNWEMSHKKTGIASFSKE

SEQ ID NO: 41881 - protein, 225 aa, Mycoplana dimorpha
AIGSAGLGALVLFAAYSNDLSYFAANGDKYPYFANIGEISFDLSNPYVVAGLIFGGLIPYLFGGIAMTAVGRAAGSIVEEVRRQFKEKPGIMQGKDKPNYGRAVDLLTKAAIREMIVPSLLPVLAPLVVYFGVLLISGSKASAFAALGASLLGVIVNGLFVAISMTSGGGAWDNAKKSFEDGFVDKDGQRHMKGSEAHKASVTGDTVGDPYKDTAGPAVNPAIKI

SEQ ID NO: 41882 - protein, 198 aa, Zea mays
  misc_feature (62)..(62): Xaa can be any naturally occurring amino acid
MVKICCIGAGYVGGPTMADIALKCPDIDAVVVDISKPRIEAWNTDTLAIYEPDLDDVVKQCXGPRTSFFSTDDEKHVADADIIFVSENTPTKTRELGAEKGADLSYCESAARMSADVSKTDKIDAEKSTVPVKTAEAIDNILTHNSKGINYHILSNPQFLAQGSVIEVPLQPDRVLIGRRETPDDKHVVQDLNDVYAH

SEQ ID NO: 41883 - protein, 240 aa, Legionella pneumophila subsp. pneumophila str. Philadelphia 1
MLFIRLERMIEFQLKKLYYSYKIFNENIMTKQAIIIGISGPSASGKSLLANTIVNELGSEQVVVISEDAYYKDNGHLPFTEREKINYDHPDSFDHALLYEHLRQLRVGNTVQIPIYSHSKHLRLPETRAVGQHAIIVLEGILLFSDKALREIMDIRIFMSTPLDVCLTRRLKRDVVERHRSFESVIHQYETTVRPMYMQFIEPSSRYADIIVPRGGENRIAIEMIQAKMRELLASHTRGS

SEQ ID NO: 41884 - protein, 322 aa, Vibrio cholerae O1 biovar eltor str. N16961
MSKIYEDNSLTIGNTPLVRLNKVSNGKVLAKIEARNPSFSVKCRIGANMIWEAEKQGKLKPGVELVEPTSGNTGVALAFVAAARGYKLTLTMPESMSLERRKLLKALGANLELTEAAKGMKGAIAKAEEIVASNPEKYLLLQQFNNPANPQIHEKTTGPEIWDATDGQIDVFVAGVGTGGTLTGTSRYIKGTQGKAILSVAVEPAESPVITQALAGEEIKPAPHKIQGIGAGFIPGNLDLSLIDRVERVTSDEAIEMARRLMEEEGILAGISSGAAVVAANRIAQLPEFEGKTIVTVLPSSGERYLSTALFAGIFTDKENQQ

SEQ ID NO: 41885 - protein, 384 aa, Salinibacter ruber DSM 13855
MLGPSWRTICRTCGAPAWGTPPAAEGRRPGARFFASRRFLMSTSITLFGAGSWGTALAVHLAAAGRDVTLWARRDEAVERMRTTHRNPTYLSDIEIPPSVHVTSDLEAAAGASSLWAVAVPSQNLRSVATRIAPLTRPGTTVVSLAKGIENETLQTMSQVLADELGGMEAQQIGVLYGPSHAEEVAENQPTTLVAAAPTEPRAEWVQDAFMTERLRVYVNTDVVGVEIGGSAKNVLAIAAGIGDGVGYGDNAKAALVTRGLAEIRRLGIAMGAKPRTFAGLAGIGDLLVTCMSPHSRNRYLGEQIGNGMTLEEIESEMDMVAEGVRTTQSVQDLARHHDIEMPVTEAVHRVLFENRRPEDMVDELMTRSAKREHWLPQGLRNVS

SEQ ID NO: 41886 - protein, 214 aa, Legionella pneumophila subsp. pneumophila str. Philadelphia 1
MPGYSDNIIRNASGLIPMVIEQTSRGERSYDIYSRLLKERIIFLLGEVEDHMANLVVAQLLFLESENPEKDISLYINSPGGVVTAGLAIYDTMQFIKPDVSTLCIGQAASAAALLLCAGAEGKRFCLPNSRVMIHQPLGGYRGQATDIEIHARETLAVRERLNNIMAKHTKKTPDQIMRDTERDNFMSATQAMEYGLIDKVLYDRQVAGHSTDL

SEQ ID NO: 41887 - protein, 530 aa, Brassica napus
MGDSTGEPGSSMHGVTGREQTFAFSVASPIVPTDKTAKFDLPVDSEHKATVFKLFSFAKPHMRTFHLSWISFSTCFVSTFAAAPLVPIIRENLNLTKQDIGNAGVASVSGSIFSRLVMGAVCDLLGPRYGCAFLVMLSAPTVFSMSFVSGAAGFITVRFMIGFCLATFVSCQYGMSTMFNSQIIGLVNGTAAGWGNMGGGITQLLMPVVYEIIRRCGATAFTAWRLAFFVPGWLHIIMGVLVLNLGQDLPDGNRSALEKKGEVAKDKFGKIMWYAVTNYRTWIFVLLYGYSMGVELSTDNVIAEYFFDRFHLKLHTAGIIAACFGMANFFARPAGGYASDLAAKYFGMRGRLWALWIIQTAGGVFCVWLGRANTLVTAVVAMVLFSLGAQAACGATFAIVPFVSRRALGIISGLTGAGGNFGSGLTQLIFFSTSRFTTEQGLTWMGVMIVACTLPVTLIHFPQWGSMFLPPSTDPVKGPKEHYYASEWNEQEKEKNMHQGSLRFAKNAKSEGGRRVRSAATPPENTPNNV

SEQ ID NO: 41888 - protein, 625 aa, Legionella pneumophila subsp. pneumophila str. Philadelphia 1
MISSSLRYNMLTLRQITLSRGDKILLDKVNVSLYEKQKIGLIGHNGCGKSTLFDFLLGQLSPDTGEYLINPQLSISHLSQHIPDSNEKALDFVLAGDQQYIKLLKRLSEAEKNGDDAEVLQCHEELSHTGGYSKPAQAAVIMSGLGFSGNQQQEPVNSFSGGWRMRLNLARCLMKPADLLLLDEPTNHLDMEAIFWLERYLKQSPSTIILISHDREFLDAFVTHILHIENRNLTLYSGNYSSFEKTHAQQLALQQAMHEKQQTKIKHMMTFVTRFKAKAAKAKQAQSRMKAIEKMEIIAAAQADSPFSFDFFPCPRAGNPLIQCNQVDAGYINHPPILKKIKLSLNPGDRIALLGPNGEGKSTLIKTLTADLPVLSGDIHRSPHLQIGYYAQHQLEQLNCKLSPVETLQTLSPEVREQTIRDFLGGFNFRGDMAVQSIQHFSGGEKARLALARLVWLKPNLLLLDEPTNHLDLGMRSAIELALQTYEGALILISHDRHLLKSSVDNFYLIYQGKVQPFEGDLDDYYLWLQTRNSEKESKLATSPNEYKERKSYQNKLKKLEQLIEHYQNQLRLLDKQLADVSLYEDTKQKSKLDNLLMERDIAHSSLMKTEEEWLEICNALENLE

SEQ ID NO: 41889 - protein, 122 aa, Oryza sativa Japonica Group
MKKKKKKMSTVTRAYLDQKLALAKRCSREATLAGAKAAAVATVASAVPTLASVRMLPWAKANINPTGQALIICTAAGMAYFVAADKKILSLARKHSFEGAPEHLKNTSFQGTGRPYPAFFRP

SEQ ID NO: 41890 - protein, 267 aa, Dehalococcoides sp. VS
MNVPAFGLGTFRLKGQTVIDSVRTGLELGYRAVDTAQIYGNEAEVGQAIADSGVARDEVFLTTKIWTENLSRERLIPSLRESLSKLRTDYVDLTLIHWPSQNDAVPVDEFMHALLQAKREGLTRAIGVSNFTIDLMQRAIDAVGADQIATNQVELHPYLQNRKLAQFARETGIGLTSYMTLAYGKVLGDAVLVDIAAKHRATPAQVALAWAMQSGYAVIPSSTKRENLAGNLLAVSLRLDDEDMQRIAGLDRGERLTDPDGLAPAWD

SEQ ID NO: 41891 - protein, 900 aa, Aspergillus nidulans FGSC A4
MFSLRTAVRRASTTKSFRALSAPHTVAFARLCSPTARASLRASAVPLLQSRHYSRASDTQLSSTRSTVVQLLSNIGSKREVQQYLSHFTSVSSQQFAVIKVGGAIITEHLETLSSALAFLNHVGLYPIVVHGAGPQLNRMLEAAGVEPQFEDGIRVTDGKTLALARKLFLEENLKLVEELERMGVRARPLTAGVFQADYLDKEKYNLVGKINGVNKKPIESAIEAGCLPILTSMAETPDGQVLNVNADVAAGELARALQPLKIVYLAEKGGLFNGDTGEKISSINLDEEYDHLMTQWWVRHGTRLKIKEMKELLNDLPRTSSVAIIHPADLQKELFTDSGAGTLIRRGNKVHTKTSLSEFEDLAQLKEVLVRDREGLDARATVDRYVEGLKERDFKAYFDEPMEALAVVLPQAKDALTSAAHLATFTITKSGWLTNVADNVFAAIKKDFPKLVWTVKEDDENLTWFFDKADGSLSRDGEVLFWYGVESSDEVKLLVQEFTQHGRQMFGDINLESRLQRAAHAAANIGKPLGAAAGQKRTFSTASNALRSARFGRPSVPVQTVRTYATTNPNPPLGEKNNSNTKPSKVALIGARGYTGQALINLINAHPHLDLRHVSSRELAGKKLQGYDKREIIYENLSPEDVKRMSSNGDVDCWVMALPNGVCKPFVDAVDQGAKDGNVIIDLSADYRFDENWTYGLPELVSRSKIAQATRIANPGCYATGTQVAIAPIVPHLGGQPTVFGVSGYSGAGTKPSPKNDVQNLTNNIIPYSLTDHIHEREISSQLGTPIAFMPHVAVWFQGIHLTINIPLKETMSSRDIRNIYQDRYAGEKLVKIVGEPPVVKNIAGRHGVEVGGFAVHSKENRVVVCATIDNLLKGAATQCLQNMNLALGYSEYEGIPLE

SEQ ID NO: 41892 - protein, 180 aa, Zea mays
  misc_feature (35)..(35): Xaa can be any naturally occurring amino acid
  misc_feature (49)..(49): Xaa can be any naturally occurring amino acid
  misc_feature (59)..(59): Xaa can be any naturally occurring amino acid
  misc_feature (69)..(69): Xaa can be any naturally occurring amino acid
  misc_feature (78)..(78): Xaa can be any naturally occurring amino acid
  misc_feature (131)..(131): Xaa can be any naturally occurring amino acid
  misc_feature (136)..(136): Xaa can be any naturally occurring amino acid
  misc_feature (145)..(145): Xaa can be any naturally occurring amino acid
  misc_feature (160)..(160): Xaa can be any naturally occurring amino acid
RGYSRGTSPGVILFEEHVYHKTKNGEPFVDVLKQXGVLPGIKVAKGHIXLAGSDKSARXKGHDGLDERXSQVLRVRCXYAKWRAVLKIGCNEPSQLAIDLSAQGLARYAIICQQNGLVPIVQPQILADGPXHDIDXCACVIEAVXLRCFKALIKAPCPLXGTLLKSNMVTSGSECNKVTP

SEQ ID NO: 41893 - protein, 169 aa, Rhizobium leguminosarum bv. trifolii
GSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKAFAFAALGAYLLAVIMNRVLVAICMTLVGSS

SEQ ID NO: 41894 - protein, 509 aa, Vitis vinifera
MVQLLLSEPSWSDGGDEDSVKLRISLLNKLESIICSLISSRARSEARVWLCNAMAGIRSIMPRHQRDLFVDLFRSKPWKRGLAAQLWRMIFEKMPHKAGKIIAKKSYMLENFFKGNPTRIMHWFSNFSTGGGLETRKGAKALSQFAFVNRDICWEELEWQGKHGQSPAMVATKPHYFLDLDVQRTVENFLEYVPEFWSSDEFAESLKDGEICSIDRKFFVDVFVDLMYKEDSRSVWEAIDEFLMEESFSSLCQHLLIVIEEPDFCLFLELIHKYINPKMEHKDFGRSSCWLEIILSKCSHFESIDHILLLNAVINQGRQLLRLVHDEDTQEEQAKIKDVVLQICTISSNANGLAPILKCFKTKTTEVIKWLGLQSWVLHYRLSEECLTPESWESLFLNNGISFHKSDKYALLHDDGFAEENGSDLDDRTSIRARRKKKEKSRKKRKKNFDHDDIYENELLGLGSHTGSWLLSTDGYSTSWSSVDLPEHLSKHCFSTWMSWIFTKASSVA

SEQ ID NO: 41895 - protein, 275 aa, Myxococcus xanthus
MLGGTAVVMTVDAYGPISDNAGGISEMSGLGPEVRAITDELDAVGNTTAAIGKGFAIGSATLTVIALFSAFNLEVNHTRIAAGLPEMSLQLTNPNVIVGLLLGSILPFLVGASTMLAVGRAAGAIVEEIGRQFREIPGLMELKADPDPKKIVDIATKSALQEMVFPGIIAVAAPPLVGYLLGPGALAGLLAGSLVVGATMALYMANAGGAWDNAKKFIEKGKLPGHAKGSAVHKAAVVGDMVGDPFKDTSGPGVAILIKVMSVVSLLVASLIALR

SEQ ID NO: 41896 - protein, 143 aa, Arabidopsis thaliana
MLRNVELVRDKLSSGNLRWLCYLSSTSVYGDCGGAWVNENHLPNPKTQSAKVRLAAEQGWLSLGRDLGVSTQILRLGGIYGPGRSAIDTLLKQERLSEGQKRRASRKFTSRVHVEDICQVLKAATEKPASGFVYPSSSMIILL

SEQ ID NO: 41897 - protein, 442 aa, Salinibacter ruber DSM 13855
MLPPFPPFSRTSTLAASARHPSGKPEPGRTGRRGTRTARRQASFLFVLRPRMDLDHLRAETPGTDHVLHFNNAGAALPPQPVLDAQVTHLEREATIGGYEAAAAAEGRLHHTYEAIAQMLGCAPDEVALLENATRAWDMAFYGLSFAPGDRILTSPSAYASNHIACLQVAERTGAAVEVLPHDEQGQVDVDALRSTMDDDVALIALTHVPTNGGLVNPAREVGAVADDADVPFLLDACQSAGQMPLPVDELGCTMLSATGRKYLRGPRGTGFLYVQDDWIERIEPPLLDLHAATWTAPDEYEIHPDARRFENWESHVAGQVALGAAVDYALDQGLDAIFDRNQHLAHALRTRLADVPGVTVHAQGRVRCGITTFSAEQKDASTIQAALRTRDINTSVSPPSSTRLDAEARSLPELVRASVHYYNTEAEIDRFVTALRSVLSS

SEQ ID NO: 41898 - protein, 119 aa, Zea mays
  misc_feature (86)..(86): Xaa can be any naturally occurring amino acid
  misc_feature (90)..(90): Xaa can be any naturally occurring amino acid
LNSTNPSATLLFNPKAFGDTINLFVERYIDQGITLVAGVETLDFIFGPTITLTIGAKFVPLTKPKKFPPYMISQEYSFEYRTDKIXMHVXIVHANHLALLFHNLISTGVTLFSYVKLIE

SEQ ID NO: 41899 - protein, 482 aa, Prochlorococcus marinus str. MIT 9301
MHKKDILPVILCGGRGSRLWPLSRSSYPKQFISFSSQSSFSLLQKTIKRLSNFDNIDNPILICNEEHRFITAEQVKSIGVKPKSILLEPFGKGTTAAIALAALKAIENNTNPKLLILSSDHEIGNLKNFKESIKEGLSFADDGRLVTFGIMPTYAETGFGYIKTNEKLEAGIIKGYEIKKFVEKPNYEKAKEFVRDKHYVWNSGIFLFKATKILEEIKNHAPNTYEICAKSINVKNLDLDFQRIDRKIFSNCKESSIDISIMEKTKLGTMIPMDANWRDIGSWDQVWENSTKDKNGNSKRGNVILKEVKNSLFISENRLVVGLGVEELILIETSDAILVLNKRFSQKVKNIVEQFDKTKNLEGFEHKKIYRPWGNYESLVEDEKWKVKKIIVKPNQSLSLQSHKHRSEHWIVVRGIAKVEISENIFYLNENESAYIPKKALHRLSNPGNEILIIIEVQTGSYLGEDDIKRIEDYYGRVTNKD

SEQ ID NO: 41900 - protein, 223 aa, Brassica napus
  misc_feature (214)..(214): Xaa can be any naturally occurring amino acid
MSLRVCPSSLFHLRPLHLFTSSAKFPFYPSLRREFRFAPSRSSSSSSSSFRLMDSSAASSPTPVTASETDSLGEETQSQTDEGDKIERKLEEFNWDHSFVKELPGDPRSDVISRKVLHACYSKVSPSVQVDDPRLVSWSESVAELLDLHPKEFERLDFPLLLSGAKPLPGAMPYAQCYGGHQFGRWAGQLGDGRAITLGEVLNSKGRRWELQLXGAGRTPYSR

SEQ ID NO: 41901 - protein, 638 aa, Coccidioides immitis RS
MDPNNPNNRLNLNFGFNDRPYTASDPRAYPTTPSTFPQPMYPNQGGHDYVDGQNAQSAYNQGYFVNNPYAQQAPHPQQYMHANVASPQPGYQTRIGGYQQNDGTNGLIQQFSNQDLGGSPRGGGAGRGPAPSQRPRTAGSPAGNQGAGHLAPPMSNRSPKPAGEEEELVRCPEKYSENVHKRGKAAKELVNVFFRENIERARDRNLRAVNLDKTLQNNTLSDARKRHEADTVAKKESNFLRFIRTRETVSNFQTLKIIGKGAFGEVKLVQRKTDGKIYALKSLIKSEMFKKDQLAHVRAERDILADSKDNPWLVKLHASFQDKAYLYLLMEFLPGGDLMTMLIKYEIFSEDITRFYMAELVMAIEAVHKLGFLHRDIKPDNILLDRGGHIKLTDFGLSTGGKKQHDNSYYQQLLKNTSTSKDKNRNSGFFNDAINLTVSNRGQINTWRKSRRAMAYSTVGTPDYIAPEIFNGQGYTYLCDWWSVGAIMFECLVGWPPFCAEEATDTYRKIVNWREYLYFPEELTLSRDSEHLIRSFLCDPEHRIGQEGGQHGGAMQIKNHPFFRGVVWDQLRKIRAPFEPRLTSNIDVSYFPIDEIPQEDNSAQLRAQARAMPEEQEAEMSLPFIGYTYKAFNAFQAS

SEQ ID NO: 41902 - protein, 133 aa, Nostoc sp. PCC 7120
MLMKRYWSRLLALVLVVAIGLVGCGSPDSLTGDYRQDTLAVVNTLRQALEITEDSPDKTALQAEARQKINDFSARYQRVNSVSGLNSFTTMRTALNSLAGHYSSYPNRPVPQKLKSRLEQEFKQVESALKRGA

SEQ ID NO: 41903 - protein, 489 aa, Salinibacter ruber DSM 13855
MPSTLFAYTCDQLFLAPMATDYDCVIVGSGPGGYETAIRATQLGMETAIVEKDKLGGVCLNVGCIPTKALLKSAEVMAETSHLDDFGLELDGSVSPDFPSVIERSRGAANQMNQGVRFLMQKNDIDVLRGHGRLTAPDTVEIEPSVNMDGEEVGEARTVTGEHIILATGARPNELPFLPIDGEKVMSSKEAMLQTEQPDSLVIVGAGAIGVEFGYFYHHMGTDVTIIEVQDRMVPAEDKDVSKELEKAYTKMGIEVMTGANVKGVDKDAEPLRVEVETGGSTEHIECDQVLSAVGVVGNVEDIGLETVGVETEGGDIVVDDYYRTNVDGVYAIGDVTGAPWLAHKASHEGILCIEKIAGHDVRPMDPNDIPACTYCQPQIASVGHTEEEAREAGYDVKVGTFPFKANGKAAALGHQEGFVKTIYDEKYGELLGCHIIGEDATELISEVVAARTLETTGLEIMESMHPHPTLSETVMEATREAYGQPINI

SEQ ID NO: 41904 - protein, 172 aa, Prochlorococcus marinus str. MIT 9301
MLEKNLKNTIKSYPDFPKKGILFRDILPVFQNPSIFNKLIESMIDKKIYRKSEAILAIDARGFLFGSVIAYKLSKPLILARKPGKLPGKLSTYKYDLEYGSNSLSLQDDSIRNLDNFVIVDDLLATGGTVNSVSKILKDKDKNVLGLSVVVELKDLNGRSKLNFPVESEIIY

SEQ ID NO: 41905 - protein, 220 aa, Bacteroides fragilis YCH46
MDDFRKYATKHLGMNAMVLDDVIKSQAGYLNPYILEERQLNVTQLDVFSRLMMDRIIFLGTQIDDYTANTLQAQLLYLDSVDPGKDISIYINSPGGSVYAGLGIYDTMQFISSDVATICTGMAASMASVLLVAGAKGKRSALPHSRVMIHQPMGGAQGQASDIEITAREIQKLKKELYTIIADHSGTSFDKVWADSDRDYWMTAQEAKEYGMIDEVLIKK

SEQ ID NO: 41906 - protein, 517 aa, Photobacterium profundum SS9
MSEVTQAKDAELLSGADYLRNILRAPIYEVAQVTPLQDMDRLSARIGNRIQLKREDRQPVHSFKLRGAYNMMSQLTPAQRKAGAIAASAGNHAQGLALSGHKLDVSATIVMPLTTPAIKVDAVRSFGGKVVLHGNNFDEAKAHAEELAQQYGYTFIPPFDHPSVIAGQGTIGMELLQQNGHLDYVFVPVGGGGLAAGISVLLKQLMPNIKIIGVEAEDSACLKAALDAGCPVTLDQVGMFADGVAVKRIGEETFRLCQQYLDDVITVSSDEICSAVKDIFEDTRAIAEPSGALSLAGLKKYVEVHQLQDKQLASILSGANLNFHGLRYVSERCELGEKREGLLAVTVPERPGAFLDFCHILGGRTVTEFNYRYNDDALANVFVGVRLMQGQEELDGIIHDLRKGGYPVVDLSDDEMAKVHVRYMIGGRPSKPLKERLYSFEFPEYPGALLKFLNTLGTHWNISLFNYRNHGADFGRVLCGFELEDKDLLSFTSHLHELGYQWKDETENLAYKFFLAQ

SEQ ID NO: 41907 - protein, 318 aa, Debaryomyces hansenii CBS767
MATFSKVNFKTINYNSFRPHYPSSFYQILSKYATEGKESRLPLNKSLDLGCGTGVATYSLLNFVDDVTGIDVSPPMIETAKSLIPERCEQMNVKDRSRIKFKTGSAESFVSLGSREVEDNSIDLIVAAQCIHWFQDYNIFYKSCASLLKQGGTLAYWYYVDPIVIDFQGPAKGEKMEILKKAFQIYSKYVYDDPKFIGPHWEQPGRNIIKNLCVEVNEAIPKDLYSDIKIQTYVPDFDGNVKPTDDDLKLEKLNMLINDFIKYLNTYSGFHNYKDATGDKENLIELFLSECETELGWDREKTRIDIVWRTGYTFMKKK

SEQ ID NO: 41908 - protein, 339 aa, Schizosaccharomyces pombe 972h-
MSYSFQGLLNRVNESAIVNTLKEYTGLNTPKWTFNDIPDLTGKVALVTGSSGGIGYVTALELARKGAKVYLAGRNEEKYQKVMKQIHDEVRHSKIRFLRLDLLDFESVYQAAESFIAKEEKLHILVNNAGIMNPPFELTKDGYELQIQTNYLSHYLFTELLLPTLRRTAEECRPGDVRIVHVASIAYLQAPYSGIYFPDLNLPHVLLGTFARYGQSKYAQILYSIALAKRLEKYGIYSVSLHPGVIRTELTRYSPTFALKLLEKSVFQYLLLDPIRGAMTSLYAATSPEISKEHLNGAYFTAIAQRGILHRAHDDAFVEELYRYTHKIFEDLKYLAPSP

SEQ ID NO: 41909 - protein, 496 aa, Candidatus Kuenenia stuttgartiensis
MLKNWKREWFSNVRGDLLAGIVVALALIPEAIAFSIIAGVDPKVGLYASFCISVIISFAGGRTGMISAATGAMALLMVTLVKEHGLEYLLAATLLTGALQIIAGFLRLGNLMRFVSSSVVKGFVNALAIMIFIAQLPELMHVNWYVYSLAAGGLCIIYLFPYIPVLGKILPSPLICIVAVTAVSVGMGLDVRTVGDMGKLPDTLPIFLLPEVPLTFETLTIIFPYSFALMVVGLLESMMTATIVDDLTDSKSDKNRECKGQGIANIGAGLMGGMAGCAMIGQSIIAIKSGGRGRLVAFAAGVFLLSMVVFAGTWVKQIPMAALVAVMIMVSIGTFSWSSIRSLKKNPLSSSIVMVSTVAAVVATHNLAIGVLIGVLLSSLFFANKISRIFVVKSHINKALPWRIYKVIGQVFYASADRFTNSFDFKEALERVTIDLSEAHFWDVTSVYALDKVVIKFRREGVHVEIIGMNEASATIVDQFGVHDKPEEVEKLLAGH

SEQ ID NO: 41910 - protein, 527 aa, Haloarcula marismortui ATCC 43049
MSQQEEPDDETGAPDDAVEELRQKRAEAELGGGEARIESQHEKGKMTARERIDFLVDDGTFNEVDPFVEHRSTNFGMEEKRFAGDAVVTGYGEVDGRKVFLFAHDFTVLGGSVGEVVADKICKVMDRAIENGVPVIGLNDSGGARIQEGVDSLVGFAKIFERNTKASGLIPQISAIMGPCAGGATYSPALTDFTFMVQDTSHMFITGPDVIETVTGEQVSKEELGGAGSHSTKSGVAHFSYPSEEEALENIRRLLSYLPANNMEDPPRVKPWDDPDREIPGVTDIVPSAPRKPYDMTKVIDAIVDEDSFFEVHGNWARNVVVGFSRMDGQSVGVVANQPRVSAGTLDIDAAEKAARFVRFCDSFNIPILTLVDVPGFMPGTDQEHNGIIRRGAKLIYAYAEATVPLLSVVVRKAYGGAYIVMSSKFLGSDVNYAWPGSEMAVLGPRGAVNILYRNEIADAGDPDAKRQELMDEFRDEFANPYGPAKRGYLDDVIEPKETRKRLIQDLDLLQRKREDTPPKDHGNIPL

SEQ ID NO: 41911 - protein, 314 aa, Parvularcula bermudensis HTCC2503
MKILAGNATPDLAEAIGKTLDVPLAQALVKSFNDGEVRVEIGENVRGEDVFVVQSTSEPANKHLMELLIMIDALSRASASRITAVIPYFGYARQDRKAGPRTPISAKLVANLITTAGADRVLTVDLHAGQLQGFFDIPTDNLYAVTVMEDEIRQTFGPDLSDLCVVSPDVGGVVRARTLARRLGDVDLAIVDKRRLAPGEAEVMNIIGEVDGRHCIMFDDIVDSGGTLVNAADALTKQGAASVSAYVSHGVLSGEAVARINKATNLHRLVVTDSIGNQARKAQSEKIKTISVARLLAEAIRRIANEESVSSLFE

SEQ ID NO: 41912 - protein, 423 aa, Ashbya gossypii ATCC 10895
MTTKLKGLKELGNTSDPLRTVSYQVRTKMSDYEDDNTDVQSLTVEEEYELWNSNVPVMYEFVSETKLTWPSLTIQWLPSDGQSPEQSLIFGTHTAGEEVNYLKVATINLPAGIAGLDQGDEEDEANDHSSFAIANKFPHIEEVIRARYMPANSNIIATINGKGTISIFDRTLEESKAQVSTLAFHKENGYGLAFNPHISGELLSGSDDTTVALWDIEAAKKPKSILTSHDDIVNDVKWHEFESNVFGTVSEDKTLQVHDKRVRLEPVKKLPTASPFNTLSFSKHSRNLLAAAGVDSQIYLYDMRDMSSPLHVMSGHQDSVTTVEFSPHTDGIICSSGSDRRAIIWDLTQIGAEQSQDDADDGAPELMMMHAGHRSPVNEFSFNPQIPWLLASTEEDNVIQAWKVSMKLVNASPPAISDPSLLV

SEQ ID NO: 41913 - protein, 431 aa, Shewanella sp. ANA-3
MAKIINVIGREIMDSRGNPTVEAEVHLEGGFIGMAAAPSGASTGSREALELRDGDKSRYLGKGVLTAVANVNGPIRAALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLSGEGKVFDSNGFSDFLKSLTEQYPIVSIEDGLDESDWDGWAYQTKIMGDKIQLVGDDLFVTNTKILTRGIENGIANSILIKFNQIGSLTETLAAIRMAKAAGYTAVISHRSGETEDSTIADLAVGTAAGQIKTGSLCRSDRVAKYNQLLRIEEQLGEKAPYRGLKEIKGQA

SEQ ID NO: 41914 - protein, 440 aa, Candidatus Kuenenia stuttgartiensis
MDMREKSVMKEHRGLARELNFFDVVCMGFNCVVGAGIFLLAGQLDSLVGIGALLVFPLCGLLCFAVALCFAEIGSMYDKTGGAYLYTKDVFGPFAGFLVGWIMWLASIIGWASVASGFGLYCNYFLPKDQQWLSKVIITALVIGLSITNYCGVKPGARSINFFSIGKFTALFIFIVAGMFFVKRENFGQLHSSGSFSMATTLALYAYTGFEFLVVPAGEMKNPQKHIPRVIMVVFMMVTALYALIQYVAMGTYPDLAGSDKPLADAAFYFLGPAGGIIIGIGALLSIGGVNAGIALTSPRSLYVLSADGFFPPVFAKIHPKYHTPYLAIAVNTVLTLLLGLTGSFRYLIAASVLVSILQYVPTCLAVIALRRKRPDRKRGYKIPGGYGIPVLALIICGWLLCHVELKIIGATALAIAVSLPFYFRGRFFRKNPCPYKKQP

SEQ ID NO: 41915 - protein, 250 aa, Cephalotaxus fortunei
MAGITASPSTTLPKLSVFNVAQRGSDRRRGSVNVSAGIYKPSDFKLLSIKSVPKLGGLKHEDQHGVVMCKASASSVTYSYTKSSKAAPAPVLPFRIGHGFDLHRLEPNLPLIIGGINIPHDRGCEAHSGGDVLLHCVVDAILGALGFPDIGQIFPDTDPKWKGATSSVFVKEAVRLMHEAGYELGNLDATLILQRPKLSPHKEVIQSNLCALLGASSSVINIKAKTHEKVDSLGENRSIAAHTVVLLMKK

SEQ ID NO: 41916 - protein, 430 aa, Synechococcus sp. WH 8102
MIDSLDLVIDTIVAREVLDSRGNPTVEAEVLLEGGAMGRAIVPSGASTGAHEAHELRDGGDRYMGKGVSQAVTHIEERIAPTLCGLSALDQAAVDAAMLELDGSDNKSSLGANAILAVSMATARAAANGLGLPLYRYLGGPMANLLPVPLMNVINGGAHAANSLDFQEFMLVPHGAPSFREALRMGTEVFHTLKGLLKAKGMSTSVGDEGGFAPDLGNVEAGEILVEAITKAGYKPGEQISLALDVASTEFFENGRYAFDGGNYDSAEMVGQLEQLVEKFPIVSIEDGLAEDDWEGWKLLTERLGGKVQLVGDDLFVTNTKRLQQGIDNSTANSILIKVNQIGSLTETLQAIDLAGRSGYTSVISHRSGETEDTTIADLSVATRAGQIKTGSLSRSERVAKYNQLLRIEDELGSQAVYAGAVGQGPRGNA

SEQ ID NO: 41917 - protein, 139 aa, Physcomitrella patens subsp. patens
MASAGGSGTQVRKSDEEWRAILSPEQFRILRKKGTEYPNSGEYNKTYNDGVYNCAGCEAPLYKSTTKFDSGCGWPAFFEGIPGAINETRDADGRRVEITCAACGGHLGHVFKGEGFPTPTDARHCVNSVSLKFTPANMA

SEQ ID NO: 41918 - protein, 337 aa, Bradyrhizobium sp. BTAi1
MTVLVTGGAGYIGSHMVLALAEAGENVVVIDNLSTGFSAFVPENVPLFIGDAGDEHLVDGVISQHGVDSIIHFAGSVVVPESVRDPLLYYRNNTMTTRSLLNAAVKRGVSRFIFSSTAAVYGNPEQVPVTETAPTRPTSPYGTSKLMAEIMLHDVATAHELNYVVLRYFNVAGADPQGRVGLATVGATHLMKIAMEVATGQRAKIDIYGTDYPTPDGTCIRDFIHVSDLAQAHRAALAYLRTGGSSVTLNCGYGRGYSVLETIEAVRRVSGRAIPTQYAPRRPGDIMTMVADTTRLKALLDWTPAYDNLETIADHALAWEEKLFLERHSGALQRATA

SEQ ID NO: 41919 - protein, 361 aa, uncultured archaeon GZfos14B8
MKAILALEDGTVVEGEGWGAEGTALGELVFATPFTGYEEALTDPSYKGQILMPTYPLIGNYGVSGAKFQSEGIKVEGFVVREKCDFPSHYKIKRSVDQFLREEGVPGICEIDTRMLTIKTRQYGTMKACLKVVEDYSEDENANALELAKTQPDISELDLVEQVTCEEYYRIKGKGKRIAVLDLGVKRNILKNLAERDLDIFVFPANIEESEIRSLEPDALLLSNGPGDPKRGKNAMRVVKNFAGVIPIFGICLGLQIIALALGCDTYKLKFGHRGANQPVKDLKSGRVYITAQNHGFAVDKDSMDGVAELTQLNANDDTVEGFEDHYLGIKCVQYHPEASPGPWDTEKMFFENFFASKNLY

SEQ ID NO: 41920 - protein, 317 aa, Oryza sativa Indica Group
MAEAAAAPPAAAATNYEVDLGNLMAYDPSHHLPAASSSRSAPIAATAIVPCCFDSVTKFPGVARREELREECLRKGTELAQAVADALFALPATEDRDGPMVRLPPPTTRFPREKHLPRPKPPTKWEQFAKMKGITKHKKNKREWDEQTQTWKRTYGYDRVNDDKDIPIIEAKGDRCHIQLAATALPITGTKADIPKKSRKKDLEDVAGMASSATASGGKFDEKLPGEKPPKNPGKHRKFLPVVEGKGMGNQEKQQNDKILNALLAKSSEDQMDVGRAITMYKVKKEKQRRKDKEKSSSSNKLKPQKKTLKKSSKKKA

SEQ ID NO: 41921 - protein, 570 aa, Arabidopsis thaliana
MITGNEFYTVMCAMAPLYFAMFVAYGSVKWCKIFTPAQCSGINRFVSVFAVPVLSFHFISQNNPYKMDTMFILADTLSKIFVFVLLSLWAVFFKAGGLDWLITLFSIATLPNTLVMGIPLLQAMYGDYTQTLMVQLVVLQCIIWYTLLLFLFELRAARLLIRAEFPGQAAGSIAKIQVDDDVISLDGMDPLRTETETDVNGRIRLRIRRSVSSVPDSVMSPSLCLTPRASNLSNAEIFSVNTPNNRFFHGGGGSGTLQFYNGSNEIMFCNGDLGGFGFTRPGLGASPRRLSGYASSDAYSLQPTPRASNFNELDVNGNGTPVWMKSPAAGRIYRQSSPKMMWESGQRHAAKDINGSVPEKEISFRDALKAAPQATAAGGGASMEEGAAGKDTTPVAAIGKQEMPSAIVMMRLILTVVGRKLSRNPNTYSSLLGLVWSLISFKWNIPMPNIVDFSIKIISDAGLGMAMFSLGLFMALQPKMIPCGAKKATMGMLIRFISGPLFMAGASLLVGLRGSRLHAAIVQAALPQGIVPFVFAREYNLHPDLLSTLVIFGMIVSLPVTILYYVLLGL

SEQ ID NO: 41922 - protein, 205 aa, Triticum aestivum
  misc_feature (111)..(111): Xaa can be any naturally occurring amino acid
  misc_feature (143)..(144): Xaa can be any naturally occurring amino acid
  misc_feature (146)..(146): Xaa can be any naturally occurring amino acid
  misc_feature (157)..(157): Xaa can be any naturally occurring amino acid
  misc_feature (170)..(170): Xaa can be any naturally occurring amino acid
MVHVSSLFVFVMSCCAISRVGCLFARCRYEFQMQYGSIGWSVGALLGYAQGASDKRVIACIGDGSFQVTAQDVSTMLRCEQNSIIFLINNGGYTIEVEIHDGPYNVIKNWXNYTALVEAIHNGEGKCWTAKVKCEEELTAAIXXPXGRKKDSLCFIXVIAHKDDTSKDFXKWGSKVSAANSKPPTPSRQANLHQYSTTTTPLAIK

SEQ ID NO: 41923 - protein, 110 aa, Oryza sativa
MDANRRQSGIQQLLAAEQEAQQIVNAARTAKSARLRQAKEEAEREIAEYRAQMEAEFQRKVAESSGDSGANVKRLEQETAEKIAQLKQQAASISPEVIQMLLRHVTTVKN

SEQ ID NO: 41924 - protein, 308 aa, Prochlorococcus marinus str. MIT 9301
MLKPHKLSNDNFLSCLDISADEVHHILEVAKNFKNEDLELKLKNKVLGLIFDKSSTRTRVSFQVAMSRLGGTTIDLNPNTSQIGRGEAIKDTARVLSRYCDVIAIRTFKHSDLEEYAKWSTKPIINALTDFEHPCQALADFLTIKEEYFDFENVVLTFVGDGNNVANSLILCGALLGVEVRIACPKGYEPDSLVINQAREIYKNKNLLKISNDPFSAVSGANVLYTDVWSSMGEEKQKEEKDKDFNGFSIDENLLSKAEKDAIILHCLPAYRGKEITEKVMESKNSRIFNQAENRMHAQQALLACLLA

SEQ ID NO: 41925 - protein, 468 aa, Photobacterium profundum SS9
MATGKIVQIIGAVVDVEFPQDSVPKVYDALKVDAKEKGTLVLEVQQQLGGGVVRCIAMGTSDGLRRGLSVENTDRPIEVPVGIATLGRIMNVLGEPIDECGEIGEEQRYAIHREAPSYEEQSNETSLLETGVKVIDLICPFAKGGKIGLFGGAGVGKTVNMMELINNIALQHSGLSVFAGVGERTREGNDFYFEMQEAGVVNLENPSESKVAMVYGQMNEPPGNRLRVALTGLTMAERFRDEGRDVLLFIDNIYRYTLAGTEVSALLGRMPSAVGYQPTLAEEMGVLQERITSTKSGSITSVQAVYVPADDLTDPSPATTFAHLDATVVLSRQIASLGLYPAIDPLDSTSRMLDPLVVGQEHYDIARGVQSLLQRYKELKDIIAILGMDELSENDKQAVSRARKIERFLTQPYHVAEVFTGDPGIYVALKDTLRSFKGLLAGEYDDIPEQAFMYCGAIEDVLEKAKKL

SEQ ID NO: 41926 - protein, 273 aa, Parvularcula bermudensis HTCC2503
MTNKLSLLLVGAGNMGGALFTSWVEKGVLDPARSAISDPNPSDAVIALAEKAGIAINPEDDQPYEVCVLGIKPQLFGAVLPDLQFGGMNDALFISMAAGTSLGEIGKLLKGQAPNARLVRTMPNLPAAIGEGMSLLCAGEGVTDKDKAAATALMEAAGQVVWTKTEDDVDRLTGVSGSGPGFVLYVVEAFEAAAKAQGASDSDARLLAEQTIIGTALHLSRDGRTAAELRKAVTSPGGTTEAGLNVLMADERLHRLIAEAVEAAYDRAQELSS

SEQ ID NO: 41927 - protein, 521 aa, Triticum aestivum
  misc_feature (18)..(18): Xaa can be any naturally occurring amino acid
RRPSFAPSHNHSHHRHGXHHRYDPPRGAGNVPPAGSDKDGREFHNKEGKGLKEGENVADAKGPQLNSPVTDAGEKNSSLQITAEGSSKVVPTPVEYTTSEIIDGKPVNTVEGLKVYEGLVNVTEINKIVSLVNETKASSRRGGFEVGQTVIVGKRPLKGHGSVIIQLGVPIIEGPLEDENQRETTRVEPVPGLLHDLFDRFFRQGIVPFKPDYCVVDFYYEEEYSHPQQPPSWYGRPLCTLCLTECDMVFGRVIFGERGDNRGPLKLSLSTGSLVVLQGRSADVAKRAIPATRKQRILLTFGKSVARKVAPSESASRPTAPLTPPSMPWGPPSRPANVRPHSPSPQHFGYTPTSSVLPAPTTGPHHIPPSDGMQPLFVAPAPVAAAAIPFPAAVPLPNATAAWMPEAAPRPAPPRFPVPGTGVFLPPGSAHQLPHQMIQASHAHAEPNSPRGSAAYVHNKGTGMEVANGSASPKSSGTTKRADTTEAKPECNGSSSSVGEEQQNGGMKNAGLSKVEPSAAK

SEQ ID NO: 41928 - protein, 522 aa, Triticum aestivum
  misc_feature (80)..(80): Xaa can be any naturally occurring amino acid
  misc_feature (178)..(178): Xaa can be any naturally occurring amino acid
  misc_feature (189)..(189): Xaa can be any naturally occurring amino acid
  misc_feature (270)..(270): Xaa can be any naturally occurring amino acid
  misc_feature (278)..(278): Xaa can be any naturally occurring amino acid
  misc_feature (321)..(321): Xaa can be any naturally occurring amino acid
MASATLLKSSFLPKKAEWGVARQVAAPRVSMVVRAGAYDDELVKTAKTIASPGRGILAMDESNATCGKRLDSIGLENTEXANRQAFRTLLVSVPGLGNHISGAILFEETLYQSTVDGKKIVDILVEQGIVPGIKVDKGLVPLTGSNDESWCQGPRRPSPSREARPTTSRGAPAFAKWXRTVVSIPNGPXSELAVKGGPPWGLARYAAISQDNGLVPIVEPEILLDGEHGIERTFEVAQKVWAETFYQMAQNNVMFEGILLKPSMVTPGAXECKDRATXPEQVADYTLKLLSRRVPPAVPGIMFLSGGQSEVEATLNLNATXREAPRLDRPGEHRGEPAGRSATPAGLRPWPSATTSPAPSSSRRRSTSPPSTARRSSTSWWSRASCPGSRWTRAWCRSPAPTTSLGARASTASPPGRPPTTSRAPASPSGAPWSASPTGPFELAVKEAALGPNPWHVSFSYARALQNTCLKTWGGRPENVKAAQEALLLRAKANSLAQLGKYTSDGEAAEAKEGMFFKNYSY

SEQ ID NO: 41929 - protein, 443 aa, Microcystis aeruginosa PCC 7806
MISFTLEAAMTISNDLPLPPGSFGLPLLGETIAFLTDGDFASKRHNKYGQLFRTHIFGSPTIILSGTEANRFLLSNENKYFAATWPKSTKTLLGSASLAVHTGDVHASRRRLIYQAFQPRSLASYIPTVETITAHYLERWQTAKTLSWYPELRNYTLDIACKLFIGLDQGSATKLGEVFDTWCAGLFTLPLPLPWTAFGKALRCREELLQAIKTIILERQKNDDLGQDALAILLEAKDENGQSLSLAELKDQVLLLLFAGHETLTSAIATFCLQMALHPDIFQLVLEEITNFDLSTPLSVDTLKQMTYLDRVLKEVLRFTPPVGGGFRRVIKDCQFNGYHLPKGWVVQYQISNTHKDNNIYSHPETFDPDRFLADEKPYGYIPFGGGLRECIGKEFARLEMKILAVRLVEKYDWQLLPNQDLTLTTIPTPHPRDGLQVTFKLR

SEQ ID NO: 41930 - protein, 500 aa, Mesorhizobium sp. BNC1
MELQDYAQHIGGEAVAAADGETYITHNPANGRPWGRFPAGKSADVARAVAAAMEALRGSWGSMAPTRRGRLLIEWARAISVNAEKIARLETAQNGKIFRDCLNQARDLENWLYYYGGQADKIEGTVVPLLRQSILNYTLREPLGVIGIITPWNSPASLTMSSAAPALAAGNAIVIKPSEVTPASILEIARLAEEAGIPKGVINVVTGGRNAGEALVDHPDIAKIAFTGSVEAGRAIAERAGKRLIGCTLELGGKSPNIVFPDADLARAEAGVLGGIFASTGQTCVAGSRAYVHESLFDSFVERLATRARQIVLGDPMDPRTQMGPVSTELQLQKDERLVAEALSEGAVKIAGGERVSPPGCEDGYFYAPTVLTKLNPAASILKTEVFGPVLSVLPFKSEDDVVAMANDSPFGLAAGFWTRDFARAHRLARRLEAGTVWINMYRAFAFNSPMNGHKQSGIGWQNGSEAIFQYLKTKSVWCETDEDYGDMFARAQPASTGRE

SEQ ID NO: 41931 - protein, 877 aa, Ashbya gossypii ATCC 10895
MDLNHAYKASNGESNNSLDSSLDVKPMEKPATDDAVRTEKRKYHGAAVMSHHQISVMSQPLTKGVRELIKKTTAFMSCSKSKPQKLMELGPMTYAHSVLTASEKPLCHMELESSSVNGFADTLQDNGVSDATLVEMWLIRVTRRKRVRYCFRISNGVLTWKDNRMLELDTIKDIRMAEMAKNYREQYDIMDAFASRWITIIYQVSPTKLKALHLIAPTQLECAKFYNAVLTVARQRRELMESISVPSSEAFANIHWKVNVSSKKADESRDTLSFEDVQRLCTKFHIYCSSNYLKRVFKIADVNRNGLLNFSEFCTFVRMLKKRHEVTEIWQKIAAETRAIDFEKFYSFLTDVQCEDMDAQLARDLFNEYSHEGYMDEDLLLKFLTAQPYAREIEEDYSRPLSEYFISSSHNTYLLGNQVGSMASVEGYIQALQQGCRSVEIDIWDSDDGPVVCHGKLTSSLPLRNVVDVINKYAFITSPYPLILSLEIHCRSEGQIIVKQLFDDILGPLIYVADHSVGWPSLRDLKHKIIIKSKKLRVNVDMAADIYHSTSSKGSSYDSEYDVQSQPSSPMPRRGMRGIHISKRKHRVIEQLLQISAIHGITFRNFSLPESKTPTHCFSLSERSFDNLANDDLQRLAIDKHNRRHLMRVYPHAFRYKSSNYDPIKCWRLGVQMVATNWQTYDLGQQLNQAMFRVTARDDWPWPSGYVRKPEYLLHTVPKTSFIRDIYEAVHSSVVALSLELLSAQLLPKPKLSSRDGEAHFAPYVVIEVLGDGLCGPIHVQNGLVTAPNQVTSCRCPENGFNPVWKTSLTATLNNTGFNFIRYIVKNADITLATCCIRLDYMKRGYRHIPLYSLESSRFIFSTLFVKTDYRIVRSLF

SEQ ID NO: 41932 - protein, 513 aa, Glycine max
FFFHLYGHRPQCVSPYLILCITLPMLLLFFYQYRRAFKNSTLPPGPRGLPIIGNLHQLNSSSLYLQLWQLSKKYGPLFSLQLGLRPAIVVSSHKLAREALKDNDLEFSGRPKLLGQQKLSYNGLEMIFSPYGEFWREIRKICVVHVLSSRRVSRFSSIRNFEVKQMIKRISLHASSSKVTNLNEVLMSLTSTIICRIAFGRSYEDEETERSKFHGMLNECQAMWGTLFISDYIPFLGWIDKLRGLHARLERNFKELDEFYQEVIDEHMNPNRKTTKNEDITDVLLQLKKQRLYSIDLTNDHIKAVLMDMLVAATDTTSTTTVWAMVALLKNPRVMKKVQEEIRTLGGKKDFLDEDDIQKFPYFKAVIKETLRLYLPAPLLVQRETNEACIIDGYEIPAKTIVYVNAWAIHRDPKAWKDPDEFLPERFLDNTIDFRGQDFELIPFGAGRRICPGMPMAIASLDLILANLLNSFNWELPAGMTKEDIDTEMLPGLTQHKKNPLYVLAKCRIQNYD

SEQ ID NO: 41933 - protein, 330 aa, Physcomitrella patens subsp. patens
MSEAASACGPAEADSCYDKVGAAHLKGGAIAVIFIASMLGVLIPLIGRRNRFLRSDGIAFFIMKAFAAGVILATAFVHMLPAGSGALTSSCLPEKPWGKFVWSEFIAMLAILATLVMDIVATEFYMSRHVMQHGGVDKVVDASEAIEKQAPGLVTPHPHVHEHEEDSVFTNIRHIVVAQVFEFGIAAHSIIIGVTVGVSNSPCVIRPLFAALTFHQFFEGVALGGCVVQAGFRSVTSLSMGLIFAITTPLGIAIGMGIASSYNENSTQALIVQGVFGSVSGGILIYMSLVDLIAADFLSKRMRCNRKLQVGAFLALFLGVGCMSVIGLWA

SEQ ID NO: 41934 - protein, 240 aa, Zea mays
MDQYKYKKKQPPYGGQKRKYRKTSIQHQENYRFIAQELELADFQEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 41935 - protein, 151 aa, Synechococcus sp. WH 8102
MAERTFIAIKPDGVQRGLVGEILGRFERKGFKLVGLKQITPSRALAEQHYGVHKERPFFAGLVDFITSGPVVAMVWEGDGVIASARKLIGATKPLEAEPGTIRGDLAVNIGRNVIHGSDAPETAEFEIGLWFDAAELNDWTPSDQTWRVEA

SEQ ID NO: 41936 - protein, 190 aa, Dehalococcoides sp. VS
MKLTIPTMLTLARIVLIPVLVVVFFLDYPWTNFAAAFIFAFASVTDWLDGWIARRYNQYSAFGAFLDPVADKLMVAVALLLIVQKHPTVWMTLWAAVIVGREIAVSALREWMAELGQRAAVKVAAIGKIKTIVQMVALVCLLYQERFLGLPVFQIGEWLLAAAALLTLWSGLAYLRAAWPIMRADNGGPR

SEQ ID NO: 41937 - protein, 310 aa, uncultured archaeon GZfos14B8
MFEPEKFIERQVDEVKETIGDGKAVIAVSGGVDSTVCAVLTHRAVGDRLVAVFIDDGLMREGEAEQVMNFFKARNMNARQVDAANEFFDALKGIVDPEEKRKAFRNTFYSVLARVVREENANCLVQGTIAADVAETVKGIKTQHNILEQIGIDPGSYGLTIVEPLREIYKPEVREVARSFGVPPEFSERPPFPGPGLATRVLGEVTPERVEIERRATKIVEEETSDVESFQSMAVLMNDMATGIRGGKRAYGYITVVRLVKSKDAITAEAVNVPWEVLKRIDKRITSEIPEVVHVLYSLTDKPPATIEFQ

SEQ ID NO: 41938 - protein, 331 aa, Microcystis aeruginosa PCC 7806
MLNNQRSSPVSVICLGEILYDLIADQSDRAMEQVTSWTTYAGGAPANVACGLRKLGINSAFIGCVGKDQPGEQLIALLDALGVDTTGVQYHATLPTRQVYVTRDAGGDRHFAGFGGRKTTDFADTALNADLLPENLFKNADYLVMGTLGLAYSPARAAMMRALELAKIYAVKVLIDINWRPVFWPNLEVAPDQIRDFIVQADLLKCSEEEAAWLFGTDTPREISSQYPNLEAILVTRGAKGCKYHLGENSGTVEAFSGEVVDTTGAGDGFVAGFLARAALEGDQIGENADLARKAVIYACAVGAMVTRGAGAIASQPTREQVEEFLAALDS

SEQ ID NO: 41939 - protein, 517 aa, Nicotiana sylvestris
MVFPIEAFVGLVTFTFLLYFLWTKKSQKLPKPLPPKIPGGWPVIGHLFHFNNDGDDRPLARKLGDLADKYGPVFTFRLGLPLVLVVSSYEAIKDCFSTNDAIFSNRPAFLYGEYLGYNNTMLFLANYGPYWRKNRKLVIQEVLSASRLEKFKQVRFTRIQTSIKNLYTRINGNSSTINLTDWLEELNFGLIVKMIAGKNYESGKGDEQVERFKNAFKDFMVLSMEFVLWDAFPIPLFKWVDFQGHIKAMKRTFKDIDSVFQNWLEEHINKREKMEVGAEGNEQDFIDVVLSKLSKEYLDEGYSRDTVIKATVFSLVLDAADTVALHINWGMTLLINNQNALMKAQEEIDTKVGKDRWVEESDIKDLVYLQAIVKEVLRLYPPGPLLVPHENVKDCVVSGYHIPKGTRLFANVMKLQRDPKLWSNPDKFDPERFIAGDIDFRGHHYEFIPFGSGRRSCPGMTYALQVEHLTMAHLIQGFNYKTPNDEALDMKEGAGITIRKVNPVELIITPRLAPELY

SEQ ID NO: 41940 - protein, 123 aa, Zea mays
IRLERELGDIHVLAREGATEDIVKFLAAGVEVNMRDTEGRTPLHWAVDRGHLSAVEVLAKANADLNAKDNEGQTALHYAAVCEREDIAELLVKHHADLQIKDEDGNTAQDLCPPSWSFMNRAN

SEQ ID NO: 41941 - protein, 331 aa, Solibacter usitatus Ellin6076
MAAIPESAKLFMSGLIERARKLKKTIVFPEGADPRVLEAAARLAREGVVKPVLIGPRPANAPEGVEFTDPAHSPLLKKYADLYYERRRAKGTTQVEAAAVAKKPLYFASLMVGAGDADGSVGGAVNSTAETVRAALHAVGVHPRARLVSSVFIMALQDLSQGHNGLMAFADCAVVIEPNAMQMADIAIATAESTRVLIDAEPAVALLSFSTRGSGRGPMVSKVVEAMQILKARAPELNADGELQADAAVDLMVGKSKAPGSKVAGRANTLVFPSLESANIGYKLVERLGGAMAIGPFLQGLAKPANDLSRGCSAEDIFNVAVVTALQSEIH

SEQ ID NO: 41942 - protein, 236 aa, Pyrococcus furiosus DSM 3638
MSQEWKEYAKRVLDEWEPKTKLGMMVKEGQITDIHEIFRRGYQIKEPEIIDVLLPEVNARENQEVLDIALTVRMTDSGRRVRFRVLAAVGNRDGYVGLGIGHGKEVGIAIRKAINYAKLNIIEIKRGCGSWECRCRRPHSVPFAVEGKEGSVRVRLIPGPRGLGLVIGDVGKKILRLAGVQDVWSQTFGETRTTVNFAKAVFNALYNTNRVAISPEMIERYGIVVGRAMPTTFTLE

SEQ ID NO: 41943 - protein, 357 aa, Escherichia coli
MKAPIMVNMSVHLNRKSPTSNASYSAEKRCWYGRSCTKRSILCRAVSFANNLQPSADEIIMIAKSWSYYVCQTSGHCGNRIQRRGTTTTSLAFRKIFAQLNLHAAEVEGDSFHRYTRPEMDMAIRKARDAGRHISYFGPEANDFGLLEQTFIEYGQSGKGKSRKYLHTYDEAVPWNQVPGTFTPWQPLPEPTDVLFYEGLHGGVVTPQHNVAQHVDLLVGVVPIVNLEWIQKLIRDTSERGHSREAVMDSVVRSMEDYINYITPQFSRTHLNFQRVPTVDTSNPFAAKGIPSLDESFVVIHFRNLEGIDFPWLLAMLQGSFISHINTLVVPGGKMGLAMELIMLPLVQRLMEGKKIE

SEQ ID NO: 41944 - protein, 467 aa, Propionibacterium acnes KPA171202
MSSHFDVVVLGAGPGGYVAAIRAAQLGKKTAIIEKEYWGGVCLNVGCIPTKSLLRNAELAHIVTKEAKTFGIGGDITVDFGKAFSRSREVSARMVKGIHFLMKKNKITEFNGWGEFTGPKAISVKDSDGKVTDEITFDNAIIAVGSVVKTLPGTQLSGRVVTYKEQILSDTVPGSIVIAGSGAIGTEFAYVLANYGCDVTIVEFLDRMVPNEDKEVSAELAKAYKKLGIKVLTSTKVDSIDDSGDKVKVTISPSKGGESKVIEADRVLQAVGFAPRVEGYGLEKTGVKLTERGAIEIDDFMRTNVDGIYAIGDCTAKLMLAHTAEAQGVVAAETIAGAQTMPINYDMIPRATYCQPQVGSFGYSEDQAREKGYDVKVSKFPFAANGKAWGLGDGTGFVKIVADARHGELLGASLVGHDVSELLPELTLAQLWDITAEEIGRNIHAHPSLSEALKDAAEGVEGHMINF

SEQ ID NO: 41945 - protein, 384 aa, Glycine max
MSDLLRHSLSKFTFSPNGTPTGREKVTVKHKHLRPFQCVLTQDNRSIVVKNGNDSLDICRVVNGMWQTSGGWGRADRDDAVDAMLKYVDAGLATFDMADIYGPAEDLYGIFINRVRRERPAELLEQVRGLTKWVPPPVKMTSSYVRDSINVSRKRMDVESLDMLQFHWWDYSNPGYLDALKHLTDLKEEGKIKTVALTNFDTERLQIILENEVPVVSNQVQHSLVDMRPQQRMAELCQHTGVKLITYGTVMGGLLSEKFLDTNIAIPFAGPAINTPSLQKYKRMVDAWGGWSLFQGLLRTLKQVASKHGVSIATVAVKYILDQPAVAGSMVGVRLGLAEHIQDTNAIFSLVLDEDDVNSIREATAKGKDLLKVIGDCGDEYRRA

SEQ ID NO: 41946 - protein, 730 aa, Coccidioides immitis RS
MDDAGTETPTNPPQLPPPQPSPELGALPRTPLNEHGLSLDRDLEAEIKNGGTHNQGQLPGDSEEPRVQEGPGQEHAGLKDGQAWDQIMVDAVPTTDAIATAAIVTEQAQTEPAHAAIVVDPEISTPEAQNHGSSIGQSSIQRQPRQSQTSVAPDSNSVLAVTAPQYTFLESRQAATPQHLGQPPPIPPPSPNYGLPAHPEFIQPRSNHGHPMSLPPCPPSGAPPIQQQQQPTLQNIICHFPSPIQSSPAAPGLSNDGASHFKNMKLIPEPPDLQRWRERLFNVEGTIVLSEEEFQTYFPHVDNVYSHRSTQRYKRKPFISHYWDCRLKGRPPGTPKSADPNKKKRKRIARERNLCDVKIKITEYFPGAMTMAPDLDMGISALAGAVDSLPATSGVNAPTASQPFGVLAPSTMLPEGHPGATGARYYTIQRVNGNGANGRSVTAGGSHRHTLEESDRIKKNSVQRFLIKDEKEKKKAILKTYHKKASGYAWLTVNKHKRESDLKLYASCFCPFVQRVWIALEVKGIPYQYIEVDPYRKPDSLLEVNPRGLVPAIRHGNWACHESTVLLEYLDDLDAGNPLLPPGKPQLRAHCRLWADHVNRHIIPCFYRLLQEQDFQKQIEYTEELKDDISKLVNASHVTGPFFLGPDISFVDIQFAPWMLRLSRVLKPYRGWPDPEKGSRWAAWVDAIEANDQIMATTSSDELYLDSYQRYAGTYFKFPLHQGGGPRSDV

SEQ ID NO: 41947 - protein, 395 aa, Salinibacter ruber DSM 13855
MTTAETIDIEQQLEIPTYDKMPMALVRGEGPYVWDAEGTRYLDFYGGHCVSLLGHCHPNVVAAVQAQAEQLIFYSNVAHSPVRARAARRLADLAPDGLGNVFFANSGSEANETALKLARTYTGRSGVVAMEQGWHGRTLGSLATTHDETYRAPYTDVLPETTWVPVGDLDAAEAVLSSEEIAAVLLEPIQSIAGMRAMPADYVQGLRALCDATGTLLIFDEVQTGVGRTGTFSMSAPLGATPDLIALAKSLGAGVPVSAVLVDDAVAAAVDPGDQGSTFGGGMLAMAAVEATLRTLVEDDLMGRATDIHTQVAEAVGPVVEEVRGRGCLMGLKLNRPAEPVIDALRDQNVLVGGSSDPYVMRLMPPLVVSDDDVTAFAEALHAALDATSAPARAH

SEQ ID NO: 41948 - protein, 638 aa, Parvularcula bermudensis HTCC2503
MPVDTPLLDKVTLPQDLRALERSQLTQFADELRAEVIDAVSVTGGHLGAGLGVVELTTALHYVFDTPTDKIIWDVGHQCYPHKILTGRRDRIRTLRQKDGLSGFTKRTESEYDPFGAAHAATSISAALGMAVARDLRGDVNRVVAVIGDGSMSAGMAYEAMNNAGDRGKQLTVILNDNDMSIAPPVGAMSAYLARVASSDKYHAFRNLAKQLAKRLPKGLYTSAEKFEEYGRAFVTGGTMFEELGFYYVGPIDGHNLDHLVPVLENVRELTDAPVMVHVVTQKGKGYAPAESAADKYHGVAKFDVVSGKQHKPKPAAPSYTSVFAGQLIKEAERDERVVGITAAMPSGTGIDKFMERFPDRTFDVGIAEQHAVTFAAGLAAEGMVPFAAIYSTFLQRAYDSVVHDVALQNLPVRFALDRAGLVGADGATHAGAFDIAYLGCLPNMVLMAAGDEAELVHMTHTAAAFDEHPIAFRFPRGEGQGLELPLTPQLLEIGRGRILREGAKVALIAYGGRLAECLKAADLLGMRGLSTTVVDARFAKPLDEDLIARVAADHEVVLTVEEGSMGGFGAAVLHFLARIGQLDKGLKIRTLTLPDTYQDQAKPADMYAEAKLQAENIADAAIVFFQGVALATADGGV

SEQ ID NO: 41949 - protein, 243 aa, Microcystis aeruginosa PCC 7806
MPKPFSIALLSQTRSSFRLLKRSGVRECLAECLGTFILIFVGTGAIMVNQISDGAITHLGISMVFGGVVAALIYALGHISKAHFNPAVTLAFWTSGFFPKSWVIPYIIAQCLGAILASATLVLCLGRVGNLGATLPLQGNWGQAFCIETIITFILMLVILGSGLDRRAPIGFAGIAIGLTVALEATFMGQITGASMNPARSLGPAFVAGIWQHHWVYWIAPILGAQLAVIIYGLLSNGFRDFK

SEQ ID NO: 41950 - protein, 269 aa, Glycine max
MAAEANFDSKSSRWSLQGMTALVTGGSKGIGYAIVEELAQLGATVHTCARNEAELNKSLNEWNTKGYRVTGSVRDVASRAERQDLIARVSNEFNGKLNILVNNVGTNIQKETLDFTEEDFTFLVNTNLESCFHLSQLAHPLLKASEAANIILISSIAGVVASNIVSVVYGATKGAMNQMTKHLACEWAKDNIRTNCVAPGPIRTPLGDKHFKEEKLNNSLIARTPLGRIGEAEEVSSLVAFLCLPAASYITGQTICVDGGFTVNGLYIS

SEQ ID NO: 41951 - protein, 246 aa, Ashbya gossypii ATCC 10895
MFKTEIYSPEGLRLDGRRWNELRRFECSINTHPTAADGSSYLEQGNNKLITLVTGPHEPALRSQVNPSKATLTVTVNMTKFAAAERSKTGHKNERRILEMQTALVRTFEKNVMLQLYPRTAIDVQVHVLQNDGGVLGSMINGITLALIDAGIAMYEYISGISVGLYDTTPLLDLNRLEEQAMSCFTLGVVGKSEKLSLLLVEDKVPLDRLESVMSLGIAGTHRVRDMMDKVLRQHGKIRLENSVAN

SEQ ID NO: 41952 - protein, 276 aa, Bacillus clausii KSM-K16
MNVGFIGTGSMGSLLIESFIDAGALKQTNISIINRSPEKAAALKATYPGITVSTSLEEIASTCEWLFLCVKPKEMPALFHALQPHVAADQIAISITSPISVESLDAALPCKTCRIIPSILNRALSGSTLVTFGNKCTQEDQANLLRFVSAVSEPLQIEEEITRVASDIVSCGPAFFSFLAQRFIDGAVSETSISQEEATELTTSMIIGLGKLLESGHYTLPALQKRVCVPGGITGEGLAVLDDELGDGFGSLFKRTHEKYATEKEKLLAEVLYEPK

SEQ ID NO: 41953 - protein, 138 aa, Oryza sativa
MAATALSSQVRLPMSLRVATAPAPARVVLPASNKLGDRLRMQATYNVKLITPDGEVELQVPDDVYILDQAEEEGIDLPYSCRAGSCSSCAGKVVSGEIDQSDQSFLDDDQVAAGWVLTCHAYPKSDVVIETHKEDDLI

SEQ ID NO: 41954 - protein, 556 aa, Ashbya gossypii ATCC 10895
MRISRSSSSRVPPSKTQRTHREEQTMYQVEAERLVSAAEERGTAALAHGGSSDRMWQRARGVARVLGKYVRFVGPGLLVSVAYMDPGNFSTAVAAGSAHRYQLLFSVLVSTVLAAFWQCLCAKLGAVTGLDLAQNCRAHFPHNVNVVLYALAEMAIIATDLAEVVGTAISLNILFGIPLPLGVVLTVVDVLVVLMAYKPNGSLRVVRWFEMFVSLLVILTVVCFTVEVFSVDVGSPQEVLRGFLPSRTVFEGDGLYLSLAILGATVMPHSLYLGSGVVQPRLRDFDIRKGYYVPSDHDRENNHPNYKPSLEAIDDAMHYTVAELLVSLFTVALFVNCSILVVAGATLHGRLSDEDTGDLFSIYNLLCSTLSKAAGTIFVLALLFSGQSAGIVCTLSGQMVSEGFLSWTIAPSVRRTLTRAVAITPCLILVLVAGRTGLSAALNASQVVLSLLLPFVSAPLLYFTGNKQIMRVPLDNTCYHVLPDDEIPLTTLRPNSAESDRSALPPLASSASPAPGFRDMSNSTLTNVLAWLLWVFVSALNFYLLISFTSGKDIHI

SEQ ID NO: 41955 - protein, 281 aa, uncultured archaeon GZfos14B8
MPDRNSIIEKREAEKEKDKVVVLDFGGQYSHLIVRRCRELGVYTELLPYDMPLEELKRGIEGNIKGIILSGSPFSVHEPNSPKCSSEIVDLNIPILGICYGAQLIAYVNGGVVGEGRKSEFGRTELFFEDSDLFDGLTERGSEGGRINVWMSHGDVIERFDGADIIGYTMNSPVAAFRISNIYGVQFHPEVHHTDKGEKILWNFLYKICGCERNWTIESFVIDKIEEIRSAVGNDGRVICGLSGGIDSSTTALLINKAIGDRLTCIFVDMDYCEKKKKKRL

SEQ ID NO: 41956 - protein, 243 aa, uncultured archaeon GZfos14B8
MRMVFVDAKERFLERLRGVKDAEAKRKVIGELFINIFEEEASKLGNVDFLAQGTIYPDRIESAGASSRNASRIKSHHNVGALPEKLGLKLIEPIKDLYKDEVREVAKELGMPPQILNQHPFPGPGLAARIIGEVTEDKLRICREASHVVEEELKRSGWYNKVWQAFAVVGDDVATGVLGDARSLGRIVTIRVVESREAMTADFVKLPYEVLESMSKRITNEVKGVTWVTYAISSKPPATIEPC

SEQ ID NO: 41957 - protein, 262 aa, Mesorhizobium sp. BNC1
MKPPYEGRVAVVTGGSSGIGLATVQLLLEQGAKVALCARGEARLKDVVSALGRDHGPDRLLSRAFSVLDSDAVHAFAAEVEAAFGRCDLLVNNAGQGRISTFENTSDDDWRAEYELKLFSQIYPIRAFLPMLKRAKGAVVAVNSLLAYQPEAHMVCTSSARAGVQNLLKSLSLELAPDVRVNSLLLGLVDSGQWARRFAEREDQSMSREEWYGNLARGKGIPLGRLGDPSEAAAAIAFLGSHAASYITGAQLDVSGGLARHI

SEQ ID NO: 41958 - protein, 361 aa, uncultured archaeon GZfos14B8
MKAILALEDGTVVEGEGWGAEGTALGELVFATPFTGYEEALTDPSYKGQILMPTYPLIGNYGVSGAKFQSEGIKVEGFVVREKCDFPSHYKIKRSIDQFLREEGVPGICEIDTRMLTIKTRQYGMMKACLKVVEDCSEDENANALELAKTQPDISELDLIEQVTCEKHYRIKGKGRRIAVLDLGVKRNILKNLAKRDLDIFVFPANAEESEIRDSEPDALLLSNGPGDPKRGKNAMSVVKNFAGEIPIFGICLGLQIIALALGCDTYKLKFGHRGANQPVKDIKSGRVYITAQNHGFAVDKDSMDGIAELTQINANDDTVEGFEDHYLGIKCVQYHPEASPGPWDTEKMFFENFFASKNLY

SEQ ID NO: 41959 - protein, 171 aa, Escherichia coli
IGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSAE

SEQ ID NO: 41960 - protein, 194 aa, Oryza punctata
VLYARVRTNGVVQIQFSPVGENKRGGEVYRLYDVGGQRNERRKWIHLFEGVNAVIFCAAISEYDQMLFEDETKNRMMETKELFDWVLKQRCFEKTSFMLFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 41961 - protein, 304 aa, Escherichia coli K12
MRLPIFLDTDPGIDDAVAIAAAIFAPELDLQLMTTVAGNVSVEKTTRNALQLLHFWNAEIPLAQGAAVPLVRAPRDAASVHGESGMAGYDFVEHNRKPLGIPAFLAIRDALMRAPEPVTLVAIGPLTNIALLLSQCPECKPYIRRLVIMGGSAGRGNCTPNAEFNIAADPEAAACVFRSGIEIVMCGLDVTNQAILTPDYLSTLPQLNRTGKMLHALFSHYRSGSMQSGLRMHDLCAIAWLVRPDLFTLKPCFVAVETQGEFTSGTTVVDIDGCLGKPANVQVALDLDVKGFQQWVAEVLALAS

SEQ ID NO: 41962 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSSFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 41963 - protein, 303 aa, Oryza sativa Japonica Group
IDMSRLINPEFSEEEIAKLGSACEDWGFFQLVNHGVDGELLQRIKDDITEFFRLPLQEKMSVAIPPNGLQGFGHHFVFSKEQKLDWVDLLFLTTRPVEDRTTEFWPTKPPTFRDSLDKYSLEIANVSAKLFKFMAINLGVDEEALLAAFKPEQPQSVRINHYPPCSQANKVLGLSPHTDGVGMTLLLQVNDVQGLQIRKDGRWFAVKNLPGALVVNVGDVLEILTNGKYKSIEHRAVINPDKERITLAAFQSVPLSSTVGPLQELLMKGEARYKTVDGAEFTKGYFAAKLEGRRYLESLKLGV

SEQ ID NO: 41964 - protein, 331 aa, Synechococcus elongatus PCC 7942
MDASLLLRQITTGYWGSQALYVAAKLGIADQLVNGPRSCEDLAIVVGAKPEVLYRLLRALASLGIFTEVSDRQFALTPAAELLRSGTAGSLRNLVMMFGEEHYVAWGELLHSIQTGENAFEHHYGAPVFAYYAQHPASADIFNGAMSDMSRPDTAAVLSSYDFQGIRCLVDVGGGHGQLLSQILAAYPDLTGILYDQPAVVAGADSVLADVSDRCEVVGGDFFASVPAGGDAYLLKHIIHDWDDADSLKILANCRQVMQPGDRLLLLEQVVRAGNEPNLAKWLDLNMLVMTQGGRERTQAEFATLLADAGFQLSQIHGTASEVCIIEGRAI

SEQ ID NO: 41965 - protein, 484 aa, Propionibacterium acnes KPA171202
MTATTITPETKDEVVGVGRVVRVIGPVVDVEFPAGQLPEILNALHVDAEVMGETHAITLEVALHIGENVVRAISLKPTDGMRRGTEVRDTGAPISVPVGDVTKGHVWNVTGDVLNADPSTIEVTERWPIHRDPPAFDDLEPETEMLETGIKVLDLLTPYVKGGKIGLFGGAGVGKTVLIQEMIYRIAHNFGGTSVFAGVGERTREGNDLINEMDEAGVLKDTALVFGQMDEPPGTRLRIALTGLTMAEYFRDVQNQDVLLFIDNIFRFSQAGSEVSTLLGRMPSAVGYQPNLADEMGQLQERITSTRGHSITSMQAVYVPADDYTDPAPATTFAHLDATTELSREIASRGLYPAVDPLTSTSRILDPLYVGQEHYDTATQVKQILQRNKELQDIIAILGVDELSEEDKVTVARARRIQQFLSQNTYTAEKFTGVAGSTVPIADTVEGFQMICRGDVDHIPEQAFFNVGSMDMVMENWDKMKKEG

SEQ ID NO: 41966 - protein, 229 aa, Salinibacter ruber DSM 13855
MGAADTSASPLSVTYHTNRKRDRPTTCRGVPFPARVSAPYVHLDRRACLRSPSLLHSCVTAFLLPMDDEPAIPNSSVEDVLEAKGALHDPTTVLTAAPQDSVYDCIDRMAEIGVGSIVVTADGAIAGIFTERDHMRKMALEGRAPRDTAVQTVMTEDVATVTPAQSLEDALDRMRDLQCRHLPVVDADGQLSGIISMRDCMRQLSEAAKSKALQLIEYMEEEYVVRQYG

SEQ ID NO: 41967 - protein, 1035 aa, Oryza sativa Japonica Group
MATFCKVRKRDDGIYVLTLASSDGHHYLTTEAITQLKQALERIRSTKARGLVTTTTSGSFCDGINAVSDDDDDEPLSSLERGMAEVVRLLLDLPMPTAAAVRGDARWLGFVLALAHDHLFVHTEAVLGLAAAADTTAKPRRRPLPDYVVALLREKIPYAQLRKLLLLKAHVFTGEELKGNWHSVHEAIPNRDHVVAVAVQNLQSVVVGDGMDYAKVRRTMYTNSCVAVAVTTTTTTMLPFDGSSSVANGVTISSEMTPSGESFNSSYNSSTTPVDISLAAIEACTDGFSESKKVGSGAYGKVYKGVYNEEELAFKKIDGLAVLNEDQFKNELKHLMSVQHRNIVRFVGYCSQIKEKFIWRGKEYVSVQYITRILCFEYLPGGSLDKHLDKESESDGFDWRTRYNIIKVISQGLNYLHELEKPIFHLDLKPANVLLDENMEPKIADFGISKHFTGTKTHITISKPTGTPRYMPPEYLNKLVISNKYDVFSFGVMVMEIIAGPTGYDNFSEANDQDSFKYIDRSHGRISLSPQSKAFKVSGTRGSLQKTAARVVSRCQPKCIVNITKDFDDRKKELIAEIGFDGILDIKLTKVNRQFGAWLLSKVDPKSGTIVTDFNQELPFGPNDVNAVFGLPCSAIVQAKYLSKLVIQKVGITSVKSCHISQFEDNQIAMMIQQDIVSKHNPGYTFPRYGKLQLMKAPRENYPQAPEVSPLNLSSVSKIQCRGNDGGANLIKFLESHFNSLDVSAMVGPQAYKELKSYVQDGFNRIDEILPSIADFVDISNLKTATEAANMFKKAFKYNMAAAVKIATRAAVRNVIDTIEDMQGPLHPWGDPSAMGYHTPTNYSTHATEYENIVEQPTDTRHCDHKFGASQCTPTKFNGAPGIVRMYAVAGDEFWEASHQLAHFTGPEVVYDVSDSHMSKKVLVLDSLNTQDPLGNHVSPGMTRLRSWCPGWNKDILNWDYEAVENIPEQQNGDDCSFHVFNNMVNWDGLRLVNSTSQDPYYLRRQFLIHLLALRDNEAILPEYVVHRLRHIKYN

SEQ ID NO: 41968 - protein, 207 aa, Brassica napus
  misc_feature (192)..(192): Xaa can be any naturally occurring amino acid
MMYRVQKTVVSAFIFSLSILPLLVSATDEENECGGSNGGGSATEKASILKYKIGAFFSILVAGVLGVCLPIFGLKSESNFFMFVKAFAAGVILATGFVHILPDATESLTSPCLGEESPWGDFPMTDLVAMAAAILTMLIESFASGYLNRSRSENEAKTLPVSTCGDKEEHSHIGSAHTHASQGHAHGSLLVXPQDDMRKKELVTQIL

SEQ ID NO: 41969 - protein, 541 aa, Vitis vinifera
MAATQQGPDRLIPTGFDNVTGKWNEYSSYVNAEGLEIRSSGMYNENPSVVFDGNGYNPQMPYGPYPETTQLASARGDGKLHAAQQFSISDPLSCQQPIAPNIPYVTSSTPVSQTELPSEIGKQGDCKPFGLNLGYPPSLGSFGSRSNFSENSDGLGFMSDGSDVFGFGSLWSDCSIPLKERSKLSSPAASQQPVGSLSMSKTDFGMASQQHGSLSRFGSQSSLNYRGYSSSGINQSSSFRNTSISTTSAMNGWNWLPYDKAKSGGNSDTSFGCTGTIDTLIEQNRGPRASKPKNRTTANASFVNNSKNGTCTGVHRESYNRLDFVTEYKDAKFFVIKSYSEDNVHKSIKYGVWVNASAQFCGVAEMVGPVDYDKSVDYWKQDKWTGQFPVKWHIIKDVPNSQFRHIILENNDNKPVTNSRDTQEVELEQGNEMLNIFRNYESDSSILDDFDFYEDRQKAIEEKKTQHKASLLAAPMVVGSQQQIRRSLPTHLIHKMSKTFAQAVLLNENDKERSPAGKAVPGAARLRGSRVEPEKTRATMA

SEQ ID NO: 41970 - protein, 418 aa, Solibacter usitatus Ellin6076
MRIRVLGIVLAGGKGTRLSPLTRERAKPAVPFGGKYRIIDFVLSNFINSGIYSIYVLTQFRSQSLLQHLAEGWQFGSLLKNQFVIPVPAQMRSEDETWYQGTADAIYQNINLVEQADPHVVAIFGGDHIYRMNIASMIEYHVAKAAEVTIAAIPMPKKHADEFGVIEAADDDRILGFHEKNPDAPTMPGDPDQVYASMGNYIFSTRTLLSLLEEDSKLPHSHHDFGKDILPRLAGKGRMYAYNFETNRIPGEPADASPYWRDVGTIEAYYEANMDLRYVSPALNLYNREWPLRSTSYSDPPAKFTFDDANRRGQAIDSIVSGGCILSGGVVRNSVLGRGVRVHAGAMVEDSVILDNCDIGRRAKIRRAILDKNVRVAEDAMIGYDLEVDRAKGYHVTETGIVVVGGERSQVDITGLVV

SEQ ID NO: 41971 - protein, 724 aa, Oryza sativa
MATVPTPSEAHGGATPTAADVEMVEASELRRRGKPSGDRATGPSRDGAAAAAEEAAAPSVERVFADRPVPSWREQLTVRAFVVSFFLVIMFSVIVMKLNLTTGIIPSLNVSAGLLGFFFVRLWTAAIERVGLLRQPFTRQENTVIQTCVVAGYDIAFSGGFGNYILSMSERIAGLGTEANNAQNIKNPHLGWIIGFLFLVSFIGLFGLVPLRKVMIIDYKLTYPSGTATAFLINGFHTPHGAKIAAKQVKKLGIFFILSFFWGFFQWFYTATDDCGFHKFPSLGLQAFQHKFFFDFSPTYVGVGMICPHIVNVSVLLGGILSWGIMWPLIAKKRGDWFSADLPDGSLHGMQGYRVFIAIALILGDGLYNFLKMIILTAFSLRYQIKKKNASTLPVSDDGMVTTTAAVSYDEERRNELFVKDQIPWYVAYGGYAVVAAISIGTVPQIIPQLKWYQILVAYIVAPILAFCNAYGTGLTDWSLVTTYGKLAIFAFGAWTGASHGGVLAGLAACGVMMNIVSTAADLMQDFKTGYLTLASPRSMFVSQVIGTAMGCVIAPCVFWLFYKAFDNIGISGSDYPAPNAAVFRSIAILGVDGFSSLPKNCLNLCYAFFAAAIVVNLIRDLVPKVSRFIPIPMAMAIPFYIGSYFAIDMFIGTVILFVWQRVDRAKADTYGPAVASGMICGDGIWVLPQSVLALAKVKPPICMKFLSRRTNDKVDAFLTTLGK

SEQ ID NO: 41972 - protein, 572 aa, Oryza sativa Japonica Group
MPDWRVGEFEGKLKDGFARSNNSEHENGAGTVSISSKKSKHRVDSEKKPHVDISGVIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKPEDVYGEQAYQRDAMELLSSDQICTGQENLDMIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDAKSCRNN

SEQ ID NO: 41973 - protein, 275 aa, Parvularcula bermudensis HTCC2503
MTADEHNGTPRALTPAPSYDLTGKVCFMAGGTSGINQRIAERFATAGAKVFVMSRKPEKVEATVALLREAGAESDGQAADVRDYQAIEAAVEACADRWGPLDMVLAGQAGNFPAGAAQMSANAFKSVIDIDLLGTFNVFRAAIHRCRRPGAVFLTISAPQATRPYPYQSHVCAAKAGVNMLVKCLAMEWGPVGVRVNGISPGPIDGTEGMDRLAPNEKMRETYRKQLALRTFGDRDDIADAALWLCSGGADYVTGTILEVEGGTTLGDASSVLTF

SEQ ID NO: 41974 - protein, 427 aa, Shewanella sp. ANA-3
MELYNLKHPSQKVSFKEAVQLGLGKDRGLFFPTQIPVLHDIEALLAMPFVERSKKVLGAWLASELGQDAVDKLVERAFNFDLPLVAVDEQRSCLELFHGPTLAFKDFGARFMAQCINAFAQDSRLTILTATSGDTGAAVADAFYGLDKVNVVVLYPKGKISELQEKMFTTLGKNIHTVAVASDFDACQHLVKQAFEDSDVRDGLHLNSANSINISRLLAQICYYFEAVAQSKQRHEADPVIAVPSGNFGNLTAGLFAKAMGLPVKRFIAATNANDTVPRYLESGDWQPNPTQATMSNAMDVSEPSNWPRVEAICEKLGWPLADLVGIRLSEAQTSEALAELHAKGYVSEPHAAIAARALTLNLVPDEVGIFLGTAHPAKFKDVVDRELNLDLPLPAELKAVEHKPILSAELAADFAQLKSHLFAVLS

SEQ ID NO: 41975 - protein, 499 aa, Mesorhizobium sp. BNC1
MNRFELPSSKLYIGGRWEEGSGAEIVSIFSGDGSVNRVIKGASRADGERAIERALKAQSDPAWRNLKPHERARFLHRIADGIETNAARIAFIQTRDTGKTLRETTALVASAAGTFRYFAGALESLDDTLTAPRGDYLSMSVHEPLGLVSAITPWNSPIASDAQKVAPALAAGNAVLLKPASWSPLVSLELARIVEAAGLPQGLFSVLPGAGREIGNLLVEHPAISRVSFTGGTATGRMLARQAAEKLMPISLELGGKSPTIVFADADIDLAIAGILFGVFSSSGQSCIAGSRLFVERSIYESFVDRLVAATKKLVVGDPFDERTQVAPLVHFDHRDAVAAQVAAAVEAGAEVLCGAAIPTGADYDRGAYYLPTILAGLENDDPICREEVFGPVLCVLPFDDEADVIAQSNANDYGLACGIWTRDFPKAWRTARAITTGTVWINTYKQFSISTPFGGEKDSGMDREKGREGIRAYMAQKSVYVDLTGKPHPWARWPEAGA

SEQ ID NO: 41976 - protein, 313 aa, Avena sativa
VVVITGASSGLGLAAAKALAETGKWHVVMACRDFLKASKAAKAAGMADGSYTVMHLDLASLDSVRQFVDAFRRAEMPLDVLVCNAAIYRPTARKPTFTAEGVEMSVGVNHLGHFLLARLLLEDLQKSDYPSRRLVIVGSITGNDNTLAGNVPPKANLGDLRGLAGGLTGASGSAMIDGDESFDGAKAYKDSKVCNMLTMQEFHRRYHEDTGITFSSLYPGCIATTGLFREHIPLFRTLFPPFQKFVTKGFVSEAESGKRLAQVVGEPSLTKSGVYWSWNKDSASFENQLSQEASDPEKARKVWELSEKLVGLA

SEQ ID NO: 41977 - protein, 1067 aa, Gossypium hirsutum
MESEGDIGGKPMKNLGGQTCQICGDNVGKNTDGDPFIACNICAFPVCRPCYEYERKDGNQSCPQCKTRYKWQKGSPAILGDRETGGDADDGASDFIYSENQEQKQKLAERMQGWNAKYGRGEDVGAPTYDKEISHNHIPLLTSGQEVSGELSAASPERLSMASPGVAGGKSSIRVVDPVREFGSSGLGNVAWKERVDGWKMKQEKNTVPMSTCQATSERGLGDIDASTDVLVDDSQLNDEARQPLSRKVSVSSSKINPYRMVIILRLVILCIFLHYRITNPVPNAYALWLISVICEIWFAISWILDQFPKWLPVNRETYLDRLALRYDREGEPSELAAVDIFVSTVDPLKEPPLVTANTVLSILAVDYPVDKVSCYVSDDGAAMLTFEALSETSEFARKWVPFCKKYNIEPRAPEWYFAQKIDYLKDKVQTSFVKDRRAMKREYEEFKVRINGLVAKAQKVPEEGWIMQDGTPWPGNNTRDHPGMIQVFLGQSGGLDAEGNELPRLVYVSREKRPGFQHHKKAGAMNALVRVSAVLTNGAFLLNLDCDHYINNSKALREAMCFLMDPNLGKQVCYVQFPQRFDGIDRNDRYANRNTVFFDINLRGLDGIQGPVYVGTGCVFNRTALYGYEPPLKPKHRKTGILSSLCGGSRKKSSKSSKKGSDKKKSGKHVDSTVPVFNLEDIEEGVEGAGFDDEKSLLMSQMSLEKRFGQSAVFVASTLMENGGVPQSATPETLLKEAIHVISCGYEDKTDWGSEIGWIYGSVTEDILTGFKMHARGWRSIYCMPKRPAFKGSAPINLSDRLNQVLRWALGSVEILFSRHCPIWYGYSGRLKWLERFAYVNTTIYPVTAIPLLMYCTLPAVCLLTNKFIIPQISNLASIWFISLFLSIFATGILKMKWNGVGIDQWWRNEQFWVIGGVSAHLFAVFQGLLKVLAGIDTNFTVTSKASDEDGDFAELYMFKWTTLLIPPTTLLIINLVGVVAGISYVINSGYQSWGPLFGKLFFAFWVIIHLYPFLKGLMGRQNRTPTIVVVWSILLASIFSLLWVRIDPFTTRVTGPDVEQCGINC

SEQ ID NO: 41978 - protein, 266 aa, Ipomoea nil
MMSIREVMESDQWLFRHSVFVLLLIAPPVYIACRFITAPFGKHVRPGWGPTISPPLAWFLMESPAIWLTLLLFPFGRSSSNPLAQILMAPYLLHYAHRTIVYPLRLYLNSDPRRAAAGFPVSVALMAFTFNILNAYLQTRWVSHYADYEGGGLFWWRFACGMAVFLAGMAVNVWADKVLLRLKSEGGGYKIPRGGLYEYVSCPNYFGEILEWLGWFLMTWSAAGFAFFLFTCANLMPRAWSHRQWYLEKFGEDYPRKRKAVIPFLY

SEQ ID NO: 41979 - protein, 388 aa, Hordeum vulgare
MALQLLPSTLSVPKKGSSMGAVAVKDTAAFLGVSSKAKKASLAVRTQVATAPSPVTTSPGSTASSPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPVLTKSGVYWSWNKDSASFENQLSQEASDPEKARKVWELSEKLVGLA

SEQ ID NO: 41980 - protein, 372 aa, Bacillus clausii KSM-K16
MSKRDYYEVLGVDRNASVEEVKKAYRKLARKYHPDVNKEEDAEAKFKEVKEAYDTLSDPQKKARYDQFGHADPNQGFGGAGASGDFGGFSDIFDMFFGGGGGRRNPNAPRQGDDLQYTMTLEFKEAVFGKETEIEIPREETCGTCHGSGAKPGTKPDTCSHCGGSGQLNVEQNTPFGRVVNRRVCNYCEGTGKIIKQKCATCSGKGKVRKRKKINIQVPAGIDNGQQLRVAGQGEAGANGGPPGDLYVVFQVKPHEFFERDGEDIYCEVPLTFPQVALGDEIEVPTLTGKVKLKIPAGTQTGTSFRLRGKGVPNVHGRGQGDQHVQVRVVTPKNLTENEKELMREFAGMSGGRPEEQNDGFFDKLRRAFKGD

SEQ ID NO: 41981 - protein, 338 aa, Pasteurella multocida
MAILVTGGAGYIGSHTVVELLNANKDVVVLDNLCNSSPKSLERVAQITGKQVKFYQGDILDTALLQKIFAENQIQSVMHFAGLKAVGESVQKPAEYYMNNVTGSLVLIQEMKKAGVWNFVFSSSATVYGDPEIIPITESCKVGGTTNPYGTSKFMVEQILKDIAKATPEFSITILRYFNPVGAHESGLIGEDPNGIPNNLLPYISQVAIGKLPQLSVFGSDYETHDGTGVRDYIHVVDLAIGQLKALDRHEGDAGLHIYNLGTGSGYSVLDMVKAFEKVNDIKIPYKLVDRRPGDIATCYSDPSLAKTELNWTAARGLEQMMKDTWHWQKKNPKGYRD

SEQ ID NO: 41982 - protein, 538 aa, Vitis vinifera
  misc_feature (254)..(254): Xaa can be any naturally occurring amino acid
MAARRISSLLSRSLSVSSAFSLSLGKNFNRGKSIHRFSTAAAAAVEELITPTVQINYTQLLINGQFVDAASGKTFPTFDPRTGEVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGXLNIVSGYGPTAGAALASHMDVDKIAFTGSTDTGKIVQELASKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIRSGIESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYSLNNYLQVKAVITPLKNPAWL

SEQ ID NO: 41983 - protein, 513 aa, Staphylococcus aureus subsp. aureus MW2
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCECKGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 41984 - protein, 163 aa, Triticum aestivum
IVGKCLGPFFGPGMVKGIPGASYETLGGGANSVADGVSVGAGLGAEIAGTFVLVYTVLSATDPKRTARDSFIPVLVPLPIGFAVFIVHLATIPITGTGINPARSLGAAVMYNQHKAWKDHWIFWVGPLLGATVAALYHRFVLRGEAAKALGSFRSTGAATART

SEQ ID NO: 41985 - protein, 320 aa, Brassica oleracea
MEKNIKFPVVDLSKLIGEERDQTMALINDACENWGFFEIVNHGLPHDLMDNVEKMTKEHYKISMEQKFNDMLKSKGLENLEREVEDVDWESTFYLRHLPQSNLYDIPDMSDEYRTAMKDFGKRLENLAEDLLDLLCENLGLEKGYLKKVFHGTKGPTFGTKVSNYPACPKPEMIKGLRAHTDAGGIILLFQDDKVSGLQLLKDGDWIDVPPLNHSIVINLGDQLEVITNGRYKSVMHRVVTQKEGNRMSIASFYNPGSDAEISPASSLACKETEYPSFVFDDYMKLYAGVKFQPKEPRFEAMKNANAVTELNPTAAVETF

SEQ ID NO: 41986 - protein, 361 aa, Escherichia coli O157:H7 EDL933
MMKTMRIAAIPGDGIGKEVLPEGIRVLQAAAERWGFALSFEQMEWASCEYYSHHGKMMPDDWHEQLSRFDAIYFGAVGWPDTVPDHISLWGSLLKFRREFDQYVNLRPVRLFPGVPCPLAGKQPGDIDFYVVRENTEGEYSSLGGRVNEGTEHEVVIQESVFTRRGVDRILRYAFELAQSRPRKTLTSATKSNGLAISMPYWDERVEAMAENYPEIRWDKQHIDILCARFVMQPERFDVVVASNLFGDILSDLGPACTGTIGIAPSANLNPERTFPSLFEPVHGSAPDIYGKNIANPIATIWAGAMMLDFLGNGDERFQQAHNGILAAIEEVIAHGPKTPDMKGSATTPQVADAICKIILR

SEQ ID NO: 41987 - protein, 712 aa, Oryza sativa
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPFTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFDIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAANAKVDTFLGN

SEQ ID NO: 41988 - protein, 270 aa, Nostoc sp. PCC 7120
MFGILVAIIVIIGLNSFIIINPGQAGVLSILGKARDGALLEGIHLKPPLISAIDVYDLTVQKFEVPAESSTKDLQNLSARFAINFRLDPIQVVDVRRKQGTLENIVSKIIAPQTQEAFKIAAARRTVEEAITKRSELKEDFDNALGDRLDKYGIIVLDTSVVDLTFSPEFARAVEEKQIAEQRAQRAVYVAREAEQEAQAEINRAKGKAEAQRLLAETLKAQGGQLVLQKEAIEAWKTGGAQMPKVLVMGKESPGSVPFIFNLGNTQNLN

SEQ ID NO: 41989 - protein, 380 aa, Oryza sativa Japonica Group
MADDLGPPTVLQKIHGQSMMFSKISPYSLMKNPALYNANTSYSVPLKSYNGMDGNNGFSSVTSVSPVFASAPKEKGLSGFMIDFMMGGVSAAVSKTAAAPIERIKLLIQNQDEMIKSGRLSHPYKGIADCFGRTIKDEGVIALWRGNTANVIRYFPTQALNFAFKDHFKRMFNFKKDKDGYWKWFAGNLASGGAAGACSLFFVYSLDYARTRLANDAKAAKKGGGRQFNGLVDVYRKTLASDGIAGLYRGFNISCVGIIVYRGLYFGMYDSLKPVVLVGNLQDNFLASFLLGWGITIGAGLASYPIDTVRRRMMMTSGEAVKYNSSLDAFKQIVAKEGAKSLFKGAGANILRAVAGAGVLAGYDKLQVVVFGKKYGSGGG

SEQ ID NO: 41990 - protein, 298 aa, Solibacter usitatus Ellin6076
MDLHRMDLRDYLAQQQRLVDSELDRLVPPESAAPETIHRAMRYSLFAGGKRIRPILCIEAARTVSDDCAGVAAAACSLELIHTYSLIHDDLPALDNDDYRRGKLTNHKVFGDAMAILAGDSLLTLAFQVLAQLDAPDARKTRLIAELATASGTVGGMIGGQVADLEGEGKPPDAQLLETIHRAKTGALLRASLRLGAIFAGAAEPQYEALSCYGQHVGLAFQIVDDILDVEESSEALGKTAGKDAAQHKITFPAVYGLEPSREMAARECERAHAVLAPFGERALRLHELADLIVRRKS

SEQ ID NO: 41991 - protein, 203 aa, Arabidopsis thaliana
VSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREI

SEQ ID NO: 41992 - protein, 530 aa, Zea mays
MPFIVAIENVMPLVMSGIGKRTRGTRFSQHNQPAKQLETFSAGVNGSCTWRIASNSLTPSAASWLSGSFSCGQVVSARPFSSSAAWFYAFCNNISHTVPDLPPHQEIGMPSLSPTMTEGNIAKWLKKEGDKVSPGEVLCEVETDKATVEMECMEEGYLAKIIHGDGAKEIKVGEVIAITVEEEGDIEKLKDYKPSSSAEPVAPAEPKAEPEPSQPKAEEKKPTQAPEAKTPKIEEASQSGDRIFASPLARKLAEDNNVPLSSVKGTGPDGRILKADIEDYLASVAKGGLRESFADPGLGYVDIPNAQIRKVTANRLLASKQTIPHYYLTVDARVDKLVQLRGELNPLQDASGGKKISINDLVIKAAALALRKVPQCNSSWMNDFIRQYHNVNINVAVQTEHGLFVPVIRDADKKGLGAIAEEVKQLAQKARDNSLKPADYEGGTFTVSNLGGPFGIKQFCAIINPPQSAILAIGSAEKRVIPGSADGQFEFGSFMSATLSCDHRVIDGAIGAEFLKAFKGYIENPTSMLL

SEQ ID NO: 41993 - protein, 203 aa, Arabidopsis thaliana
VSKWTPLCVASPPERNSASLNPHCSPARVNFRTALAAFRPQFRLFSRNSASRRRLRASSSAESGIFLPHLVASMEDVEETYIMVKPDGIQRGLVGKIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREI

SEQ ID NO: 41994 - protein, 440 aa, Coprinopsis cinerea okayama7#130
MTFILLSAGSNAQGQLGHSENEDAHTFHPCLFHDQPPGSLPNGPSTRVLEIAAGANHTLALLEKDENTKTDLSKRREIWACGDGRRGQLGPQLQDSSRRPRTDIFRKLEFDREGLGEYHPKAIAAGWETSYVVMSSLDPTKDDICFSFGSNDFGDLGTGEAATSTIKRSGSTGTNVQLVSFSHLRVDGKPLSQFGPLRIESLVASQHHVAAILRANETRLVVGWGASRHGQVGLVEAVGPKGKVKPIAIIDRPRIISVDDPHDPLVTLSVGSQHTVVLHASGKVAGFGSNRKGQLNLGGFEKAKNIGCTWNGTFGLVVSDEGNSIYGVGSDTHGQLGRGEGVPGDQGASQPRPADFPESIAGHRPLKLSCGTEHVLSLWTAVGKEETEVWGWGWNEHGNLGLGSTDDIHRPTKIWPREGTVGTVVDIWTGSGTSWILCKK

SEQ ID NO: 41995 - protein, 497 aa, Debaryomyces hansenii CBS767
MSSTVAQKPQLTGKLITTIAVICLGSLQFGYHMAELNSPESIISCQMSKPGKVPYEESLFGSHNFSKCIPLSPENVGLVTSIFSIGGLIGSFYIGSFADKLGRKKTSLIHCSIYFLGSMLNGLSNSYYMLLVGRFIAGLGAGAALVTTPIFINEIAPSDYRGFLGSMNQVSVNIGILFTQLLALVWCDDNNWRLLLIMGAVIALVNFLLIAVYVDESPMWLLNKGFSGRAATVLHKLRGGDYVQSRNEVHRWRNPGESSSVENDTLLDTSDSDINEETTPSRDSSVSLEAYMKSSEYRNSKIVATGILIFQQFCGINSIIFYGVSVLVAIFPKHAIFINCLISVVNVVVTFGAAPLTDKLGRKPLLLTSVSVMGLLTIIMGIGIISSSSIFSIVGTFSYITFFAVGLGPIPFLLVSEVTQPKAKALAQSWGTTMNWLATFIVGFLFPILKNSWIGGGVYFIFTLMCAVSFVFIKYWIPETKGANSYEEVWGLPIRTD

SEQ ID NO: 41996 - protein, 573 aa, Nostoc sp. PCC 7120
MSLTNTINFNNLRGDLFGGLTAAIVSLPLALAFGVASGAGPVAGLYGAVCVGFFAALFGGTPTLISEPTGPMTVVMTAIVSSMTASNPENGLAMAFTVVMLAGLFQIFFGVFKLGKYITLMPYSVISGFMSGIGVILIILQIAPFVGQPSPKGGVLGMVQNLPILMTKINPAETILGVLTLAIIFLMPSKIKRYAPPQLVALVVVTVVSLVFFGNVEIRRIGEIPMGLPQLRLPTFNPSQITTMIIDGAMLGLLGCIDTLLTAVIADSLTRTEHKSDKELIGQGIANFVSGLCGGLPGAGATMGTVVNIQTGARTAVSGITRALILLVVVLWAANITETIPMAVLAGIALKVGIDILDWSFLKRAHKVSLKGTIIMYGVLFLTVFVDLIVAVGVGVFIANILTIERLSELQSQDVKTISDTDDAIVLSDEEKGLLDQANGRILLFYLSGPMIFGVSKAIAREHTAMADSDVLIVDLSDVPMLGITASLAIENAIKDASEQGRQVLIVGAAGKVKRRLEKFGIMRFVPAHYMFVDRVEALKQGVAIVKSNGTGATGVNALTNQGNDPDSYAYPN

SEQ ID NO: 41997 - protein, 437 aa, Yersinia pestis KIM
MAYQQERIMSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLAVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 41998 - protein, 305 aa, Ralstonia metallidurans CH34
MAWRLPYTCRVADFWKAAPMPTFAYRIVNVFAESTFGGNPLCVFEDARGLDDATMQALALQFNLSETTFVLPSDNANAAVRIFTPGYEMRFAGHPTLGTAHVVRDLMKTGDALSLEFKAGVVPVTAKGDRWTLTAPHTGAPKTAPAGLPDAEMASLLGLTMDDLAGSPMWVDTGADQLLVPVKTPDAVRRAQPDSSRLDRWPQSSLGRKTAYVFAFDPEQPGKALVRYFFTKQGGGVAEDPGTGSACANLGGWLVATGHQLPASYEVDQGEFVDRRCRLDLNVTTEGAIRVGGRVIELGRGTVTL

SEQ ID NO: 41999 - protein, 293 aa, Triticum aestivum
  misc_feature (240)..(240): Xaa can be any naturally occurring amino acid
  misc_feature (247)..(247): Xaa can be any naturally occurring amino acid
  misc_feature (265)..(265): Xaa can be any naturally occurring amino acid
MAAGEGKLSTEANVNSDTTMSSKDYLDPPPTPLLDAGELGKWSLYRATIAEFTATLLFVYVAVATVIGHKRQTDAEACSGAGVLGIAWAFGGMIAVLVYCTAGISGGHINPAVTFGLLLARKVSLPRAFLYMAAQCLGAICGAAMVRAVHGAHHYALYGGGANEVARGYSKAGALLAEAAGTFVLVYTVFSATDPKRMARDSHVPVLAPLLIGFAVLMAHLATIPVTGTGINPARSLGAXAVVYNGXRAWADQWIFWVGALAGGXVAMGYHQYVFRNWAGKHSFGSNNHEVQA

SEQ ID NO: 42000 - protein, 541 aa, Ralstonia metallidurans CH34
MQNFNWTNPYPTVRIPLFARNVVSTSHPLAAQAGLRMLLKGGNAVDAAIAAAAAITLVEPVSCGLGSDAFAILWDGKQLHGLNSSGVAPAAWNPDYFKNKYGADGNGLANRPIRGWDSVTVPGVIAGWAALHERFGKLPFEDLMEPAIEIAERGYAVPPVVAHKWAAAVPDLKSQPGFADTFMPNGRAPAVGEKFLFKDAADTLRKIGATGGRAYYEGEIAEKIAAFSKACGGAMTLDDLRNYRPEWVTPISKSYRGYEVHEIPPNGQGIAALMALGILDQFDVGSLPVDSVDSQHLQIEAMKLAFADLYRYVADPRSMEVTPEQMLDEAYLKSRAKLIDMQRATHFNFGMPRTGGTIYLTAADENGMMISFIQSNYMGFGSGVVVPGTGISLQNRGVGFSMDPKSANVVEGGKRPFHTIIPAFLTKQGKPVMSFGVMGGDMQPQGHLQTVVRMLDYNQQPQAACCAPRWKVNRDFTLDVEGTMDPNTVAGLKERGHKLKSVEDPYMDFGSGQFIWRLSDDAEQGYVAASDSRRDGQAVGF

SEQ ID NO: 42001 - protein, 335 aa, Debaryomyces hansenii CBS767
MAITIGINGFGRIGRLVLRIALQRSDIKVVAVNDPFIAPEYAAYMFKYDSTHGRYKGEVTSKDDSLVIDGQSIKVFGEKDPASIPWGKAGVDYVIESTGVFTTTEGAQKHIDGGAKKVIITAPSSDAPMFVVGVNEQKYTPDLKIVSNASCTTNCLAPLAKVINDKFGIEEGLMTTVHSITATQKTVDGPSHKDWRGGRTASGNIIPSSTGAAKAVGKVIPELNGKLTGMSLRVPTVDVSVVDLTVRLKKSATYEEISEAIKAASNGELKGILGYTEDAVVSTDFLGSDYSSIFDQKAGILLSPTFVKLISWYDNEFGYSTRVVDLLEHVAKASN

SEQ ID NO: 42002 - protein, 359 aa, Triticum aestivum
  misc_feature (140)..(140): Xaa can be any naturally occurring amino acid
  misc_feature (235)..(235): Xaa can be any naturally occurring amino acid
EFGRGRRDARRPLAATPAHRCCPRPLPCLRSSPIPFRCRAGEREREAAMARHFLLNTGAKIPSVGLGTWQADPGVVGAAVYAAVKAGYRHIDCARVYGNEKEIGLALKKLFEEGVVKREDLFITSKLWNDHHAPEDVPEXALNESLNDLQLDYLDLYLIHWPFRVKKGTNNNPENFVTPDIPATWGAMEKLHDAGKARAIGVSNFSSKKLGDLLAVARVPPAVDQVECHPCWQQXRLHNFCQSAGVHLTAYSPLGSPGTTWMNGNILKEPIIISITEKLGKTIGQVALLWNIQMGHSVLPKSTNQERIKKNIDVYDWTIQDDVLAKFSEIQQARLLRGDFMINPQSVYKTHEEFWDGEI

SEQ ID NO: 42003 - protein, 322 aa, Escherichia coli CFT073
MSQRNTQQGATMALPILLDCDPGHDDAIAIVLALASPELDVKAITSSAGNQTPEKTLRNVLRMLTLLNRTDIPVASGAVKPLMRNLIIADNVHGESGLDGPALPEPTFAPQNCTAVELMAKTLRESEEPVTIVSTGPQTNVALLLNSHPELHSKIARIVIMGGAMGLGNWTPAAEFNIYVDPEAAEIVFQSGIPVVMAGLDVTHKAQIHVEDTERFRAIGNPVSTIVAELLDFFLEYHKDEKWGFVGAPLHDPCTIAWLLKPELFTTVERWVGVETQGKYTQGMTVVDYYYLTGNKPNATVMVDVDRQGFVDLLADRLKFYA

SEQ ID NO: 42004 - protein, 77 aa, Candidatus Kuenenia stuttgartiensis
MTSVGEKVREIITKQMGVKAEQITHETSFVNDLGADSLDTVELIMEFEDAFDMNIPDEDAEKIRTVGDAVKYIEEHK

SEQ ID NO: 42005 - protein, 326 aa, Trichodesmium erythraeum IMS101
MDIKPGFIGTVGNTPLIRLNSFSEETGCEILGKAEFLNPGGSVKDRAALYIIKDAEEKGLLKPGGTVVEGTAGNTGIGLAHICNAKGYKCLIVIPETQSVEKMDALRTLGAEVKPVPAVPYKNPNNYVKMSGKLASTIENAIWANQFDNLANRIAHYETTGPEIWEQTDGKVDAWVAATGTGGTFAGVSLFLKEKNPQIKTVLADPMGSGLYSYVKTGEISSEGNSITEGIGNSRITKNMENVMIDDAIRVDDKEAVRVVYQLLRKDGLFMGGSVGINVGAAVALAKQMGPGHTIVTVLCDSGTRYQSKLFNREWLATKNLLPDER

SEQ ID NO: 42006 - protein, 306 aa, Mesorhizobium sp. BNC1
MILCCGEALIDMLPRETADGEAAFVPHVGGSVFNTAIALGRLEVPVSFFSGLSEDLFGVRLQDTLRASGVDLSHAIISTRPTTLAFVSLNEGQASYHFYDENTAGRMLFEADLPDLDESVEAMLFGGISLAPEPCGGTFEALMTRESPTRVTMLDPNIRQAFIRDPLAHKARMRRMMAIADIIKISEEDLAWFGGPASAGEAAQVLLAAGTRLVVVTSGGKGASAYWRGGSFVISAVNVKVADTVGAGDSFNAGILAALRKAGYLKKSRLASLTTEVVRDALSFATRVAAVTVSRAGANPPWADEV

SEQ ID NO: 42007 - protein, 247 aa, Ashbya gossypii ATCC 10895
MPKLVLVRHGQSEWNEENLFTGWVDVKLSAVGEQEAARAGELLKEHNVNPDILFTSKLTRAIQTANIALTKADRIWIPVERSWRLNERHYGDLQGKDKAATLAAFGEEKFNTYRRSFDVPPPPIADDSEFSQSNDERYRDVDPNVLPKTESLALVIDRLLPYWQDTISKELLSGKTVMITAHGNSLRGLVKHLEGISDADIAKLNIPTGIPLVFELDENLKPTKPSYYLDPEAAAAGAAAVANQGKK

SEQ ID NO: 42008 - protein, 743 aa, Physcomitrella patens subsp. patens
MNNERKVIELEQGWSFMKKGITKLKNILEGVPEQQFSSEEYMLLYTTIYNMCTQKPPQDYSQQLYDRYRESFEDYIKSKVLPALREKHEEFMLKELVKRWDNHKIMVRWLSRFFNYLDRYFIARRSLPALSEVGLMCFRDLVYAEIKINVKDAVIALIDREREGEQIDRALLKNVLGIFVEIGMGNMDAYESDFETFMLQDTASYYSRKAASWIEEDSCPDYMLKAEECLKREKERVGHYLHASSEHKLLERVQHELLTQYEPQLLEKEHSGCHTLLRDDKVEDLSRMYRLFLRIPKGLEPVAAIFKLHVTEEGTALVKQAEDAAGNKKAEKKDTVGVQEQAFVRKVIELHDKYLQYVSECFVNHSLFHKALKEAFEVFCNKGVAGSTSAELLATFCDNLLKKGGSEKLSDEAIEDTLEKVVKLLAYISDKDLFAEFYRKKLARRLLFDKSANDDHERSILTKLKQQCGGQFTSKMEGMVTDLTLARENQTNFEEYLTENIQSSPGIDLTVTVLTTGFWPSYKSSDLALPAEMVKCVEVFKEFYQTKTKHRKLTWIYSLGTCNITGKFDAKPIELIVTTYQAAVLLLFNAEDRLSYNDIKNQLNLTDEDIVRLLHSLSCAKYKILNKDPHTKTVGQTDTFEFNTKFTDKMRRIKIPLPPMDEKKKVIEDVDKDRRYAIDASIVRIMKSRKVLPHQQLVLECVEQLGRMFKPDFKVIKKRVEDLIAREYLERDKDNPNMFKYVA

SEQ ID NO: 42009 - protein, 575 aa, Physcomitrella patens subsp. patens
MRWAALCVVATVLALAGFANAKVVEHDFEVAYVDAAPDCYAKTVIGINGVYPGPTIRAVQGDILKITFHNYIATEGITMHWHGIRQVGSAWADGTAAVAQCPILYGESFTYEFIVDRPGTYFYHGHFGSQRAAGFYGALIVDLPAGKHEPYHYDGEHMIIVNDWWHRPIVTQEQGLEAIPFKFVGDPQSLLLEGRGRYNCSAVPTYTPAAISCNQTDERCAPHVMKVERGKTYRLRLASVASLSSLNFKIEGHKMKVVEADGHNVQPFWTDNLDLYSGETYSVLVSANMPGDNYHLGLNVRGREDHNVPTGLGILNYNNAPVRQPSTPAPKGPAWDDFEASKRQARKYKALKHNPDPTSHALDRHAKVTRTLILLTTQQKLKGHIKWAINNVTYAPLPTPVLAGLVYNISGSYDTAPPPDKMPADYNIYAPPPVTETNKGSGVYQFKTGDVVDVIIQNCGNLQNISENHPWHLHGHDFWILGYGDGKYDPKTSPKTFNLKNPPMRNNVPTFPFAWTAIRFKLDNPGAWPFHCHIEWHVHLGMGVVFAHGIEEVRAKGIPNSVLGCGLTKQLFKLR

SEQ ID NO: 42010 - protein, 447 aa, Trichodesmium erythraeum IMS101
MAYDYDLFVIGAGSGGLASSKRAASYGAKVAIAENDLVGGTCVIRGCVPKKLMVYGSRFSHFYKDAVGYGWSEVEPSFDWHKLIDAVNTEVLRLNKLHISFLEKAGVEIIEEYAKFIDPHTIEVGDRKVTADKILIAVGGKPEKIDIPGIEYSITSREIFHLKEQPKRMAVWGGGYIGVEFAGILNGVGTEVTQIIRRDSILRGFDTDISSNIQEGMVKHGINFRENTNVEKIEKVPEGLKVHLSGENAEPLIVDTFLCATGRKPNLAGLNLENAGVETLRGAVAVSNNCRTTQANIYAIGDCIDKVNLTPIAIAQGRAFADTEFGNIPRSISLENIPTAVFSEPEGGTVGLTEAAAREKFGDSIKCYRSKFRPMFHSFTGADEKVMVKLVVETNTDRILGVHMVGKDAGEIIQGMAIAVNMGATKADFDRTIGIHPSTAEELVTLN

SEQ ID NO: 42011 - protein, 441 aa, Oryza sativa Japonica Group
MTRRNGTSGSESSAAHAVADDPSHCSTIQRLGLMPRGDSGRAAHSKLGRNGDRRSRAAHIKVGPKRGVRLISGEPFIFRSFKSKPTSGRALSAEDRAGLVNALKDKLQSLAGQHTDVLEALSPNVRKRVEYLREIQGQHDEIELKFFEERAALEAKYQKLYEPLYTKRYNIVNGVVEVDGGNDEPASENAAEGKDADAKGVPDFWLTAMKTNEVLSEEIQERDEPALKYLKDIKWARIDDPKGFKLDFFFDTNPFFKNSVLTKTYHMVDEDEPILEKAIGTEIEWYPGKNLTQKILKKKPKKGSKNAKPITKTEVCESFFNFFSPPQVPDDDEDIDEDTADELQGQMEHDYDIGTTIRDKIIPHAVSWFTGEAVQAEDFDDMEDDEEDDEDDDEDEEEEEEDEDEDEDDEEEKSKPKKKSAGKPKYFALNCPGNYWLVVHG

SEQ ID NO: 42012 - protein, 620 aa, Escherichia coli K12; identical to SEQ ID NO: 1585

SEQ ID NO: 42013 - protein, 249 aa, Ashbya gossypii ATCC 10895
MMDTTVYIALVIALITTAAVLIIIIHSGQAISVGSGSKKRVTSSPIFIIAGPSGSGKTSLFNLLTTGEAGKTVASQIASFSDSFMLPSGVEKFKFALIDFPGHVKLRQELFTTLKASSNIRGLIFMVDSTVDPKRVTETAEFLYDVLSITERKPQAIDIMIACNKSESFTSRPPTMIKDALEKELGQIIERKSKDLKGAGEDDLTTVFATSGSAFKLDHLEAAVQVCAGSVLNKDIDPWQAWLDENATN

SEQ ID NO: 42014 - protein, 146 aa, Glycine max
  misc_feature (98)..(98): Xaa can be any naturally occurring amino acid
ITKELARLQQLASNNKLTSEDICGGTITLSNIGAIGGKFGSPLINLPEVSIIAVGRIQKVPRFADNGNVYPASLVNVNIGADHRVLDGSTVTRFYNKXKQLIENPELLTLHLKSNLHHIKGKILKLVTTVLFTRSVSIRARSDHQH

SEQ ID NO: 42015 - protein, 284 aa, Zea mays
MDRYHRVERARNQSTIEENEIRITAQGLIRNYVSYATFLLQERRIKEIVLKAMGQAISKSVAVAEIIKKRAPELHQDTNISSVSITDVWEPIEEGLVPLEMTRHVSMISITLSPRELDKHTPGYQAPAYVEHPRQQQVPPLQRQPRRPSGQQFQQLEYEDSYARGRGRGRGRGRGRGWARGGYGGYGNNQGGYNQGGGYYDNQGGYGGYDDQGGYGGGYGYNQGRYGNYQENGGYNRGRGGGMRGRGNWGYRGGYEGGRGGGGPGGRGYGGRGRGRMGGGGRAN

SEQ ID NO: 42016 - protein, 352 aa, Oryza sativa Japonica Group
MASAAIYSLFIINKSGGLIYYKDYGSAGRTDTNDSLRLASLWHSMHAISQQLSPTHGCEGIDLLQAHNFDLHCFQSLTGTKFFAVCETGAQNIETLLKVIYELYTDFVLKNPFYEMEMPIRCELFDLNLAQVRLPPPHGLTSQGSPNRFRRGYHHLTRLNGYRKVVAFVSFVNHQAALSAMSALNGTVFDPDTGDRLHIELAKSSSRKRHGDGGVYRVVDKRLKRKERAADHENAGDGGNDDDAWGEDDNGGNDVVVIDDWCFLSCTVVVNQGLSSIGGNLFQIYYLLEQDQPDKLSSDIPPCSTLFVANLGHSCTEEELKEVLSKQPGFHLLKMRRRGGMPVAFADFTLCV

SEQ ID NO: 42017 - protein, 456 aa, Zea mays
MDQYEVLEQIGKGAFGSALLVRHKAEKKKYVLKKIRLARQTDRTRRSAHQEMQLIATVRNPFIVEYKDSWVEKGCYVCIVIGYCEGGDMAEAIKKVNGNHFSEEKLCKWLVQLLMALDYLHANHILHRDVKCSNIFIARDQSIRLGDFGLAKILTSDDLASSVVGTPSYMCPELLADIPYGTKSDIWSLGCCIYEMAALRPAFKAFDMQALISKITKSIVSPLPTRYSGSFRGLIKSMLRKSPEHRPSAAELLKHPHLQPYVLQVQLKSSPSRTTSPIYQALTDKVKKMTFVSDTADSARRRAARRSSLGSERTVTFCKPSPERNSVSSTRSIKEYTTTTQSARELSVGSSLQVDDEVTSKAVVTKTAGVLRTPSKSRAPASKTLVAARSRLDPPKTSYARTNRAELDSRTPLSKSSARTARRASLPLAAYRAPSGGRSRVSLEGPKLTRTQLSCT

SEQ ID NO: 42018 - protein, 356 aa, Propionibacterium acnes KPA171202
MSQQNRLFGVIETYRDRLPMDGIDQIVTLGEGATPLVPAPRLGAELDATVWVKVEGANPTGSFKDRGMTMAMTKALADGSKAVVCASTGNTSASASAYASRAGMTPVVLLPQGKIAAGKLAQAVVHGGRIIQILGNFDDCLRIARELAENFPVSLVNSINPYRIEGQKTAAFEVVDVLGDAPDIHALPVGNAGNITAYWKGYREYVADGPASHTPRMFGFQAAGAAPLVLGHDVNDPETVATAIRIGRPASGKLALAARDESEGLIDAVTDEQILDAQTFLAAREGIFVEPASAVGVAGLFKLKSEGRLDPGLRIVVTVTGNGLKDIDTALSRTTLSTEAVEASTDQVAALLDFCS

SEQ ID NO: 42019 - protein, 202 aa, Glycine max
  misc_feature (46)..(46): Xaa can be any naturally occurring amino acid
KRQKGEKVLKQSLVYAGAELQLKPKKDFDAQREKELEEQEKFRPPXGSGHQNNTNTEANYPKGLLIAFKLKSISDQVPLDQNNIDQQANDSNVVKDNADNDKENNGVSEGKDTEGEEKSKETDGKNYAAAYKDNNDVVSREDLKGVFDKSGTVKYIDFKIGEESGYIQYREPEAVQKARAAAVLSVKDGSVVKNYIATLDPI

SEQ ID NO: 42020 - protein, 350 aa, Coprinopsis cinerea okayama7#130
MFISNIRASPDGFERPVIAVNGHHPALLIKAKKGDEFELTVANHLTEETMLRQTSIHGIFQHKSSWADGPEGVTQCPVAQFGNSFTYKFNAGNETGTYWYHSHFETQYCDGLRGPLVIYDDNDPYRNDYDVDNEDTIITLADWYHLQAPSINTTIAPPVNATLINGKGRQPVKPDSPLAIVNVKQGKRYRFRILSLSCDPNYNFSIDGHDLTVIEADGQLTRKLVHPFHLRGHAFSVIQSAGSPNKNYIDPVRRDVVSIGDPDRKENVTIRFVTDNPGPWFFHCHIEFHLSGGLGAVFVEDQKDIKSSDRAPPPSWSELCPTFDALPTNATFVSTVATPTAPTAPTNIPF

SEQ ID NO: 42021 - protein, 243 aa, Brassica napus
  misc_feature (229)..(229): Xaa can be any naturally occurring amino acid
MEGLIQTRGILSLPAKPTGARRTLLLQPSHALKQRLSTRSLPPLSISSNGHSKFQSFHPNPHKILISHRERNRGFICKAEAAAATAGEGDSTASTPPKVFGVEVTTLKKIIPLGLMFFCILFNYTILRDTKDVLVVTAKGSSAEIIPFLKTWVNLPMAIGFMLLYTKLSNVLSKKALFYTVIVPFIAYFGAFGFIMYPLSNLIHPEALADKLLATLGPRFMGPLAIMRXWGFRLFYVMAELGG

SEQ ID NO: 42022 - protein, 526 aa, Coprinopsis cinerea okayama7#130
MSFAWKALATLAVAIASRSAFAQSIIGNQDTMTISNINAGPDGFTRPVIAVNGEFPSPLVRANKGDDFRINVVNNLDDDTMLRQTSVHWHGVFQHQSAWADGPDGVTQCPIPQSGQEFEYAFNAGQEAGTFWYHSHYGTQYCDGLRGPLVIYDPEDPHQDLYDVDDENTIITLADWYHLQAPSIQGPAVSQATLINGKGRRPGNTEGDIAVVNVEKDSRYRFRIVSLSCDPDYTFSIDNHTMTIIEADGQNTKPLEVESIRVFAGQRYSVVVNADQAIGNYWIRAEPNIGDTGLVGTSGGGVNSAILRYATADEVEPDTPRLTNRPALQESNLRALTSGVPGGDGPADITFTFNLGLNFATGTFSMNPGESWVHPDTPVMVQIMNGVPAEDLVPAESLHTITRGQVVEVVIPPFGIAGPHAFSVIKSAGGSPNFVDPVRRDVVAVGTEAGQGDTIIRFVADNPGPWFFHCHIEFHLVTGLAAVFMEAPDEIASSNPPPPSWDALCPAFSALPPSATSIRIVPTPTP

SEQ ID NO: 42023 - protein, 605 aa, Ralstonia metallidurans CH34
MESIDHAILLGAVVMTAGILLGVFSSRFGVPFLLVFLGVGMAAGVDGPGGIRFSNTWLSFLVGNIALAVILLDGGLRTRLATFRVALRPSLSLATLGVVITAVLVGAFASWLLGIDWKLGLLLGAIVGSTDAAAVFSLLNGSGVRLTERVASVLEIESGINDPMAIFLTLTLIEWITSPQGLSPGALVTRLVVQFGVGGILGAALGYCLANVMERVNVAEGLQAILVCSGGCMVWAIVQTAGGSGFLAVYLTGMIVGNREHAVGGDTMRAMDGMAWLAQSAMFLLLGLLVSPHRIWDIALPAAAVALFLMCVARPVSVWISLLPFRFNAREKGFVAWVGLRGAVPIVLSLFPMLQGMKDSGLLFRVAFAVVLASLLCQGTTVALAARLARVLRPLYNEPLSRERMRGTQAPALELMQFEVAANSPVDSLRADQLELPMRSRLMTVARDGALVPLDRAILRAGDTVSVLAPGGVLPVLSRLFLTSGPPPAWDQVTYDFLLAGQASLADVAALYGTRALLPHEQLSTLEQAMLAVFRSPPVEGDALEIAGLRLTVTRMDGPRIVQVGLLLPRPVAAGAGDGTNHRWRRRHRARPGLDRVSRPSRRKP

SEQ ID NO: 42024 - protein, 453 aa, Neurospora crassa
MSQILTSRQADELHRALIAYLTAANLPNTAAALREELNLSEEVFDPATAKKYEGLLEKKWTSVVRLQKKIMDLESRNHILQSELDNATPTSRQNKDPVAWLPRAPPRHTLQSHRDPITCVAFHPVFSSLASGSEDQTIKIWDWELGELERTIKGHTKAVLDVDYGGPRGNTLLASCSSDLTIKLWDPLDSYKNIRTLPGHDHSVSAVRFIPGSGNLLVSASRDKTLRIWDVSTGYCVKTLRGHAEWVRDVCPSLDGKYILSTSDDYTSRLWDVTITNPEPKVTLIGHEHVVLCCAIAPPAAYQNLAAMAGIKKPPATSSAEFMATGSRDKSIRLWDARGTCIKTLVGHDNWVRGLVFHPGGKYLLSVSDDKTLRCWDLTQEGKCVKTIGDAHGHFVQCIKWAPSVIKDASVNGDNGEPNGTPKKGGAAATPEAQIRCVIATGSVDLNVRIFAN

SEQ ID NO: 42025 - protein, 388 aa, Bordetella petrii
MIRSKLPDVGTTIFTVMSRLAIEHQAINLGQGFPDFDPDPKLCELVAKAMSAGHNQYPYMPGVAPLRQAIAEKTQALYGRAYDPETEITVTSGATEALMATVLAAVNSGDEVVVIEPCYDSYLPAIRLAGGTAVPVPLRAPTLEDPYYRIDWLRVRDAITSRTRLLMLNFPHNPTGAVLNDSDLDALESIVRDTGILLLSDEVYEHIVFDGKPHASLARRPLLAEHAFVISSFGKTYHTTGWKVGYCCAPRQLSAELRKVHQFMVFTVSSPMQFALAEYMRNPQPYNDLPAFYQAKRDRLAAGLARTRFKPLPSPGTFFMLADYSAISKQSEADFARDLTVQHGVTVIPVSAFYQHPDAESSNHQLVRFCFAKKDATLDAAIERLVNV

SEQ ID NO: 42026 - protein, 245 aa, Oryza sativa Japonica Group
MKFNIANPTTGCQKKLEIDDDQKLRAFYDKRISQEVSGDALGEEFKGYVFKIMGGCDKQGFPMKQGVLTSGRVRLLLHRGTPCFRGYGRRDGERRRKSVRGCIVSQDLSVINLVIVKKGDNDLPGLTDTEKPRMRGPKRASKIRKLFNLAKDDDVRKYVNTYRRTFTTKNGKKVSKAPKIQRLVTPLTLQRKRARIAQKKQRIAKKKSEAAEYQKLLAQRLKEQRERRSESLAKRRSKLSAATTA

SEQ ID NO: 42027 - protein, 551 aa, Aspergillus oryzae
MSLVTLAVASWSLVYGVTAGVIPSGSMPTVSGITTSPRPSSSYPGPCSPCPSLPSCPAATTVTVTVTATACVPTPTPSGGGGVTQPHPSPSFPVPPGTPGAGTSQTSGISGSQPGPGPGPGPSPSLPGQSPCPTIPVGPGGGGSTSGGPPASTTVPVPTISSSVKPQPTSAVPSTITPIHPPTSTPVQPSPAQSTPPSSSPGKTKPIPPPVTPGKTKPVPPTSTPVQPPPSVHPTTQPIPPSSSPGETKPMPPPSTPVQPPPTQSIPPSSTPGATLPGTPGTPGTPVQPPPSVHPTTQPVPPSSTPGKTKTKPASPPGTPVQPPPSVQPPTSTPEGTKPASPPGTPVQPPPSEHPTTHPASPPGTPGTTKTKPASPPGTPVQPPPSEQPPTSTPEETKPAPSTPVQPPTSEQPTTKPIPPIGITTKPPTETPTETPTETPTGSPPGPPVPTASPPGSVTPTQPSSSSEEGVKPTTTVPTVPPTETPEDDPPGDDPPGDDPPPKTTLVKRAYPRWHIKGGKHWNFTKPKTGKKPKTTGRPFEPDYDQDEDEE

SEQ ID NO: 42028 - protein, 935 aa, Debaryomyces hansenii CBS767
MLIIDSEPYEDKSNDKTVNGFRKKDVGLYAMNYGGCYVASVAIYSSYTQVLQAFIEAEKFNGPAIVLAYLPYHNEFDNTLSILKETKLAVDSGYWPLYRYDPTIEDESKSFILDSSNLRNQLKNFLDRENKLTLLAKKDPLLSRNLTSNATTEIKAKQLQAANDSYSKLLQGLSGPPLTVAFASDGGNAEAVAKKINRQALGRGLKSIVLAMDDISMEDLPNETNIVFIASTSGQGEFPTNGKQFWDGLKNSNDIDLSTIKFSVFGLGDSEYWPRKEDKHYYNKPSKDLFNKLKFYGGVELIDIGLGDDQDADGFNTGLNEWEPKLWKALGVDNVEGVEEPKPLTNEDMKIQSDYLRGTIVEGLNDQSTGAISAVDQQLTKFHGIYMQDDRDIRDDRKSKGMEPAYAFMVRVRLPGGIATPSQYLRMDELSNERGNGTLKLTTRATFQLHGVVKHDLKPAIRGMNAALMDTLAACGDVNRNVMVSALPHNAKVHSQISKTGALISEYLLPQTTAYHEIWLQGEDEGDKAGASKNWENRKEGPKKEKTLVAGNALTDFEPMYGPTYLPRKFKVVITVPPYNDVDVYAHDIGLIAIVEGDEVIGYNVLAGGGMGSTHNNKKTYPRTGSMFGYIAKDQIHIACEKIMLVQRDFGDRTNRKHARLKYTIDDLGVEVFKGKVEELLGFKFEKAKPFEIKSNVDYFGWCKDETGANHFTAFIENGRIEDTPELPQKTGLSKIAEYLLQNERPGEFRLTGNQHILISNINDDDLDTVKSLLAQYKLDNTDFSGLRLSSAACVAFPTCGLAMAESERYLPELITKLEEALEDYGLRHDSVVMRMTGCPNGCARPWVAEVALVGKAFGAYNLMLGGGHHGERLNKIYRYSIKEDEILSILKPLFKRWSLERNEGEPFGDFCIRIGIIKPTTEGKFFHDDLPEDA

SEQ ID NO: 42029 - protein, 150 aa, Yarrowia lipolytica CLIB122
MSLEGTRKRKRTNLFVNDIKPLLYAFGDVNDPYPETVAALEDILTDYIVDTCHEAAKMAEIAGRQKIKVDDFKFLLRNDPRKLGRAEELLVLQKEFVEARKAFDSTEGKQLSKTYNQEKEKEKKKKEKEEKKEKKRKEKEEKKKIKEEEK

SEQ ID NO: 42030 - protein, 491 aa, Ashbya gossypii ATCC 10895
MLRCLSGKLPSRIIKCRGYSTEAMAENFELSTLPNGLKVATSNVVGHFSALGMYAGVGTRHEVKNLRGCTNIIDRLAFKSTENMSAVQMAEALERLGGNYQCTSGREYMMYHASVFNRDVEKMLSLMADTVRRPQISEQEVEEQKSAALYDAKGVRHNHEMLLPEMLHEVAYRGEALGVPMATAEEAIRGVSRYHLRDYRNKFYNPQNFVAAFIGVPHEEAVAMASRQFGDMENKYPPHATQPARYIGGMANSLERNNNPSLPEMYHMQIAFESLPIDHPDIYTLATLQTLLGGGGSFSAGGPGKGMYSRLYTNVLNKYHFVDNCMAFHHSYSDSGLFGISISVYPNAARYMAPIIAEELISLLPGGKYKLTEEEVDRAKNQLKSSLLMNLESRLVELEDLGRQILLRGNKIPVAQMISKISEVTPEDCMRVAELVLTGSVENSLSGTGAPTIITQGSESAFGDSLHVLKHYGLGRYDRITQGTGSFGWSA

SEQ ID NO: 42031 - protein, 426 aa, Bordetella petrii
MSNDMSKRIMAHQPSTGAATRVLISSTLAFTICFAVWMIFAVLGIPIKSQLGLSETEFGLLAATPVLSGSLIRVPLGIWTDRYGGRIVFFLLMLVSVPGVWLLAYATEYWQFLVLGLFIGLAGGSFSVGTPYVARWFPRNRQGLAMGIFGAGNSGSALTKFVAPALIAAAGGAWVIVPQVYAVALLATAILFWMFSATNPAHNVRGGASLSAQLAMLRDPRVWRYCQYYSVVFGGYVALALWMTKYYVGEYGFDMKLAALLAACFSLPGGVLRAVGGWISDKYGAYRTTWWVMWVCWVAFFLLSYPQTHFVIETDTGPREFFLAIGPTLFTILMFVVGIAMAVGKASVFKFISDEFGENIGAVSGIVGLAGGLGGFVLPILFGALLDFTGVRSSAFMLMYGTVCVSLIWMHYSFRPEPAARALQAA

SEQ ID NO: 42032 - protein, 309 aa, Polaromonas sp. JS666
MKTDILALGEAMVEFNQTSEDGGRKYLQGYGGDTSNAAIAAARQGASVGYVSAVGDDVYGQMLRELWTREGVNHSGVRTDARGFTAVYFVNHDERGHHFSFFRRGSAASRMTPDQLPAERIADARFLHLSGISAAISESACDTCFAAIDIARSAGVKVSFDTNLRLKLWPLARAGAVMRELIRQADICLPSYEDVVAISGLQDPDRLADFCLELGARVVALKLGSDGALLVDGNKRIRIPPFPCRPVDATGAGDTFGGALLARLAAGDDLETAGYYAAVAAALSTEGYGAVEPIPVAGQVRAAIERQAV

SEQ ID NO: 42033 - protein, 484 aa, Triticum aestivum
  misc_feature (253)..(253): Xaa can be any naturally occurring amino acid
METPRGLLQSDASADQVASERSDSVQQHGVDKEHAMLAPFTAGWQTAISPTLIIERSEGCYIYDANGNKYLDALAGLLSTALGGSEPRLVKAATEQLNKLPFYHSFYNHTTRPSLDLANELISIFTARQMGKVFFTCSGSEANDSQVKLVWYYNNALGRPKKKKIIARSQSYHGTTYISASLSGLPTLHQDFDLPGNFVLHTDCPHYWRFHLPGETEEEFATRLANNLENLILKEGPDTIAAFIAEPVIGAGXVILPPKTYFEKIQEVVKKHDILFIVDEVITGFGRLGAMFGSDLYDIKPDLVSLAKALSSAYAPIGAILVSREISDVIYSHSNKLGTFAHGFTYSGHPVSCVVALEALKIYRERDIPGHVAHVAQRFQEGIKAFAAKSPIIGETRGVGLLIATEFTDNKSPYDLFPFEWGIGETFGAECKKRGMVVKVLGNLIAMSPPLIITLEEIDKLVSIYGEALKVTEERVAECKAKKE

SEQ ID NO: 42034 - protein, 148 aa, Trichodesmium erythraeum IMS101
MSEIENHQQPSTPFLDSEANNEQKYPTRTPPWGTVTILEEGLRYKISRIEVKPKHYISTQMHYHRSEHWIVVSGTAKVTFNDQEKLLFQKQSTYVPANTAHRVENPGIIPLIMIEIQNGEYLGEDDIIRFPDEDNQLFSFKKAITNKE

SEQ ID NO: 42035 - protein, 211 aa, Ashbya gossypii ATCC 10895
MSSKGYKKPSLYGYAKIYIYSFLTLIVGSYGLYKLLTNHGEDINIGKFLSRTSPYMWANLGISLCIGLSVVGAAWGIFITGASIIGAGVRAPRITTKNLISIIFCEVVAIYGLIMAIVFSSKLTVATPETLFSKSNLYTGYSLFWAGITVGVSNMICGIAVGITGATAAVSDAANSALFVKILVIEIFGSVLGLLGLIVGLLMAGKTVEFQ

SEQ ID NO: 42036 - protein, 338 aa, Oryza sativa
  misc_feature (229)..(229): Xaa can be any naturally occurring amino acid
MDLQEAAMEARKGHRIPPTEEKVIIDTDPGIDDSVAIMMAFEAPGVKVVGLTTIFGNCTTSHATRNALILCDRAGRPEVPVAEGSAEPLKGGKPHVADFVHGSDGLGNTSFPDSTTTNKVEQSAAEFLVDKVSESPGEISVLALGPLTNIALAMKKDSSFASKVKRIVVLGGAFFAAGNATPSAEANIHSDPEAADIVFTSGADIYVVGLNITTQVYFTDKDMLGAKEXSKGKHAQFLCDICKFYRDWHVHSYGVDALFLHDPVSFTALVHPEYFTFKKGVVRVETQGICKGHTSMDMGLKKWNSDNPWTGYSPISVAWTVDVPKVLAYAKELLFNAQ

SEQ ID NO: 42037 - protein, 307 aa, Anabaena variabilis ATCC 29413
MQETTILILGAGAWGASLANLALANGHRVRVWSRRGTETLAALLEDVDIILSAISMKGVREVASQIQSLTPSPETIFVTATKGLEPETIYTPSQIWQSCFPNHPVVVLSGPNLSKEIDQSLPAATVVASRIATAAATVQLAFSSSRFRVYTNPDPIGVELGGTLKNVIAIASGVCDGLHLGTNAKAALVTRGLTEMVRIGNCWGAKTETFYGLSGLGDLLATCNSPLSRNYQVGYQLAGGQTLAQILAKLPGTAEGVNTCQVLVQLARQQNIVIPITEQVYRLLQGEVTPQQALDELMLRDIKPEYN

SEQ ID NO: 42038 - protein, 318 aa, Zea mays
MDRYHRVERARNQSTIEENEIRITAQGLIRNYVSYATFLLQERRIKEIVLKAMGQAISKSVAVAEIIKKRAPELHQDTNISSVSITDVWEPIEEGLVPLEMTRHVSMISITLSPRELDKHTPGYQAPAYVEHPRQQQVPPLQRQPRRPSGQQFQQLEYEDSYARGRGRGRGRGRGRGWARGGYGGYAYNQGGYNQGGGYYDNQGGYGGYDDQGGYGGGYGYNQGRYGNYQENGGYNRGRGGGMRGRGNWGYRGGYEGGRGGGYERRTLGGGYEGGRGGGYEGGRVGGGYEGGRGGGGPGGRGYGGRGRGRMGGGGRAN

SEQ ID NO: 42039 - protein, 339 aa, Triticum aestivum
  misc_feature (289)..(289): Xaa can be any naturally occurring amino acid
MESYSLSYASLCGLAVVVAGWLLHCVYKWRSPPCNIGRLPPGSMGFPLVGETFQFLRPSPSLDIPAFYKQRLERYGPLFKTNLVGHPVVVSMDAEVNRFIFQQEGKLFRSWYPDTTNDLFGKESMVYYDGSVHKYVRSFAARLFGIDSLRDVLFSEMEHSVTQNLAAWATEPFIEVKDAVATMIFDHMAKKLIGFGPDKSRKLRKNFDAFFQGMVSFPLYFPGTTFYGCIQGRKKLQNVLKDLLKERLSTPQTRHGRFLDEVVDELRSGTGTMNEKFAVDFVGRLLVGXFATISSALAVGMKLLTDHPNVVESLREEHEAILRKKEGGRTGINGENYSP

SEQ ID NO: 42040 - protein, 350 aa, Oryza sativa Japonica Group
MATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKDCSCLNSAGRATVVRNRGNRGMQGRVERRAMNQVTRNLAAEWANDGIRVNCVAPGFIRTPLLSEFVEGNELGRAEFSRVPMGRLGEPEDIASLVAFLSMPASSYITGRDDSVGHSNRCWKQSLGMVAFPLAALRKEASSSLPPLNSVGKQWHQGQDVDRSDRLALANGKDKVAKGAHHI

SEQ ID NO: 42041 - protein, 162 aa, Mycobacterium avium 104
MEFDVTIEILKGQRNKYEVDHETGRLRLDRYLYTAMAYPTDYGFIEDTLGEDGDPLDAMVLLPQSVFPGVIVEARPVGMFRMTDEKGGDDKVLCVPAGDHRWEHIQDIGDVPEFELDVIKHFFVHYKDLEPGKFVKAADWVGRAEAEAEVQRSIERFKAQGH

SEQ ID NO: 42042 - protein, 348 aa, Oryza sativa
  misc_feature (111)..(111): Xaa can be any naturally occurring amino acid
MAATAAYLPLRAQAQVGLAPLRPSGSAAAGARLPGRTARRRLAARGGPEAAGIRAEAVPGGGGVARRAAMVPPYNVLITGSTKGIGYALAKEFLKAGDNVVICSRSVYPLXAERVESAVTDLKKEFGEQHVWGIVCDVREGKDVKALVDFARDKMKYIDIWINNAGSNAYSYKPLVETSDEALMEVITTNTLGLMICCREAINMMRNQPRGGHIFNIDGAGSDGRPTPRFAAYGATKRSVVHLTKSLQAELQMNEVNNVMVHNLSPGMVTTDLLMSGATTKQAKFFINILAEPANVVADYLVPNIRAIPTNQSMKPTYIRFLTGLKAYSRIFSRIAFGARRNKYVAED

SEQ ID NO: 42043 - protein, 343 aa, Oryza sativa Japonica Group
MDHAAEAQRTDLMTITRHVLNEQGRHPESRGDFTILLSHIVLGCKFVASAVNKAGLAKLIGLAGDTNVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 42044 - protein, 112 aa, Triticum aestivum
MITRRIARPSCRRRIIQISALSTFDGRIGAYHGGAWDNAKKYIEAGASEHAKSLGPKGSDCHKAAVIGDTIGDPLKDTSGPSLNILIKLMAVESLVFAPFFATYGGILFKYL

SEQ ID NO: 42045 - protein, 203 aa, Torenia hybrid cultivar
AHLKGGAKKVVISAPSKDAPMFVVGVNEKEYKPELDIVSNASCTTNCLAPLAKVINDRFGIVEGLMTTVHSITATQKTVDGPSSKDWRGGRAASFNIIPSSTGAAKAVGKVLPVLNGKLTGMAFRVPTVDVSVVDLTVRLEKEATYDEIKAAIKEESEGNLKGILGYTEDDVVSTDFVGDSRSSIFDAKAGIALSKTFVKLVS

SEQ ID NO: 42046 - protein, 230 aa, Brassica rapa
MAMATSTQLSSSLFHSQITKKPFLLPATISVHGFSTRRLKSLSLSHRSSVSALSASSAVDVTEPVKKPVRTLPFRVGHGFDLHRLEPGYPLIIGGIDIPHDRGCEAHSDGDVLLHCVVDAILGALGLPDIGQIFPDSDPKWKGAASSVFIKEAVRLMDEAGYEIGNLDATLILQRPKISPHKETIRSNLSKLLGADPSVVNLKAKTHEKVDSLGENRSIAAHTVILLMKK

SEQ ID NO: 42047 - protein, 203 aa, Arabidopsis thaliana
VSKWTPLCVASPPERNSASLNPHCSPARVNFRTALAAFRPQFRLFSRNSASRCRLRASSSAESGIFLPHLVASMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGGLAVQTGRNIVHGSDSPENGKREI

SEQ ID NO: 42048 - protein, 295 aa, Bacillus cereus G9241
MKKIKKAIIPAAGLGTRFLPATKAMPKEMLPIVDKPTIQYIVEEAIESGIEDIIIVTGKGKRAIEDHFDHSFELEKKLLEKGKHEVLEKVQASSKINIHYIRQKEPKGLGHAVWCARKFIGNEPFAVLLGDDIVQAETPCLRQLMDEYEGTQSAVIGVQKVPENEVHRYGIIDPVEQNDRRYQVRQFVEKPAEGTAPSNLAIMGRYVLTPEIFMFLENQQTGAGGEIQLTDAIQRLNEIQSVFAYDFEGTRFDVGEKLGFIKTTIEMALQDKGIQEELLNHMEWLLKSESSREYK

SEQ ID NO: 42049 - protein, 588 aa, Bordetella petrii
MAVEGDAGQLAKVVVLLGAAVVAVPLFRRLGLGSVLGYLAAGLVIGPFGLGLFRDPHTILHTAELGVVMFLFIIGLEMRPSHLWALRGEIFGLGSLQVLVCGLLLTGVGVAFGFPLAVSFICAMGFVLTSTAIVMQLLGERGDIATARGQKIVSILLLEDLLIVPLLALVAFIAPPGAGPVEASTAASRWLDVGIGVGALAALVVAGIWLLNPLFRLLARAKAREVMTAAALLVVLGSALLMQWGGLSMAMGAFLAGVLLSESTFRHQLEADIEPFRGLLLGLFFLGVGMSLDLTVVARNATLIVVGVLAMMAVKALCIYGTARLARSSKAEALDRAVLMAQGGEFAFVLFSAALANRVIDPVVNANMTAIVVLSMALTPLAVLAHNRWAPRPGVSTEGLEAPSNQLGRALVIGFGRVGQIASQHMLAMGAEITIIDNDPEMIRSAADFGFKVYYGDGTRTDVLHAAGAKHAQAILVCADGRATVTQMVERIKAVCPHSRILVRSFDREHALELHRADVDFQVRETFESAMVLGRQATMTLGATPEIADEIAEDIRRRDAERFQLEVTGGLFAGRALLLNNQSAEHDH

SEQ ID NO: 42050 - protein, 441 aa, Yarrowia lipolytica CLIB122
MGEKPNRIGRANISYINHDHIFLPSFQPSYPSRQLHPLISSQNKVHSSIVHLPKVASPSSPETQQHSQAPLFITHIMSGLPQALASGFAARVREGGTTLYINTTPMLRSARHNTAVNYAEFEEDFDANDFEDDDDDDQSQRESRDGSEEAEGDEDGTKKEEQDKFAGLKAPLVSNEPKRAAPPVRPVMYPQEVLEELSQVKEPTLIPIRVAVENIDVFRVQDFFLWDADEKILTPEQFATLTCADLDVPIGYSAQMSAQIKKQLAEYTAAPALPKDVEVHVIVELAVTVDKIVYEDKFEWDLSGEYATPQEFARTVVQDLGLGQEFYPAITYQLYETLGKLQKAWLERSIPLDVDNRAAFGLEAGLRVDQDNLGESWVPRVEEMTPEEMQKREMERDRSSRRLKRESARMAEVPYVDLDSLYSRKRRRRFDEDSRSGSPMW

SEQ ID NO: 42051 - protein, 637 aa, Moritella sp. PE36
MIIASDIELLRGGKPLITNTSAKINPGQKVGLVGKNGCGKSSLFALIRHEISLDNGSLTYPSSWQVSSVKQETPALDRSAHDYVLDGDTGFRQLEADLAQAEAADNGNKIAEIHGKLDAIGAYSINARCSELLSGLGFSEDKQQLSVQSFSGGWRMRLNLAQALLCRSDLLLLDEPTNHLDLDAVIWLEKWLKQYDGTLMLISHDRDFLDAIITKIIHVEDQKLNEYTGDYTSFEKQRAEKLSQQQSMYEKQQREVAHMQSYIDRFRYKASKAKQAQSRIKAMERMELISAANADSQFSFRFLTPDALPLPLLTMENVCAGYDDNLILDNIKLNLVPGSRIGLLGRNGAGKSTLIKLLAGEIEPLTGKLEVNPNSKVGYFAQHQLEFLRLDDTPLQHLVRLAPDKTELELRKYLGGFGFIGEKALDIVRPFSGGEKARLVLALIVWQKPNLLLLDEPTNHLDLEMRHALSVALQGFEGAMVVISHDRHLLRSTTDELYLVHDKKVLPFDGDLDDYHSWLSEQQKVEKQATQVINTGANSAQAKKDQKRKAAELRKLTQPVRKHIEKVDKQLETLGDKLTALETQLSETSIYEDQNKAKLKTALSEQAKFVVAIEGAETTWMELNEQLEEMIEESEQA

SEQ ID NO: 42052 - protein, 289 aa, Gluconacetobacter xylinus
MIKPLKKAVLPVAGLGTRFLPATKCVPKEMLTVVDRPLIQYAIDEAREAGIEEFCLVSSRGKDSLIDYFDISYELEDTLKARKKTSALKALEATRVTPGSMLSVRQQEPLGLGHAIWCAREFIGNDPFAILLPDDVVQSEKSCIGQLVEVYNKTGGNVLAVTEVPREQTGSYGILDVGADDGKTVEVKGLVEKPDPKDAPSTLSVIGRYVLTADVLKHLAKLEKGAGGEVQLTDAMAKTIGHVPFHGYRYEGKRFDCGSKPGFLEAQIAFALAREDLAGDVREFLKKYK

SEQ ID NO: 42053 - protein, 458 aa, Staphylococcus epidermidis RP62A
MKVAKFGGSSVSTAEQIKKVLTIVNEDPERKIIIVSAPGKRHNDDIKTTDLLIRLYEKVLNKLNYESKKQEIIQRYADIVEELGIGNDILITINDTLEEYIKNLSDKPNRLYDALLSCGENFNAQLIAQYNNSQGIPTRYISPKEAGLTVTDLPQQAQILDSAYNDIYKLRDYDEKLIIPGFFGVSKQNYIVTFPRGGSDITGAIIARGVRASLYENFTDVSGIYKANPNIINNPELIEEITYREMRELSYAGFGVFHDEALQPLYKDRIPVVIKNTNRPNDKGTYILHDREIDSKNVISGISCDKGFTVINIKKYLMNRLVGFTRKILGVLEDYNISFDHMPSGIDNISIIMRTNQIQGKESQVLNAIRKRCEVDELSIDHDLAVLMIVGEGMNQVVGTASKITHALSESNINLIMINQGASEISMMFGIHEADAEKAVLSTYEFCYNGVCLKNLCK

SEQ ID NO: 42054 - protein, 354 aa, Staphylococcus epidermidis RP62A
MKRWQGLVKEFKEYLPVNQSTPALTLNEGHTPLIYCENLSQKLDIELYVKYEGANPTGSFKDRGMVMAVTKAKEQGKKVVICASTGNTSASAAAYAARAGLKAIVVIPEGKIALGKLSQAVMYGAEIVSIEGNFDEALEIVKEIAEENDEIELVNSVNPFRIEGQKTGAFEIVEQLDGQAPDILAIPVGNAGNITAYWQGFVEYHNKKNTQLPQMFGFQAEGASPIVQNKIIKNPETIATAIRIGNPASWQKAVNALDESNGLIDSVIDEEILEAYQLMTTNEGVFSEPASNASIAGLIKLHRSGKLPKGKKIVAILTGNGLKDPDTAISLLDNPIQPLPNNKESIIRYIKGAI

SEQ ID NO: 42055 - protein, 503 aa, Glycine max
MVLSKTTSESDVSVHSTFASRYVRTSLPRFKMPEESIPKEAAYQIINDELMLDGNPRLNLASFVTTWMEPECDKLIMAAINKNYVDMDEYPVTTELQNRCVNMIAHLFNAPLEETEAAVGVGTVGSSEAIMLAGLAFKRKWQNRRKQEGKPFDKPNIVTGANVQVCWEKFARYFEVELKEVKLRDDYYVMDPEKAVELVDENTICVAAILGSTLNGEFEDVKRLNDLLIEKNKITGWDTPIHVDAASGGFIAPFLYPELEWDFRLPLVKSINVSGHKYGLVYAGIGWVIWRSKEDLPEELIFHINYLGADQPTFTLNFSKGSSQVIAQYYQLIRLGFEGYRNVMENCRDNMLVLKEGLEKTGRFSIVSKDNGVPLVAFTLKDHTHFDEFQISDFLRRFGWIVPAYTMPPDAQHVTVLRVVIREDFSRTLAERLVADVEKVLHELDSLPARVISSTSVTVTAEENGKVVVAKKSAMETQREITAIWKKFVLERKKNNDKMNGVC

SEQ ID NO: 42056 - protein, 128 aa, Volvox carteri f. nagariensis
MSMAVRSSFAARVAGARPAVRAARPSARTVSVNAYKVTFKTPSGDKVVEVADDVYLLDAAEEAGMDLPYSCRAGACSSCAGKIVSGTVDQSDQSFLDDKQMEAGFVLTCVAYATSDLVILTNQEEGLY

SEQ ID NO: 42057 - protein, 600 aa, Coprinopsis cinerea okayama7#130
MLASPTSPPSSGAQQDNPTPARPWLDKLKQAGSLTIHHVKRHTGVGVVCAVAYFDPGNWGVDLQAGSQFGYRLLFVVLLAGLFAVFLQVLASRLGCVTGLDLAGHSRLLLYNRPKHTLLYRWLGLYPLYVLAEVAIIATDLAELLGSAIALCMLFPSLELWHGVLITAFDVIVILAFGDPLRGRPVRLFELLIAGMVIAVLVCMCIVISKVDVHWGDAFLGYVPSKYIFQSGGLYTSVGILGATVMPHSLFIGSALATQDRIEFRELKKEDWHSMDSAEIPRSRLGYIWHSIKHHVQHAFAKPPPSFYDQATKHSEHENNPFAFVRAHLYHGIFDVAASLLGFAVLINSSILILASAVFYYGDQWSGDGDPASLFDCYDLIRDIVGQSAATLFAIALLASGQSSSLIATVAGQAVCEGFLRWRVSPLVRRLITRLLAIIPSMTVALVVGRPGIDALLVASQVVLSVVLPFITFPLLWCTSSKTIMSVRKPKKTVESFTAEPSTSDLAVPVLNREPSGAPSTKGDAKVPTSPTMTVSPPGTPASDGPSKIPDAGTAESADDYEMVDYSNNKLTIAVGVAIWLLVVAANVYVLIDLARGGSG

SEQ ID NO: 42058 - protein, 482 aa, Staphylococcus epidermidis RP62A
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 42059 - protein, 346 aa, Prochlorococcus marinus str. NATL2A
MFGLIGHSTSFEDAKRKALGLGYDHIAQGDLDVWCTAPPQLVENVKVVSAIGKTIEGAYIDSCFVPEMLSRFKTARRKVLNAMELAQKKEISITALGGFTSIIFENFNLLQNQQVRNTTLDWQRFTTGNTHTAWVICRQLEQNAPRIGIDLSKSKVAVVGATGDIGSAVCRWLSNRTGVSELLLVARQQKPLLELQSQLGGGRILSLDDALPEADIVIWVASMPKTLEIDPSKIKRPCLMIDGGYPKNLGEKFSGPGIHVLKGGIVQFFKDIGWSMMELAEMENPKREMFACFAEAMLLEFENCHTNFSWGRNNITLEKMDFIGKASERHGFSAVGLKSNIQTLTV

SEQ ID NO: 42060 - protein, 477 aa, Brassica rapa
MAAATRRLIQRVSTTRLSTAGARRSYGGVPESNSKAPSSSSSQRLMELESEFSAHNYHPVPVVFSRGNGSTIWDPEGKKYIDFLAAYSAVNQGHCHPKIIKALQEQVQKLTLSSRAFYNDKFPVFAERLTNMFGYEMVLPMNTGAEGVETALKVARKWGHEKKHIPKDEALIVSCCGCFHGRTLAVISMSCDNDATRGFGPLLPGNLKVDFGDADSLEKIFKEKGDKIAGFLFEPIQGEAGVVIPPAGYLKAVRELCTKHNVLMIADEVQSGLARSGKMLACDWEEIRPDMVILGKALGGGVIPVSAVLADKDVMLHIKPGQHGSTFGGNPLASAVAMASLDVIEEEKLVERSASLGEELRIQLNKIKKQFPDHIKEVRGRGLFNAVEFDSKSLSPVSAYDICLSLKERGVLAKPTHNTIVRLTPPLSISSDELREGSKALRDVLEVDLPKLQKINAGKTPVSHLTECDRCGRSLYA

SEQ ID NO: 42061 - protein, 556 aa, Lotus japonicus
MDGPVGLKKISSQCSIPEMDDFDQLSRLLDKPRLNIERQRSFDERSLSELSQGFARAGVDNYENYSPGVRSGFNTPASSARNSFEPHPMVADAWESLRRSLVYFKGQPVGTIAAVDHQAEEVLNYDQVFVRDFVPSALAFLMNGEPDIVRNFLLKTLHLQGWEKRIDRFKLGEGVMPASFKVLHDPVRKTDTLIADFGESAIGRVAPVDSGFWWIILLRAYTKSTGDLTLAESPDCQKGMKLILTLCLSEGFDTFPTLLCADGCSMIDRRMGIYGYPIEIQALFFMALRCALSMLKQDDAEGKECVERIVKRLHALSYHMRGYFWLDFQQLNDIYRYKTEEYSHTAVNKFNVIPDSIPEWVFDFMPTRGGYFIGNVSPARMDFRWFALGNCVAILSSLATPEQSMAIMDLIEARWDELVGEMPLKISYPAIESHEWRIVTGCDPKNTRWSYHNGGSWPVLLWLVTAACIKTGRPQIARRAIELAESRLLKDGWPEYYDGKLGRYVGKQARKYQTWSIAGYLVAKMMLEDPSHLGMISLEEDKQMKPVIKRSSSWTC

SEQ ID NO: 42062 - protein, 310 aa, Zea mays
MTAGQLLRTEPSAQPQRVRHSTPPAALQADIVPSYPPPESDGDESWVWSQIKAEARRDADAEPALASFLYATVLSHASLDRSLAFHLANKLCSSTLLSTLLYDLFVASLADDPSVRAAAVADLIAARSRDPACAGFAHCLLNYKGFLAVQAHRVAHVLWAQGRRALAVALQSRVAEVFAVDIHPAATVGRGILLDHATGVVVGETAVVGDNVSILHHVTLGGTGKAVGDRHPKIGDGVLIGAGATVLGNVRIGRGAKVGAGSVVVIDVPPRSTAVGNPARLIARKKGEEVMPGESMDHTSFIQQWSDYII

SEQ ID NO: 42063 - protein, 580 aa, Lotus japonicus
METATQLTSPPPPSAFDGTLGHHLARRLVEIGVRDVFSVPGDFNLTLLDHLIGEPQLNVIGCCNELNAGYAADGYARAKGVGACVVTFTVGGLSVLNAIAGAYSENLPVICIVGGPNSNDYGTNRILHHTIGLPDFSQELRCFQTVTCFQAVVNNLEDAHELLDTAISTALKESKPVYISISCNLPAIHHPTFARDPVPFFLSPKVSNQEGLEAAVEVAAAFLNKAVKPVIVGGPKLRAPKAQKAFLEFAEASGYAIAVMPSGKGFVPEDHPHFIGTYWGAVSTGYCGEIVESADAYIFVGPIFNDYSSVGYSLLVKKEKAIMVQPNRVTIGNGPSLGWVFMADFLTALSKKVKTNKAAMENYQRIFVPPGIALTREKGEPLRVNVLFKHIQAMLSGDSAVIAETGDSWFNCQKLRLPANCGYEFQMQYGSIGWSVGATLGYAQAATNKRVIACIGDGSFQVTAQDISTMIRCEQKTIIFLINNGGYTIEVEIHDGPYNVIKNWDYTRFVEAINNGQGKCWTAKVRTEDDLTEAIAAATGPQKDSLCFIEVFVHKDDTSKELLEWGSRVAAANGRPPNPQ

SEQ ID NO: 42064 - protein, 380 aa, Lotus japonicus
MSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 42065 - protein, 222 aa, Glycine max
KIGVETDKIGRILSNPSPAVNGVLPADTRTPFTAGLGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFMANSRAKAIDNAEGLVKILAEKETDKILGVHIMAPNAGELIHEAAIALQYDASSEDIARVCHAHPTMSEAVKEAAMATYDKPIHI

SEQ ID NO: 42066 - protein, 489 aa, Polaromonas sp. JS666
MNLKRPSLFRQQCHIDGQWVDASDQATLAVVNPANDEVIACVPRLTDKDVQSAIRAADKALPAWREMSAKDRSKILRRWYDLCMTHQEDLATILTTEQGKPLSEARGEIAYGSGFIEWFSEEAKRVYGDIIPAPTADRRIIVIKQPVGVVAAITPWNFPNAMITRKAGAALAAGCTIVVKPASATPFSALALADLAVEAGIPPGVFNVVTGRSDVVGGALTSSPVVRKLSFTGSTEVGKQLMAQCAGTVKKVSMELGGNAPFIVFGDADLDAAVAGVMASKFRNAGQTCVCANRIFVQDMIYDVFAAKLKVAVEAQVVGDGMQAGVNLGPLIDAAAVNKVQEHISDAIALGANVLTGGQAHALGGHFFQPTILINVSSEAKLMNEETFGPVAPLIRFSTEEEVVSMANDTPFGLAAYFYTGSYERAWRVSEALECGIVGLNEGIISTELAPFGGIKESGVGREGSKYGIEDYVEVKYICAGGLGKKRAA

SEQ ID NO: 42067 - protein, 497 aa, Oryza sativa Japonica Group
MAERELIDRDKLVLIDLQFHGFHGVKSEEKTLGQKFVVDVDAWMDLSVAGETDSISDTVSYTDIYGIAKDVVEGPSRNLLEAVAHRIASNALLKFPQISTIRVKVGKPHVAVLSKAQRSCEEIMLHADLAHLFRFTDLRSSDKLELVVGYTIKLALMGVKVTAKYKPPILPIGKGAYGIVCSALNSETGEQVAIKKIANAFDNKIDAKRTLREIKLLRHMDHENIVAIRDIIPPPQRNSFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSFPEKFPHVHPLAIDLVEKMLTFDPRQRITVEGALAHPYLASLHDISDEPVCSSPFSFDFEQHALSEEQMKDLIYQEGLAFNPDYQ

SEQ ID NO: 42068 - protein, 163 aa, Escherichia coli K12
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSGKLDAFLASIRDVAKIVEVARSGVVGLSRGDKIMR

SEQ ID NO: 42069 - protein, 289 aa, Moritella sp. PE36
MSAKHPIIAVTGSSGAGTSTTSLAFAHMFQQENIKASFIEGDSFHRYTRPEMDVAIRKAREQGRHISYFGPEANDFELLENFFQDYGRDGSGKYRRYLHSFDEAVPYNLMPGTFTPWQDIDAGTDLLFYEGLHGGVATKDNNVAKHVDLLIGMVPIVNLEWIQKLVRDTEDRGHSREAVTDSIVRSMDDYINFITPQFSRTHINFQRVPLVDTSNPFSATAIPTLDESLVVIRFQSVKNIDFPYLLTMIDGSFISGINTLVVPGGKMALAMELICAPLIRQLLVEGKIS

SEQ ID NO: 42070 - protein, 360 aa, Pisum sativum
MDFSTNGSEESELYHAQIHLYKHVYNFVSSMALKSAMELGIADAIHNHGKPMTLPELSSSLKLHPSKVNILYRFLRLLTHNGFFAKTTVKSNEGEEETAYVLTPSSKLLVSGKSTCLSSLVKGALHPSSLDMWGVSKKWFHEDKEQTLFECATGENYWDFLNKDSDSLSMFQDAMAADSRLFKLAIQENKHVFEGLESLVDVAGGTGGVAKLIHEAFPHIKCTVFDQPQVVGNLTGNENLNFVGGDMFKSVPSADAVLLKWVLHDWNDELSLKILKNSKEAISHKGKDGKVIIIDISIDENSDDRGLTELQLEYDVVMLTMFLGKERTKKEWEKLIYDAGFSRYKITPICGFKSLIEVYP

SEQ ID NO: 42071 - protein, 518 aa, Oryza sativa Japonica Group
MGNRTSRHHRAAPEQPPPQPKPKPQPQQQQQQWPRPQQPTPPPAAAPDAAMGRVLGRPMEDVRATYTFGRELGRGQFGVTYLVTHKATGKRFACKSIATRKLAHRDDIEDVRREVQIMHHLTGHRNIVELRGAYEDRHSVNLIMELCEGGELFDRIIARGHYSERAAAALCREIVAVVHSCHSMGVFHRDLKPENFLFLSKSEDSPLKATDFGLSVFFKPGEHFKDLVGSAYYVAPEVLKRNYGAEADIWSAGVILYILLSGVPPFWAESEDGIFDAVLRGHIDFSSEPWPSISNGAKDLVKKMLRQDPKERLTSAEILNHPWIREDGEAPDKPLDITVISRMKQFRAMNKLKKVALKVVAENLSDEEITGLKEMFRSLDTDNSGTITLEELRSGLPKLGTKISESEIRQLMEAADVDGNGTIDYAEFISATMHMNRLEKEDHILKAFEYFDKDHSGYITVDELEEALKKYDMGDDKTIKEIIAEVDTDHDGRINYQEFVAMMRNNNPEIAPNRRRMF

SEQ ID NO: 42072 - protein, 67 aa, Zea mays
MGRQRPAVARPGEATRELPDNPRSDTIPREVLHACYSRVFPSAKGDNLKLVAWSYSVADLLDLDHKD

SEQ ID NO: 42073 - protein, 202 aa, Moritella sp. PE36
MSIKFIASSKLPTPFGTFTMHGFEDSETGKEHVALTYGELATDKVILGRIHSECLTGDALFSLRCDCGFQLETAMKNITEAGSGFILYLRQEGRGIGLLNKIRAYNLQDSGANTVEANEKLGFAADLRNYAMCKPMLDHLGISKVRLMTNNPKKLAAMEECGVNVVARQPLQVGKNMHNEHYLRTKADKLGHMMTEEHFKED

SEQ ID NO: 42074 - protein, 176 aa, Prochlorococcus marinus str. MIT 9303
MIPGLQPISLQDLKALAAPRHWSIEGHLDEMASLTPLRGSISAEHQGSILEVKGKFQTIVTLCCDRCLSEFNQNLACNTEELIWLKGNGPNPNELNVSSHSDDMDALMECLDPRGSFDPERWVFEQLSLQMPLVKRCGADCPGPAQLQPSAKTTAVKAEGTDLDPRWAALQKLNSP

SEQ ID NO: 42075 - protein, 533 aa, Photorhabdus luminescens subsp. laumondii TTO1
MALYKASSRPKSDSGQGKFKKQLTLTDLTFIGLGAIFGSGWLFAASHVSVIAGPAGIFSWLIGGIAVLLLGIVYCELGAALPKSGGIIRYPVFSHGELMGYLMGSITLIAFSSLIAIEVVAARQYAAAWFPFLSQPGSGDPTLTGWLVQFILLAFFFYLNYNSVKTFAKSNNIISIFKFIVPLLVIIILFNYFNPSNLQVHGFSPFGISGIEAAVSTGGIIFAYLGLTPIISVAGEVEKPQKTIPIALILSISLSTVIYVLLQLAFLGGIPSDLLFSGWNNIGQYFSLPFRDIALILGVGWLAFLVVCDAVISPSGTGNIYMNATPRVVYGWAKSGTLFNVFTHVDEKSGIPRPALWLTFILSVFWTLPFPSWEKLISVVSAALILSYALAPVTASALRRNAKEIKRPFYVKWFAIIGPLSFIISAFIVYWSGWKTVSWLLGLQIILFFIYLLFKNKVPIGKVSLRQQITSALWLISFYSAMIILSYLGTFGGKGIIPAPWDIVAVAVISLIAFYWGTFSALPNAILPTEDED

SEQ ID NO: 42076 - protein, 216 aa, Glycine max
  misc_feature (144)..(144): Xaa can be any naturally occurring amino acid
  misc_feature (203)..(203): Xaa can be any naturally occurring amino acid
ISLEPELGEPWVLPCVRKTELLMAQNDSLNHEYLPVLGFEPFCKAAVTLLLGDVETSTPLAEGRAFGVQTLSGTGALRVAAEFLSKILKYTTFYVSNPTWENHRLVFFNGGFKQCMEYRYWNEEKRGLDIEGMIEDLRAALTYXLIILHDSAHNPTGCDPTKDQWKIIADIGQEKKLFPLFDYVYQGFATGDAENDAWAVRYXANERNIELICCPS

SEQ ID NO: 42077 - protein, 252 aa, Terrabacter sp. DBF63
MSNSLDGKVALVTGGGGGIGRETAKVLVDHGARVVVADLSEDAGNGTLEYIDGGDAVAFVRADVTDLASMQHLVQAAVDRYGRLDIAHNNAGIEVTGPDLADVTVEQFDKVIAVNLTGVFISMKAEIPQMLAQGGGSIINTASSLGQAALAHQSAYVTSKHGVIGLTRAAAVEYSDKGIRVNAVLPGVIQTPMIDALEETYPGFKDALLTKHPIGRLGTPHDIAEMVAWLGSDAAAFATGSQFAVDGGYLAI

SEQ ID NO: 42078 - protein, 493 aa, Cucumis melo
MGFHQTHETNQVLLSKIAISDGHGEDSPYFDGWKAYDNDPFHPENNPLGVIQMGLAENQLSPDLIVDWIRKHPKASICTDEGLLNFKDIANFQDYHGLPEFRNAIASFMGKARGGRVKFDPSRIVMGGGATGASETVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLICDEIYSATVFKSPSFTSIAEIIEEMDHCKKELIHILSSLSKDMGLPGFRVGILYSYNDTVVSIARKMSSFGLVSSQTQHLLAAMLSDEEFVDNFLVENSKRLAKRHARFTEELEKMGITCLNSNAGLFVWMDLRKLLKDQSFESEMELWRVIINEVKLNVSPGSSFHVTEPGWFRVCFANMDDNTVGVALDRIHSFVGKIDKKENSTIPMPPKKKHRENKLRLSFSFSGRRYEEGNVLKSPHMMSPHSPLVRAKT

SEQ ID NO: 42079 - protein, 420 aa, Lotus japonicus
MVLSNTASSGSESDLSIHSTFASRYVRTSLPRFKMPQESIPKEAAYQIINDELMLDGNPRLNLASFVTTWMEPECDKLIMASINKNYVDMDEYPVTTELQNRCVNMIAHLFNAPLGDSDTVGTVGSSEAIMLAGLAFKRTWQNRRKAEGKPHDKPNIVTGANVQVCWEKFARYFEVELKEVKLSEGYYVMDPQKAVDLVDENTICVAAILGSTLNGEFEDVKRLNDLLIEKNKETGWDTPIHVDAASGGFIAPFIYPELEWDFRLPLVKSINVSGHKYGLVYAGIGWVIWRNKEDLPEELIFHINYLGADQPTFTLNFSKGSSQIIAQYYQLIRLGYEGYKHVMENCRDNMLVLKEGLQKTGRFEIVSKDNGVPLVAFTLKDHTHYNEFQISDSLALRVDSAGIQHAPKYSARDRGPCSH

SEQ ID NO: 42080 - protein, 454 aa, Erwinia amylovora
MVMSALQQRLTQWAQQHQRRLERYAPVSRYGRVTGISGILIECILPGARIGDLCRIQRSDGGSVLSEIVGFSPEKILLSALGALDGISQGATIVPLYLPHSICVSEQLLGSVLDGFGRALEPGGHSAFAEPGTQVRAVPVLNDAPPPTERPRITTPLPTGLRAIDGLLTIGNGQRVGIFAGAGCGKTTLLAELARNTPCDAIVFGLIGERGRELREFLDHELDDELRSRTVLLCATSDRSSMERARAAFTATAIAEAFRAEGKSVLLIVDSLTRFARAQREIGLALGEPPGRGGLPPSVYTLLPRLVERAGQTQQGAITALYSVLIEQDSMNDPVADEVRSLIDGHIVLSRRLAERNHYPAIDVLASLSRTMSNVVEPGHMMQAGRLRSLMAAYQQVEMLIRLGEYQPGNDSLTDAAVNANDIINRFLRQSMRAPDPFEQTQYQLAEVSAHAPD

SEQ ID NO: 42081 - protein, 277 aa, Brassica napus
EEEEAVMDIDSCDKKNPLAVVDYIDDIYDFYKNNECRSCVPPNYMENQPDINERMRGILVDWLIEVHYKFGLMEETLYLTINLIDRFLAVHHHVARKKLQLVGVTAMLLACKYEEVSVPVVDDLILISDKAYTRREVLDMEKLMANTLQFNFCLPTPYVFMRRFLKAAQSDQKVELLSFFIVELCLVEYEMLQYAPSLLAASAIYTAQSTLKGFEEWSRTCEFYTGYTEEKLMECSRKMAGLHHEAGTGKLTGVYRKYNTSKFGYASRTEPAGFLLL

SEQ ID NO: 42082 - protein, 2289 aa, Arabidopsis thaliana
MAGVNLQLRHAYSIAQFVPTVSSPPPLPTQRVRLGTSPSRVLLCNLRANSAAAPILRTTRRSVIVSASSVSSAVDSDSLVEDRDDVGRIPLLEVRDLRAVIAESRQEILKGVNLVVYEGEVHAVMGKNGSGKSTFSKVLVGHPDYEVTGGSIVFKGQNLLDMEPEDRSLAGLFMSFQSPVEIPGVSNMDFLNMAFNARKRKLGQPELDPIQFYSHLVSKLEVVNMKTDFLNRNVNEGFSGGERKRNEILQLAVLGAELAILDEIDSGLDVDALQDVAKAVNGLLTPKNSVLMITHYQRLLDYIKPTLIHIMENGRIIKTGDNSLAKLLEKEGYKAISDILMGNACVGPNISGNGFLQTVTAAMWRPRIGAEQASSSSHGNGQVSKEAASEPATDQVQNKPPEPITMPSSKTNPETKLKPDLEIQPEEKKEKVLAEETKQKVVPEESKQEVPPEESKREVVVQPESAKPETKSESKPETTKPETTSETKPETKAEPQKPKHMRRVSSAGLRTESVLQRKTENFKEFYSLGRKLGQGQFGTTFLCLEKGTGNEYACKSISKRKLLTDEDVEDVRREIQIMHHLAGHPNVISIKGAYEDVVAVHLVMELCSGGELFDRIIQRGHYTERKAAELARTIVGVLEACHSLGVMHRDLKPENFLFVSREEDSLLKTIDFGLSMFFKPDEVFTDVVGSPYYVAPEVLRKRYGPESDVWSAGVIVYILLSGVPPFWAETEQGIFEQVLHGDLDFSSDPWPSISESAKDLVRKMLVRDPKRRLTAHQVLCHPWVQIDGVAPDKPLDSAVLSRMKQFSAMNKFKKMALRVIAESLSEEEIAGLKQMFKMIDADNSGQITFEELKAGLKRVGANLKESEILDLMQAADVDNSGTIDYKEFIAATLHLNKIEREDHLFAAFSYFDKDESGFITPDELQQACEEFGVEDARIEEMMRDVDQDKDGRIDYNEFVAMMQKGSIMGGPIRSQFSCWLMASAARGESSNPYGGGLGTGGKFRKPTARRSQKTPYDRPTTSVRNAGLGGGDVRGGGWLSKLVDPAQRLITYSAQRLFGSLSRKRLGSGETPLQSPEQQKQLPERGVNQETKVGHKEDVSNLSMKNGLIRMEDTNASVDPPKDGFTDLEKILQGKTFTRSEVDRLTTLLRSKAADSSTMNEEQRNEVGMVVRHPPSHERDRTHPDNGSMNTLVSTPPGSLRTLDECIASPAQLAKAYMGSRPSEVTPSMLGLRGQAGREDSVFLNRTPFPQKSPTMSLVTKPSGQRPLENGFVTPRSRGRSAVYSMARTPYSRPQSSVKIGSLFQASPSKWEESLPSGSRQGFQSGLKRRSSVLDNDIGSVGPVRRIRQKSNLSSRSLALPVSESPLSVRANGGEKTTHTSKDSAEDIPGSSFNLVPTKSSEMASKILQQLDKLVSTREKSPSKLSPSMLRGPALKSLQNVEAPKFLGNLPEKKANSPDSSYQKQEISRESVSREVLAQSEKTGDAVDGTSKTGSSKDQDMRGKGVYMPLTNSLEEHPPKKRSFRMSAHEDFLELDDDLGAASTPCEVAEKQNAFEVEKSHISMPIGEKPLTPSEAMPSTSYISNGDASQGTSNGSLETERNKFVAFPIEAVQQSNMASEPTSKFIQGTEKSSISSGKPTSEEKRIPLEEPKKPAAVFPNISFSPPATGLLNQNSGASADIKLEKTSSTAFGVSEAWAKPTESKKTFSNSASGAESSTSAAPTLNGSIFSAGANAVTPPPSNGSLTSSPSFPPSISNIPSDNSVGDMPSTVQSFAATHNSSSIFGKLPTSNDSNSQSTSASPLSSTSPFKFGQPAAPFSAPAVSESSGQISKETEVKNATFGNTSTFKFGGMASADQSTGIVFGAKSAENKSRPGFVFGSSSVVGGSTLNPSTAAASAPESSGSLIFGVTSSSTPGTETSKISASSAATNTGNSVFGTSSFAFTSSGSSMVGGVSASTGSSVFGFNAVSSASATSSQSQASNLFGAGNAQTGNTGSGTTTSTQSIPFQFGSSPSAPSFGLSGNSSLASNSSPFGFSKSEPAVFTSVSTPQLSSTNSSASSSSTMSSPLFGTSWQAPNSSPNSGPVFSSSFTTSSTPTTFSFGGSSAATVSSTTTPIFGASTNNTPSPSPIFGFGSTPPTTPQQPVFGNSGTPSQSLFGNSTPGFAFGAPNNGNGINNNQQVSMEDSMAEDTDQANRASMVAPMFGQAAVSMPQPNFAFGGGAATQPPSMANPFQFGGQPMASTLQNASPFQASQSLEFQGGGSFSLGSTGGGDKSGRRIFKAKKSTRKK

SEQ ID NO: 42083 - protein, 505 aa, Brassica rapa
MDLLLLEKSLIAVFAAVVLATVISKLRGKKLKLPPGPMPIPIFGNWLQVGDDLNHRNLVDYAKKFGDLFLLRMGQRNLVVVSSPNLTKEVLHTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFDSEDDPLFIRLKALNGERSRLAQSFEYNYGDFIPILRPFLRGYLKICQDVKDRRLALFKKYFVDERKQIASWKPTGSEGLKCAIDHILEAQQKGEINEDNVLYIVENINVAAIETTLWSIEWGIAELVNHPEIQTKLRNEIDTVLGPGVQVTEPELHKLPYLQAVIKETLRLRMAIPLLVPHMNLNDAKLAGYDIPAESKILVNAWWLANNPESWKKPEEFRPERFFEEEAHVEANGNDFRYVPFGVGRRSCPGIILALPILGITIGRMVQNFELLPPPGQSKLDTSEKGGQFSLHILHHSTIVMKPRSF

SEQ ID NO: 42084 - protein, 492 aa, Prostanthera ovalifolia
  misc_feature (5)..(6): Xaa can be any naturally occurring amino acid
  misc_feature (49)..(50): Xaa can be any naturally occurring amino acid
RINPXXSGSGVSTLEKKNPGRIIQIIGPVLDVAFPPGKMPNIYNALVVXXRDTVGQPINVTCEVQQLLGNNRVRAVAMSATDGLTRGMEVIDTGAPLSVPVGGSTLGRIFNVLGEPVDNLVPVDARTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEGNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEME

SEQ ID NO: 42085 - protein, 159 aa, Brassica napus
GRPTRRTRGKQTKDDLFPHKAKKWFGESKKLDVATPGVAGSLPSNTLCVAREAKLKEIEEEQSRHAYSVAVATAAAADAAVAAAQAAAEVVRLTAVSRFPGKSKEDIAAIKIQTAFRGYMARRALRALRGLVRLNSLVQGKGVRRLTTSTLQSMQTLSL

SEQ ID NO: 42086 - protein, 463 aa, Microcystis aeruginosa PCC 7806
MVHLTPNPSYSLSLKIEIPNQAGTFASVLNAIADVGGNLGQISLIERNLKISTREIMVDAASTDQAEQIIAAVKALPDVKLLKVSDRTFDLHRRGKISIESRIPLTSQDDLAMAYTPGVGRICTAIAHQPEQVYSLTIKGNTVAVVTDGSAVLGLGNLGPEAALPVMEGKAMLFKEFAGIDAFPICLATQDPEEIIATVKRIAPVFGGINLEDIGAPRCFEIEKRLRAELNIPVFHDDQHGTAIVSLAALINALKLVKKSLDTAKIVINGAGAAGIAIATLFKTAGATDITLCDSLGILSQNRDDLTPEKQAWAVSASGKLGDALKGADVFLGVSAPGVLTPEMVKGMAKNAIVFAMANPIPEIQPELINDLVAVVATGRSDYPNQINNVLAFPGLFRGALDCRARAITDNMYLEAAKAIASLINPANLDRENIIPSVFDGRVVTAVAAAVQHAARQDGVAGE

SEQ ID NO: 42087 - protein, 572 aa, Arabidopsis thaliana
MSLVRTVTIVLFIIAFLQNAAAQKRQQSIVKSRGAVATDDGRCSVIGMRVLREGGNAIDASVAAALCLGVVSPASSGIGGGAFTVVKIAGGKEIAYDSRETAPLRATENMYGGNVDLKKKGALSVGVPGEVAGLFTAWKQHGKLPWKRLVTPAEKLAEGFKISKYLYMQMNATRSDILADKGLSDLFVSNGELKKPGTICHNPKLALTLKLIGEYGPKAFYNGTVGVNLARDIKKSGGIITLKDLQSYRVKIKEPLSADILGYRVLGMPPPSSGGAAMMLVLNILSQYGIPSGVSGPLGVHRLIEALKHAFAVRMNLGDPDFTDVTKVVSDMLSPKFAKDLKSKINDQKTFDPKYYGGMWNQIDDHGTSHLSIIDRERNAVSMTSTINGYFGALMLSPSTGIVLNNEMDDFSIPMKSNGNLDVPPPAPANFIRPGKRPLSSMSPTIVLKDGKVKAAVGASGGANIIAGTTEVYLNHFFLKMDPLSSVLAPRIYHQLIPNRASYENWTTVFNDHFEIPKATRVVLEKKGHVLSPIAGGTIAQFIVQESGENSGGRSELVAVSDPRKGGFPSGY

SEQ ID NO: 42088 - protein, 388 aa, Vibrio vulnificus CMCP6
MRITVVGAGYVGLANAALLAQYHSIILLDVDSKRVEQINAKSSPIVDVDIERFLSSGALQLTATTSPQIAYHDAQLIIVATPTNYDPITNGFDTTSVEQVIQDAIQISPNATILIRSTVPVGFTERMRTQVERRNILFAPEFLREGKALYDNLFPSRIVIGEQSERGQQIAELFANAAEKRDVPILLTNPTEAEAIKLFSNTYLAMRIAYFNELDSYAEAHGLDARQIIEGVGLDPRIGNHYNNPSFGYGGYCLPKDTKQLLANYQDVPNNIIGAIVDANRTRKDFVAESILKREPKVVGIYRLIMKAGSDNFRASSIQGIMKRIKAKGIEVVVYEPVLKEAEFFHSRVIKDLNEFKQTADVIVSNRMVKELTDVADKVYTRDLFGSD

SEQ ID NO: 42089 - protein, 419 aa, Arabidopsis thaliana
MLVPNKRFHYLLQFQMWCLPSVRPNVSEMFFKSPMLKPTARFSSTSSPYLPPSFSVAPMMDWTDNHYRTLARLITKHAWLYTEMIAAETLVHQQTNLDRFLAFSPQQHPIVLQLGGSNVENLAKAAKLSDAYGYDEINLNCGCPSPKVAGHGCFGVSLMLKPKLVGEAMSAIAANTNVPVTVKCRIGVDNHDSYDELCDFIYKVSTLSPTRHFIVHSRKALLGGISPADNRRIPPLKYEYYYALVRDFPDLRFTINGGITSVSKVNAALKEGAHGVMVGRAAYNNPWQTLGQVDTAVYGVPSSGLTRRQVLEQYQVYGDSVLGTHGNGRPNVRDLVKPLLNLFHSENGNSLWKRRADAAFKECRSVGSLLEESLRAIPDCVLDSPISGSPESGDEDVFADVHNVLPPPYEAGEEIILCA

SEQ ID NO: 42090 - protein, 124 aa, Listeria monocytogenes str. 1/2a F6854
MDKIYLNELVFYGYHGVLKEETKLGQTFRVSLILGLSTKKAGISDSVEDTVSYADVYETVKEIVEGTPFKLIEALAEKIATEVLTGYPLLEEVTVKLIKPNPPIPGHYDSVAVEIERKRSDLNG

SEQ ID NO: 42091 - protein, 463 aa, Arabidopsis thaliana
MMMRAVIRRAASNGSSPSLFAKSLQSSRVAASSPSLLSGSETGAYLHRGNHAHSFHNLALPGNSGISRSASLVSSTLQRWVRPFSAETGDTVEAVVPHMGESITDGTLATFLKKPGERVQADEAIAQIETDKVTIDIASPASGVIQEFLVNEGDTVEPGTKVAIISKSEDTASQVTPSQKIPETTDTKPSPPAEDKQKPRVESAPVAEKPKAPSSPPPPKQSAKEPQLPPKERERRVPMTRLRKRVATRLKDSQNTFALLTTFNEVDMTNLMKLRSQYKDAFYEKHGVKLGLMSGFIKAAVSALQHQPVVNAVIDGDDIIYRDYVDISIAVGTSKGLVVPVIRGADKMNFAEIEKTINSLAKKANEGTISIDEMAGGSFTVSNGGVYGSLISTPIINPPQSAILGMHSIVSRPMVVGGSVVPRPMMYVALTYDHRLIDGREAVYFLRRVKDVVEDPQRLLLDI

SEQ ID NO: 42092 - protein, 423 aa, Vibrio vulnificus CMCP6
MSFETISVIGLGYIGLPTAAMFASRKKKVIGVDVNQHAVDTINQGKIHIVEPDLDMMVHAAVSGGYLKATTTPEAADAFLIAVPTPFLPCAEGEIPAPDLSYIEAASKAIAPVLKKGDLVILESTSPVGATEQMAAWLAEARSDLTFPQAHGEDADVNIAHCPERVLPGHVVRELVENDRVIGGLTAKCSARAVELYKTFVQGECVVTNARTAEMAKLTENSSRDVQIAFANELSIICDKLDINVWELIALANRHPRVNILQPGPGVGGHCIAVDPWFIVSKTPEEAQIIHTARKVNDSKPQWVINKVKLAIADFLQANPDKTAKDVTIACYGLAFKPDIDDLRESPAMAITQKIAEMHNGRVIAIEPNIDVVPKKLENVELTSLDFAKLEASIHVMLVDHTNFKVSDIPSNGIVVDTKGVWG

SEQ ID NO: 42093 - protein, 1129 aa, Mesotaenium caldariorum
MESSTGLVAGSRNRNQFVVIPADEEQRRNVTTPAASVCQICGDDVGLSATGELFVACVECGYPVCRPCYEYERKEGSKACPQCKTVYKRLKGSPRVPTDEEDDDIEDLENEFRGHSHVAHKSHDQHDHDHLDDVESVRSGRNTHDPYATYEPYRVQPQVPLLTDAHYETGSEYGGHTTNSDYGGHGVGSDYGGKTNPSEYSHHHHSHHQAIMVPGGQPGSDAGVHAGSFVNGDGISAKSADPKDPASFGYGSIAWKDRVDAWKQRQDKMQMTTAPGGVLVDANKGGPGGPEDPYNGGNDLPLMDESRQPLSRKVDFNMGLIQPYRLMIVIRLVVLAFFLRYRILNPAPSRPLWMTSVICEIWFAVSWILDQFPKWMPINRETYLDRLNLRFEKEGEPSQLQAVDLFVSTVDPEKEPPLTTANTLLSILSIDYPVDKVSCYLSDDGAAMLTFEALSETSEFARRWVPFVKKYNIEPRAPEMYFSQKIDYLKDKIQPSFVKERRIMKREYEEFKVRINALVSKSMKVPEDGWTMQDGTPWPGNNSRDHPGMIQVFLGPSGGLDTDGNALPRLVYVSREKRPGFNHHKKAGAMNALIRVSAVLTNAPYILNLDCDHYVNNSKALRHAMCFMMDPNVGKKVCYVQFPQRFDGIDRSDRYANHNTVFFDINLRGLDGLQGPVYVGTGCCFRRHALYGYEPKKKESSRGCCSMVFCGCCGLCGRKKEKSAVDNPLKTGKFKGSDPSLPMYNIDDLEDGDGQERESLVALKQFEKRFGQSPVFVLSTFHEEGGSVASSSASSTLKEAIHVISCGYEDKTEWGKEVGWIYGSVTEDILTGFKMHCRGWRSIYCMPKIAAFKGSAPINLSDRLQQVLRWALGSVEIFLSRHCPIWYGWSGSRLKLLQRLAYINTVVYPFTAFPLLAYCTLPAICLLTNQFIIPEISSLNSLWFIALFISIFACAFLEMRWSGVGMEEWWRNEQFWVIGGVSSHLYAVFQGLLKVLAGIDTNFTVTAKAADDGEAYADLYLFKWTSLLIPPTTLIIINLIGAVAGVANAINNGYDQWGPLFGKLFFAFWVVVHLYPFLKGLMGKSNRTPTLIIVWSVLLASIFSLLWVKINPFTNTTNGPALVQCGIRC

SEQ ID NO: 42094 - protein, 280 aa, Bruguiera gymnorhiza
MAKEVSEEGHAPHGKDYVDPPPAPLIDWAEVKLWSFYRAVIAEFIATLLFLYVTIATVIGHKKQTGPCDGVGLLGIAWAFGGMIFILVYCTAGISGGHINPAVTFGLFLARKVSLIRALAYMVAQCLGAICGVGLVKAFMKHSYNSLGGGANFVNAGYNKGTALGAEIIGTFVLVYTVFSATDPKRSARDSHVPVLAPLPIGFAVFMVHLATIPITGTGINPARSFGAAVIHNNDKIWDDQWIFWVGPFVGALAAAAYHQYILRAAAIKALGSFRSNRSN

SEQ ID NO: 42095 - protein, 500 aa, Moritella sp. PE36
MNNVIGHLINGEMVETNISDNTRTQDIFNPATGQAEKKVALASKQTVEQAISAAEAAFPQWRNTPAIKRARVMFRFKELLEKNADTICRLIGEEHGKISHDAAGELQRGIENVEYACGAPELLKGEHSKNVGPNIDCWSEFQPLGVVAGITPFNFPAMVPMWMFPLAIVCGNCFILKPSERDPSSTLFIAQLLKEAGLPDGVMNVVNGDKEAVDALLNDERVKAVSFVGSTPIAEYIYSTASANGKRCQALGGAKNHAIIMPDADMDNAVNQLLGAAFGSSGERCMALSVAVAVGDAAADSLVAKMAVAMKDLRVGAYDNASNDFGPVITQAHKDKVEGYITSAENQGAKIVVDGRQPVVKGYENGFFVGATLIDGVTPEMDSYEAEIFGPVLQVMRVKTMQEAMQLINDHEYGNGTCIFTRDGEAARYFSDNIQVGMVGINVPLPVPVAYHSFGGWKRSLFGDLHAYGPDGVRFYTKRKTITQRWPSSGVREGASFAFA

SEQ ID NO: 42096 - protein, 333 aa, Propionibacterium acnes KPA171202
MIAGSIEELDENSQFVRLKNSFPKHDVYAKLEGLNTAGSVKLKTAIALVDSLEKLRGLQPGGWVVESSSGSLGIALSGVCARRGYKLTIVTDVNANSRSISHMRALGAEVEVVQSLDAAGGFLGTRLARVRELVEMPGGPLWTNQYENVANPEVHSKKTYRAIVEELGDPDYLFVGAGTTGTLMGVSRAVMKRGSCTKVCAIDSTGSVTFGGAPSRRYIPGLGASVKPPIFDEKFPLKRYYIDEIDTVRQCRRIAQVEGFLPGGSTGTVLAAFDALRDKIPEGSRVVIIAPDLGERYLDGVYNDDWVMENFGESAFNYAIRPVAHEVKETEGI

SEQ ID NO: 42097 - protein, 444 aa, Moritella sp. PE36
MNNQATHGISQAQLDAHWMAFTGNREFKKDPRIIVSAEGNYYTDADGRKIFDGLSGLWCCGVGHSRPEITEAVSKQIKQLDYAPAFQFGHPKSFELAEKIVEFMPKGLNRVFYTGSGSEAVETSLKMARAYWRKKGMGSKTKLIGRGLGYHGVNFGGISVGGIAANRSLYGPAVEADHLRHTMQSENTFVKGQPKTGYELANDLLDLVALHDASNIAAVIVEPMAGSAGVIPPPVGYLNRLREICDQHNILLIFDEVICAFGRMGANTGAEAFGVTPDIINVAKQMTNGTIPMGAVIAKQEIYDTFMEHGGPEYMLEFPHGYTYSAHPVACAAGLAALEILQKDKLIERVKDHSSYFEEMVHSLRGCKHVTDIRNYGFAAGFTIAPIAGEPGLRPYQIAMKMWQKGFYVRYGGATIQLGLPFTSEREEIDSLINALGETFNEIV

SEQ ID NO: 42098 - protein, 290 aa, Triticum aestivum
MAKDEVMETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFRAPTSSGTAAAPTRSPPATPRAPASLRRSSGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 42099 - protein, 491 aa, Escherichia coli O157:H7 EDL933
MAVTQTAQVCDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 42100 - protein, 480 aa, Escherichia coli O157:H7 EDL933
  misc_feature (284)..(284): Xaa can be any naturally occurring amino acid
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGINYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITAXQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 42101 - protein, 443 aa, Photorhabdus luminescens subsp. laumondii TTO1
MSKTHYSESLNLKSHWMPFSANRSFQRDPRLIVAAEGQWLKDDKGRQIYDSLSGLWTCGAGHTRTEIQQAVAAQLSTLDYSPGFQFGHPLSFQLAEKIANLTPGDLNHVFFTSSGSESVDTAVKMVRAYWRVKGQPEKTKLIGRALGYHGVNIAGTSLGGIGGNRKMFGQLMDVDHLPHTLQTDMAFTPGMAETGGAELANEMLKLIELHDASNIAAVIVEPVSGSAGAIIPPKGYLQRLREICDQHNILLIFDEVITGFGRMGRWTGAEYFGVTPDLLNFAKQITNGAIPLGGVVASSEIYEAFMSQSLPEHSVEFSHGYTYSAHPVACAAGLATLDLLDKNHLIQRSAELAPHFETALHALRNCPNVTDIRNCGLVGAIELAARDGDTAVRPFDASMALWKAGFYVRFGGDTLQFGPMFNAERADLDRLFDAVGEVLHHID

SEQ ID NO: 42102 - protein, 151 aa, Oryza sativa Japonica Group
MALEQTFIMIKPDGVQRGLIGEVIGRFEKKGFYLKAMKLINVEKSFAEKHYADLSSKPFFGGLVEYIVSGPVVAMVWEGKQVVSTGRKLVGATNPLAAEPGTIRGDFAVDIGRNVIHGSDSVENARKEIALWFPEGIAEWRSNQHPWIYEV

SEQ ID NO: 42103 - protein, 393 aa, Triticum aestivum
SLPAYYLSCHTSEPPPQSTFVPFRSASLPTLSWPARPSPPRDSPRPLRSCALAAPPWVAVPLAPSGLRHHRRSVAMAAGAAPSPIPASDPLPKGSDLFFRSVLSNMQKVYLSRNPTAEKILDLVHSYDGDHICFDHFAFRTFGVDGYGINSLAEFFTDFGYESREELRFPAKKLRALWFSPPNNDGYTRAGIYGPLPRIFISELLVDELSAPSQEIIRKYIKTSANGNKYAVLASTFGELTWEKPTYSDFQVLSRESEYAGWTLVNGYALNHATVSTHRLESDIRSISKFNKFVEDNGFKLNTEGGILKVSPDGLLQQSSTVADSSLFTFADGITESIPRSYIEFAERLPLPQFRDLQDEEVKEHHRRDGFEVGNADKIFESTSKDQLTRRSA

SEQ ID NO: 42104 - protein, 386 aa, Rickettsia conorii str. Malish 7
MNIHEYQAKEILRKYGVPTSTGLVVTKTEKINETIDKLNTEVYVVKAQIHAGGRGKAGGVKVVKSKEEAKKVAHDMFGINLVTHQTGPQGQKVNRLYIESGCDILKEYYFSIVFDRSASCITFIASTEGGIDIEAVAEKTPDKIIKFSVDPATGLQDFHMRGIAYELGFKDNQAKQMKEIVKSVYNAFIETDATQIEINPLIVNSDGNLLALDAKITFDDNGLFRHPNITAMRDHDEEDPLETRAANAGLSYVKMDGNIGCMVNGAGLAMATMDIIKLYGASPANFLDVGGGADRERVKEALKIILSDKEVQGILVNIFGGIMRCDIIAEGIIAAAKDIGIKVPLVVRLAGTNVEKGEEILSNSGLAIIPAHDLADAANKIVEAIR

SEQ ID NO: 42105 - protein, 368 aa, Papaver rhoeas
MATYVDPPNGTGSPGKHYYSMWQTVFEIDTKYVPIKPIGRGAYGIVCSSVNRETNDKVAIKKIQNAFENRIDALRTLRELKLLRHLRHENVIALRDVMMPTHRRSFKDVYLVYELMDTDLHQIVKSSQPLSNDHCQYFLFQLLRGLKYLHSANILHRDLKPGNLLVNANCDLKICDFGLARTCSGKGQFMTEYVVTRWYRAPGLLLCCDNYGTSIDVWSVGCIFAELLGRKPIFPGTECLNQLKLIINVLGSQSEADLEFIDNPKARKYIKSLPYSPKTPFARIYPNASPLAIDLLQKMLVFDPSKRISVTEALQHPYMSPLYDPNADPPAQVPVDLDIDEEDLGEETIREMMWTEMLHYHPEAVSSN

SEQ ID NO: 42106 - protein, 535 aa, Staphylococcus epidermidis RP62A
MLQVTDVSLRFGDRKLFEDVNIKFTEGNCYGLIGANGAGKSTFLKILSGEIDSQTGHVSLGKDERLAVLKQDHFAYEDERVLDVVIKGHERLYQVMKEKDEIYMKPDFNDEDGIRAAELEGEFAEMNGWNAEADAANLLSGLGIEPDLHDKNMSELENNQKVKVLLAQSLFGDPDVLLLDEPTNGLDIPAISWLEDFLINFENTVIVVSHDRHFLNNVCTHIADLDFGKIKLYVGNYDFWYQSSQLAQKMAQEQNKKKEEKMKELQDFIARFSANASKSKQATSRKKQLEKIELDDIQPSSRRYPYVKFTPEREIGNDLLTVENLSKTIDGEKVLDNVSFTMNPNDKAILVGDSEIAKTTLLKILAGEMEPDEGTFKWGVTTSLSYFPKDNSEFFDDVDMNLVEWLRQYAPEDEQTETFLRGFLGRMLFSGEEVKKKASVLSGGEKVRCMLSKMMLSSANVLLLDEPTNHLDLESITAVNDGLKSFKGSIIFTSYDFEFINTIANRVIDLNQAGALSKEVPYEEYLQEIGVLQNN

SEQ ID NO: 42107 - protein, 347 aa, Lactobacillus reuteri
MERKSLDEINGSVDVPNVYQSAFWQKFLAYSGPGALVAVGYMDPGNWLTSLAGGSQYRYQLLVVLFTAILIAMYMQSLAIKLGVTTRTDLAQAIAWRLPTPLRIALWLFNEIAMMATDLTGVVGTAVALNMLFKLPLLIGVLLTIADVLVVLFFLHFGIRRIEFIVLTAILVVGAIFAIEVCRAHPEFSAIMDGFVPRSTIFTNHSELLISLGIVGATIMPHNIYLHSSLAQSRRYDEHDPKQVKETLRFANWDSLIHLFAAFVVNALLLILGGTLFFHAASLGSLEDVFFGLKNPQIVGSLASPLMSWLFAFALLVTGLISSITSTLAGQIVMEGFINIRLPLWKR

SEQ ID NO: 42108 - protein, 429 aa, Oryza sativa Indica Group
MAGAVSALFLLDIKGRVLVWRDYRGDVSALQAERFFTKLLDKEGDSEAHSPVVYDDAGVTYMFIQHNNVFLLTASRQNCNAASILLFLHRVVDVFKHYFEELEEESLRDNFVVVYELLDEMMDFGYPQYTEAKILSEFIKTDAYRMEVSQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFIPPDGSFDLMTYRLSTQVKPLIWVEAQIEKHSRSRIELMVKARSQFKERSTATNVEIEVPVPSDATNPNIRTSMGSAAYAPEREAMVWKVKSFPGGKDYMCRAEFSLPSITAEEAAPEKKAPIRVKFEIPYFTVSGIQVRYLKIIEKSGYQALPWVRYITMAGEYELRLI

SEQ ID NO: 42109 - protein, 365 aa, Arabidopsis thaliana
MGESITDGTLATFLKKPGERVQADEAIAQIETDKVTIDIASPASGVIQEFLVNEGDTVEPGTKVAIISKSEDTASQVTPSQKIPETTDTKPSPPAEDKQKPRVESAPVAEKPKAPSSPPPPKQSAKEPQLPPKERERRVPMTRLRKRVATRLKDSQNTFALLTTFNEVDMTNLMKLRSQYKDAFYEKHGVKLGLMSGFIKAAVSALQHQPVVNAVIDGDDIIYRDYVDISIAVGTSKGLVVPVIRGADKMNFAEIEKTINSLAKKANEGTISIDEMAGGSFTVSNGGVYGSLISTPIINPPQSAILGMHSIVSRPMVVGGSVVPRPMMYVALTYDHRLIDGREAVYFLRRVKDVVEDPQRLLLDI

SEQ ID NO: 42110 - protein, 499 aa, Polaromonas sp. JS666
MKNSGNDPAVKPVAERKQLRHYVDGAFVGSEVTFSNINPVDGTLIAEVCEANASTVDQAVRAAQAALKGPWGRLSVQERAAVLHKVADGILARFEEFVEAEVADTGRPVHQARTLDIARAIANFRTFADLAKTANTDLFEMATADGAGALNYTVRKPLGVIGVISPWNLPLLLFTWKVAPALACGNTVVAKPSEESPSSATLLAEVMHDAGVPPGVFNLIHGFGKDSAGEFLTRHPGISALTFTGESKTGSTIMKSVADGVKEVSFELGGKNAAVVFADTDFDAAVAGVLRSAFTNSGQVCLCSERVYVQRPIFDKFVAALKAGTERLKIGYPHDDGVDIGPLISHGHRDKVLSYYKLAVEEGATVVTGGGVPSFGDARDAGAYVQPTIWTGLTDSARCVTEEIFGPVCHIAPFDNEEEVIARVNDSVYGLACAVWTTNLSRAHRVSRQIHVGLVWVNTWYLRDLRTPFGGVKLSGLGREGGRYSLDFYSDVANICIKL

SEQ ID NO: 42111 - protein, 598 aa, Oryza sativa
  misc_feature (24)..(24): Xaa can be any naturally occurring amino acid
MGGEAPEARRLDRAMSFGGAGSIXPEEALHLVLGYVDDPRDREAVSLVCRRWHRIDALTRKHVTVPFCYAASPAHLLARFPRLESLAVKGKPRAAMYGLIPEDWGAYARPWVAELAAPLECLKALHLRRMVVTDDDLAALVRARGHMLQELKLDKCSGFSTDALRLVALSCRSLRTLFLEECSIADNGTEWLHDLAVNNPVLETLNFHMTELTVVPADLELLAKKCKSLISLKISDCDFSDLIGFFRMAASLQEFAGGAFIEQGELTKYGNVKFPSRLCSLGLTYMGTNEMPIIFPFSALLKKLDLQYTFLTTEDHCQLIAKCPNLLVLAVRNVIGDRGLGVVADTCKKLQRLRVERGDDDPGLQEEQGGVSQVGLTTVAVGCRELEYIAAYVSDITNGALESIGTFCKNLCDFRLVLLDREERITDLPLDNGVRALLRGCTKLRRFALYLRPGGLSDTGLGYIGQYSGIIQYMLLGNVGETDDGLIRFALGCENLRKLELRSCCFSEQALARAIRSMPSLRYVWVQGYKASKTGHDLMLMARPFWNIEFTPPSSENANRMREDGEPCVDSQAQILAYYSLAGKRSDCPRSVVPLYPA

SEQ ID NO: 42112 - protein, 239 aa, Mesotaenium caldariorum
DQFPKWNPINRETNLGRLQLRYGDALDAVDLFVSTVDPGKEPPLTTANTLLSILAMDYPVEKLNCYLSDDGASKLTFDAVNETSGFAKKWVPFCKKFAVEPRAPEAYFAQKADFLKGQVQSSFVNERRNMKKEYEEFKVRINHLVSDFQNVPEDGWTMADGSYWPGNNARDHPGMIQVFLGPSGGKDVEGNALPRLVYVSREKRPGFNHHKKAGAMNALIRVSALLTNAPHILILDCDH

SEQ ID NO: 42113 - protein, 470 aa, Yersinia pestis biovar Microtus str. 91001
MKLHLAISSGLGRSGASRNMSFDSLGLNADILRAVEEQGYLVPTPIQRQAIPVVLEGRDLMASAQTGTGKTAGFTLPLLQLLSQDQQPIKGRRPVRALILTPTRELAAQIDENVQSYSKYLKLRSLVVFGGVSINPQMMKLRGGVDILVATPGRLLDLEHQNAVDLSKIEILVLDEADRMLDMGFIHDIRRVLAKLPAKRQNLLFSATFSDEIKGLASKLLHNPASVEVARRNTASEQIAQSVHFVDKNRKRELLSQMIGEGNWQQVLVFNRTKHGANHLAEQLNKDGITAAAIHGNKSQGARTRALADFKDGKIRVLVATDIAARGLDIDQLPHVVNYELPNVPEDYVHRIGRTGRAERTGEAISLVCVDEHKLLRDIERLLKREIPRIALDGYEPDPSIKADPIQNGRQGRGAQRPGMGRGSSAGRPQNGGGAAGRGDSRNSRPRSQADGQRRPAGPSSRGRSRNPGE

SEQ ID NO: 42114 - protein, 312 aa, Paeonia suffruticosa
MANFPVINLEKLNGGERAATMEIINDACENWGFFEIVNHGISPEFMDTVEKLTKEHYKKCMEQKFKELVASKALETEINDMDWESTFHLRHLPISNMAEIPDLDDEYRKVMKEFASKIETLAEELLDLICENLGLEKGYLKKAFYGSKGPTFGTKVSNYPPCPKPDLIKGLRAHTDAGGLILLFQDDRVSGLQLLKDDQWVDVPPMRHSIVINIGDQLEVITNGKYKSVMHRVIAQTDGNRMSLASFYNPGSDAVIYPAPALLGKEAQVYPKFIFEDYMKLYAGLKFQAKEPRFEAMKAVEESVKLGPIATA

SEQ ID NO: 42115 - protein, 326 aa, Magnaporthe grisea 70-15
MAQTPLITVLGSLNIDLVSYVPHHPLPGETLTANSFAVSPGGKGANQAIACAKLSRPQSDKTAATANVRMVGAVGADSYGSLLRSNLEGHGVDVSGVAVRADPAKTGLAIIVVDEPTGQNRIILSPESNHDLDKAVAIEAGLKDKPDLLIMQLEVPIPVVLEAMQAARTASIPCLLNPAPAVELPASAFEGLEHLIVNETEASVLGRVAESVLDTEEGLRSVADGFVKAGVRNVVITLGGRGVYFLQGWTGKAALVPALKATVVDTTAAGDTFVGMYALAAVAASKAGVDFDAEAAVRTANKAAAKTVERKGAQDSIPWRDELEGQ

SEQ ID NO: 42116 - protein, 154 aa, Ashbya gossypii ATCC 10895
MLGFRQTATAIVRPVGTIGYARRCYHPKVIDHYTNPRNVGTLDKKLTNVGTGLVGAPACGDVMRLQIQVDDSTGVIENVKFKTFGCGSAIASSSYMTELVRGKTLADAEKIKNTEIARELSLPPVKLHCSMLAEDAIKAAIKDYRSKRKATELR

SEQ ID NO: 42117 - protein, 398 aa, Prochlorococcus marinus str. MIT 9303
MATSRRLGRLGRGVFDRNDRRKQAYRLANAGPQSLSLLDLSLGSTDLSPPAVALEAIEVALRAPESSSYCLHASTRPFREAVAAWSQRRFGVSVDPDREVLLLVGSQEGTAHLPLAVLDPGDSALILDPAYPSHRGGLILADARIERLLLRPEQEWRPDFNALSNSQWDQLRMMVFGFPHNPTAQVGEQSWLVEAMDRGIRHQVVVAHDNPYVDLALDGEAPALLRCPGWRECGIEFFSFSKAWCLGGFRLAFAIGAEHLITALRELKGVVDFNQSLALQRGAIAALTDAQDWPQEILGVYRERRDRTLAALHALGWHAPCPSMALYLWLPIPAWAKQQNYNDETLAADLLDQTGLALTPGSGFGSGGDGWLRLALVHPVEDLEAAVARMRPWWHAHI

SEQ ID NO: 42118 - protein, 571 aa, Yarrowia lipolytica CLIB122
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 42119 - protein, 509 aa, Camptotheca acuminata
MAVLLLFLPLIFIFLAYKLYQRLRFKLPPGPRPLPFVGNLYSVKPVKFRCFAEWAQVYGPIMSVWFGSTLNVVISNSELAKEVLKENDQHLADRERNRSSNSFSRGGKDLIWADYGPHYVKVRKLCTVELFTPKRLEALRPIREDEVTAMVDSIFKDSANPDNYGKSLLVKQYIGAVAFNNITRLVFGKRFMNSEGVMDEQGKEFRGIVANGVKIGGLRFIGEHIPWLRCMFPQEEEILVKHEARRDRLTRAIMEEHTLARKHSGGAKQHFVDALLTLQKEYELSDDTVIGLLWDMITAGMDTTSISVEWAMAELIKNPRVQQKAQEELDRVIGYERIMSETDFPNLPYLQCVAKEALRLHPPTPLMLPHKANSNVKIGGYDIPKGSIVHVNVWAIARDPATWKDPHEFRPERFLEEDVDMKGHDFRLLPFGAGRRICPGAQIAINLITSMLGHLLHHFSWAPPEGVKPEEIDMTENPGLVTFMKTPVQAVAKPRLPSHLYKRVAVGAV

SEQ ID NO: 42120 - protein, 457 aa, Glycine max
MACEVPIKSMMSSAVTLLTPRHVAVIGAGAAGLVAARELRREGHRVVVFEKGEEVGGMWVYSPEVDSDPLGLEAKRRLVHSSLYDSLRTNLSRESMSFRDYPFRRREGKGRDSRRFPGHREVLLYLQDFAAEFEIGELVRFGTEVLFAGLDQCGKWRLTSTSPHTHPVDEIYDALIICNGHYVQPRLPHIPGINAWPGKQMHSHNYRTPEPFQDQVVVLIGSSASAVDISRDIATVAKEVHIAARSVEEDKLGKVPGHENMWLHSMIDSVHEDGTVVFQDGNAVGADFIIHCTGYKYDFPFLETNGEVTVDDNRVGPLYKHVFPPALAPWLSFVGLPWKVAPFSLFELQSKWIAGILSNRIALPSKEEMAKDVDAFYSSLVVLCTPKRNTHNMGILQWDYNNWIADQCGVPSIEEWRRQMYIATSKNRVLRPESYRDEWDDDDLVLQAQQDFANYLT

SEQ ID NO: 42121 - protein, 615 aa, Arxula adeninivorans
MKLLSLVPMALAAVATAKTVEYDFHVNWTTANPDGLYERKVIGINGQWPLPRIEVDKGDRLVVNMYNDMPDRNASIHFHGMYQNGTNYMDGPVGVTQCPVPPGGKFTYNFTVDQNGTYWYHSHVDGQYPDGYRAPFIVHDKNFPYDYDEELVLTMSDWYHDLIDYLNKEEFLTLYNPTGAEPVPQAMLFNDTQKLSVSVKPNTTYLVHLMNIGALGAQYFYIEDHNVTVVEIDGVYTEPAETDILYLAVAQRYTFLLKTKDTTDKNYPMVSIFDENLFDVIPSDLGMNMTNWLEYNSDADHPEADIPWESSVDIEYFDDMDLVPYDHKPLYTNVSKRIELEVVMTNLDNGVNYAFFNNITYTAPKVPTLMTALSAGDLVTNELVYGEYTHTVVVNHLDVVEIVVNNNDAGFHPFHLHGHEFQVVERSPEYEGFVPYNPDNHTDSDFAEYPMRRDTAWVPPNGNMVLRFVADNPGAWFFHCHIDWHLTQGLAMVFVEAPEKLKDMTLPQSHKDTCDAVGMPWKGNAAANDDDFLDLTGQNAQAPDLPAGFTARGIVALVFSCISAFLGMGMITWYGLSDISNTERKVLEREGVISEGEQVDPIDPSTVAHPHHHEN

SEQ ID NO: 42122 - protein, 109 aa, Solibacter usitatus Ellin6076
MGFRAGTHATCGISAKVAKINAFTKIPGGIMAVEQKVKQIIVEQLGVDESQVDSNASFVDDLGADSLDIVELVMAFEEAFELEIPDEDAEKITTVKDAVDYIEGKTTKK

SEQ ID NO: 42123 - protein, 400 aa, Staphylococcus epidermidis RP62A
MNRSVLKFGGSSVSDFKKIKNIAEMLKTRIEDGEELIVVVSAMGKTTDQLMNNVSSLTSTPKDQELALLLTTGEQQTVSYLSMVLNDIGVNAKAMTGYQAGIKTVGHHLKSKIAEINPNIFDEAFKDHDILVVAGFQGINDDFELTTLGRGGSDTTAVALAASNQIPCEIYTDVDGVYATDPRILNEAKRLEYVSYEEMMEMSALGAGVLETRSVELAKNYDIPLYLGRTLSNMKGTWIMSKSDLLEKKAVTGVALDTHMMHVTISYPLPDNQLLTQLFTALEEESVNVDMISQIVNLEGLQLSFSIKDSDAHQISSILENLSIHFSALDYKINEAYVKISLIGSGMRDMSGVASKAFMTLINSDIPFYQTTTSEISISYVIDEENGEKAVEELYHAFEI

SEQ ID NO: 42124 - protein, 292 aa, Photorhabdus luminescens subsp. laumondii TTO1
MSLVPFKQVDVFTHRPFKGNPVAVVMDAQELSSIQMQGIANWTNLSETTFILPAENPLADYRVRIFTPGSELPFAGHPTIGTAHALLEAGLIQAREGRIVQECGAGLITLNVTERDEGQKLITFELPEPTITPLSSEQIDRLESILDCPLDRALTPALIDVGARWIVAHTTGAEAVLATKPDYARLLEHDTQMNITGVCLYGAYHEGAEADIEVRSFAPSCGVNEDPVCGSGNGSVAAFMRHHKVAMIDDKIVHSSQGKKLGRQGSVWLSHSDGKIFVGGSAVTCINGTITI

SEQ ID NO: 42125 - protein, 67 aa, Zea mays
NKLFPVNPAPKVLRAMQFMTENRFSPIPVLDGRGMRGMVSFGDFVRGVVAEPRGEVTRLNDYIQGGY

SEQ ID NO: 42126 - protein, 464 aa, Pseudomonas syringae pv. tomato str. DC3000
MAVYNYDVVVLGSGPAGEGAAMNAAKAGRKVAMVDSRREVGGNCTHLGTIPSKALRHSVKQIIQFNTNPMFRAIGEPRWFSFPDVLKNAEMVISKQVASRTSYYARNRVDVFFGTGSFADETSVNVVCANGVVEKLVANQIIIATGSRPYRPADIDFSHKRIYDSDTILSLGHTPRKLIIYGAGVIGCEYASIFSGLGVLVELVDNRDQLLSFLDSEISQALSYHFSNNNVMVRHNEEYERVEGLDNGVVLHLKSGKKIKADALLWCNGRTGNTDKLGLENIGLKANGRGQIEVDEAYRTSVSNVYGAGDVIGWPSLASAAYDQGRSAAGSMVDNGSWRYVNDVPTGIYTIPEISSIGKNEHELTQAKVPYEVGKAFFKGMARAQISGERVGMLKILFHRETLEVLGVHCFGDQASEIVHIGQAIMSQPGEANTIKYFVNTTFNYPTMAEAYRVAAYDGLNRLF

SEQ ID NO: 42127 - protein, 467 aa, Agrobacterium tumefaciens str. C58
MTIDIKNIAEMDRNAVLHPFTQLKDFASGKLGEPTIVETGKGIRIQDAHGKQLIDGFAGLYCVNVGYGRTEVAEAISRQAYRLAYYHSYAAHTTDELAILSDRLVRMAPGKMSKVFYGMSGSDANETQAKLVWYYNNLRGKPQKKKIISRERGYHGCSVVAGSMTGMSFYHDHMDLPRVGILHTGVPHHYWGAEAGETELEFSKRRAAELEALILREGPDTIGAFIAEPVLGTGGITPPPEGYWPAIQEVLKKYDVLLIADEVITGFGRTGSMFGSQHYGIEPDLITVAKGLTSAYFPLSGAIVGEKVYTVMEDGADRVGAFSHGYTYSGHPIGAAAANAVLDIVEKEDLPGNAQAVGSYFQEQLKAKFAQLPIVGEVRGVGLMGAIEFVADREKKTRFAPHLTVGARVSKAARNGGLIARAMPHGDILGFAPPLVTTKAEVDEIIAIAEAAVRTVMDDLVQAGEKI

SEQ ID NO: 42128 - protein, 165 aa, Zea mays
CKITVVPANWPASEVLNLKPNGVLFSNGPGDPAAVPYAVKTVQDIIGKVPVFGICMGHQLIGQALGGKTFKMKFGHHGGNHPVCDLRSGRVDISAQNHNYAVDPESLPEGAEVTHVNLNDNSCAGLQYAKMKLVSLQYHPESSPGPHDSDTAFGEFIELMKSNRL

SEQ ID NO: 42129 - protein, 201 aa, Triticum aestivum
  misc_feature (40)..(40): Xaa can be any naturally occurring amino acid
  misc_feature (60)..(60): Xaa can be any naturally occurring amino acid
MASHLDFRYLDEGLGGERGKRKRREEEADAADSMDLDADXAPRPSKLRAVASQSDPSKPXAAFGSPTYDGVIAGRVSGRTWKEPRTRRSSALMVSRKPVPLEQRVRDKSLKKAYQARVAELKDEIRQNKVAKRKQKEEREKRKKENVLRTGSKLQKVTNPKTIQKIAKSKNRGQLRVVSDDIFGGKKSEAARRMQVPGLEN

SEQ ID NO: 42130 - protein, 492 aa, Agrobacterium tumefaciens str. C58
MKGIASAALKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 42131 - protein, 497 aa, Solibacter usitatus Ellin6076
MSIFRTKSIDALIAASEDPEKKLRRTLGPWSLTAFGIGAVIGSGIFILTGTAAAGETLNYKSILHAPVLDLIMHGTQALSMTGRQGAGPAITLSFLLTAIACSFAALCYAELASMIPIAGSAYTYAYATLGEIIAWIIGWDLILEYAVSNMAVAVGFSAYLNDVLDNVFGWHIPAKFANPPIAEGQLTGAWFNISALLVLMILTWILVKGVKESASTNNAMVAIKIAAILIFVIGAAKAVDTSNWKPFAPHGFPGVLTGAAIVFFTYIGFDSVSTAAEECKRPQRDLPLGIILTLIICAILYILVALVLTGIARYDTLNNAAPVANALKVLGYNGIRQWVSLGALVGMLSSLLVFQYGQARIWFAMSRDGLLPKMFSKVHPVYKTPHISTWIAGLVVGIPAGIWDIGTFADLANIGTLFAFIIVSVGVIVLRRTQPDRPRGFRVPGGGFLPVISIVFCLILMMALPLETWVRFFVWLLIGFAIYFPFGRKNSALARR

SEQ ID NO: 42132 - protein, 83 aa, Triticum aestivum
VAGNTSARREILDIAEDVFRAKTVDVSGHTITLQLTGDLDKMVALQRLLEPYGICEIARTGRVALCRESGVDSKYLRGYSLPG

SEQ ID NO: 42133 - protein, 600 aa, Oryza sativa Japonica Group
MDFTNLLITVLLLLAPLKYKSDVATASDDEDFFKTCSSHRCSKHGPEIRYPFRLSTQPPSCGAPGMQLSCSGQDTILDHPVLGSCKVTMIYYRHVIMNAIPLVDSSPHCLLHKFISVNQSTAVYRPHTLKAASLVGCSRDSIDTNQYNSIVGPTSCLSLANNASQFWYLAYPYEYMSILPLGCTIVSKDIPMPYSYDKNGPNFDISIFTETAKRVISTGETVFTWYSSNVTSICQQCEHEGPRVTIIAGTFIVLSLIVATALYISLKSRYNEEIHLKVEMFLKTYGTSKPTRYTFSEVKKIARRFKDKLGHGAFGTVYKGELLNGVPVAVKMLENSVGEGQEFINEVATIGRIHHANIVRLLGFCSEGTRQALIYEFMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTEPTVENQNEFYFPEWIYERVMNGQDLVLTMETTQGEKEMVRQLAIVALWCIQWNPKNRPSMTKVVNMLTGRLQNLQVPPKPFTSSQNQLVI

SEQ ID NO: 42134 - protein, 507 aa, Synechococcus elongatus PCC 6301
MSPADSHNQLLIDRVHPQDWINPEPADCYDLVVIGAGTTGLVVAAGATGLGLGLKVALIEKQLMGGDCLNFGCVPSKALIRSSRVIGELQRANTLGIQVAPEAIAVDFAAVMERLRKVRAGMSVHDSAQRFQALGVDVFLGQACFCDRNTIQVGEATLKFRKAVIATGARATYPNIEGLEASGFLTNETVFSLSNCPRRLAVIGGGPIGCELAQAFQRLGSQVTLFQRRSQLLPKEDFEAAEVIQNQLRADGVQVCLSAEITRIERTASGKLITFRQEGRESVLEVDEILVGTGRSPNVQDLNLEAVGVDYDSVHGVKVNDYLQTTNPKIYAAGDVCSPWKFTHAADAAARIVIKNALFSPFGLGKSKVSDLIIPRVTFTDPEVAHVGLSETAARHQGIAIATITIPLDQVDRTVLDGETAGFIRIHHQPNSDKILGATIVAPHAGEMISEVTTAIANQLGMSALSSVIHPYPTQAEGIKKAADNYRRTLLTPMTKQLLKLLMIFSK

SEQ ID NO: 42135 - protein, 331 aa, Aspergillus oryzae
MKPLLVKKFINNRFELIRPISGGSEGSVYIARDHHTGKELAIKLYHEPSGHKSYHREVNGYRYLAGLMGVPKFYWAGQDQRYHATAIELLGPSLAHLWRDCGRRFSLKTVLLLADQLICRFQELHSRNCVHRDIKPENLLIGVGRKANRVYVADLGFVKRYSALSDRQILKRERHDRRECEKNPGIGVGLQGTEVYAAWRAHYAKPQSPRDDMESLGYVLVRFLKGHLPWERLWASACTDLERQIAVAEMKRNIRTETLCKGLPSAFNLYFLHILLKATPDYTYLREIFLRLFRREGFKDDQIYDWTFKQEAELLRQHCNNRLKEQVKKFL

SEQ ID NO: 42136 - protein, 266 aa, Methylobacillus flagellatus KT
MSGIHVDIVGKGQPVALIHGWGMHGGVWQPVAKRLAKSFEVHVLDLPGMGLSQEVIASNLDEMVASLLPALPAHADIVGWSLGGLVAMRLALSQPARVRRLALVGSTPRFINTEPGHAQPWEYGIAAPVFQKFAQQVGEDYANTLIKFLTLQCMGARDARATIKELRRSLSDRPAPAPLALESALDVLLQNDLRPELSALQQPVLLVHGDRDSLAPVQAAHWLARHLQHASLRVIAGAGHAPFLSHTAQFIDSVCDFFQPNPGSAR

SEQ ID NO: 42137 - protein, 318 aa, Debaryomyces hansenii CBS767
MIAENFNNMPLLSPTLTPSQVPISETPQVPPKVSDEVRNALPIHGKLPEVRCMARARIPTTNGPEIFLHLYENNIDNKEHLAIVFGEDIRSKTLFAKRPNDTQQDRMTRGAYVGKLFPGRVDADHDSHSNMSLNFDTDGDLIREPSTTFMEDPCIVRIHSECYTGETAWSARCDCGEQFDEAGRIMGNDGHGCIVYLRQEGRGIGLGEKLKAYNLQDLGADTVQANLILRHPADGRSFSLATAILLDLGLAEIKLLTNNPDKILAVEGKNRDIKVLERVPMVPLAWKTEDGIKSKEIEGYLSTKIERMGHLLEKPLKI

SEQ ID NO: 42138 - protein, 54 aa, Brassica napus
AYYLPETEYVHWARAHPEYTKGQVVGLVTLVATMKGWKRKTRLEVVEKIESAAA

SEQ ID NO: 42139 - protein, 402 aa, Synechococcus elongatus PCC 6301
MSKRTLASLTAADLEGKRVLVRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHAPTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEGALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 42140 - protein, 325 aa, Rickettsia conorii str. Malish 7
MNKFKNIAVYGGGSFGTSLASLAAQNCNNVTLFLRDEAIAKEILHNKTNVKYLGDIKLPAHLQATTNLDIIKDFELIIIALPSYAFDDSIKLLKTHSISKDNTLLIATKGFARNPTALLSDRLKTLLPYNPTAFFVGPNLAKELAKNLPASASIASLDIDIANKIAYNLSSKIFTTNVSSDIVTLQVAGALKNIFAIKSGIDLARKQGENARATLIVAALKEIAILSKALGGMQKNSDILLEGVVGDLVLTCYSLGSRNTKFGYELGISSDKKKFLQEYKELAEGREALKLVLDLIKKYNLHMPIISEVASCVIPYVIPAKAGMT

SEQ ID NO: 42141 - protein, 425 aa, Candida glabrata CBS 138
MAKSTTKKVSKKDLKLAKKEVESSSDSSSSSSSSSESSSSDSSSSESSDDEEPKKTKESSDSSSSDSSSSESDSDSESDSEESKEDKKESSSSSSSSSSDSESDSEESKEDKKESSDSESSSSSSSSSSDSESDSDSSSSDEEEEAKEEKDSKKRKAEDEEEESSPKKAKTDGEPATVFVGRLSWSIDDEWLKQEFEHIGGVVAARVMYERGTDRSRGYGYVDFEDKSYAEKAVKEMHGKEIDGRPINVDMSTSKPTVNPREDRQKRFGDIPSEPSDTLFLGNLSFNADRDNIYEIFGKFGEIISVRIPTHPETEQPKGFGYVQYTSIDDAKKALEALQGEYIDNRPVRLDYSTPKPNNGGNGGNGGSRGGFRGGRGGNSGGFRGGRGGNNGGNRGGFRPSGSGANQAPLGKPRTAFAGQKKTFD

SEQ ID NO: 42142 - protein, 192 aa, Triticum aestivum
MANPSMAAGGGVPWAEGARAVGAQIRNRLRVAPVDRRWLWRRPEGRAASEAVRQWSDRLRAILHRDKQGPDQQQQQQGPASPDAAAAAKAKPSSSALRFYRKKVGKEVNGSEDSVIFRSLQALAVPLIGNACYVFMHGLNSVQIYGAEKLQQALQERPKDKPLLTVSNHVAAMDDPFVIASLLPPSVMLEAQ

SEQ ID NO: 42143 - protein, 382 aa, Pinus radiata
MDSNMNGLAKSNGCEISRDGFFESEEEELQGQAEAWKCTFAFAESLAVKCVVLLGIPDMIAREGSRATLSLGEIVAKLPTESPDAACLFRIMRFLVAKGIFRASKSAREGGAFETRYGLTPASKWLVKGRELSMAPMLLMQNDETTLAPWHHFNECVLEGGVAFQKANGAEIWSYASDHPDFNNLFNNAMACNARIVMKGILSKYQGFHSLNSLVDVGGGTGTAVAEIVRAYPFITGINYDLPHVVATASSLSGVQHVGGDMFETVPTGDAIFMKWIMHDWNDEDCIKILKNCRKAIPDTGKVIIVDVVLDADQGDNTDKKRKKAVDPIVGTVFDLVMVAHSSGGKERSEKEWKRILLEGGFSRYNIIEIPALQSVIEAFPR

SEQ ID NO: 42144 - protein, 477 aa, Vibrio parahaemolyticus RIMD 2210633
MQQIKNETLKEVFKQWASDDGVVVINPATEQELIRLKPSSIEELDCLIEACSAEQVRWAKLSAKERSSCLKNWHQLLMEHAEDIATIITLEQGKPLSESRGEVSYGASFVEWFAEEARRAYGEVIPAPAIDRRLSTIKQPVGVCAAITPWNFPIAMITRKAAPALAAGCGMIIKPSELTPLTALAVVELAYQAGIPKPLLPVVISEQAAEFGQVLSMDPRIKKISFTGSTRVGKILMKQASETVKAVSMELGGNAPFIVFEDADLESAADGLIASKFRNAGQTCVCTNRLYVHQNAKERFMEKVLAKMTELNVGNGLESGVTVGPVITMASKHRLEAVIDQALQEGATIANRPQKLAGRFMEPVILDNVDQGMAIVQQELFGPVLPVLTFEDDEQVLAMANDTEYGLACYFYTDSLKRIIKFTEGLEYGMVGVNEGIISTEVAPFGGIKESGVGREGAKQGLDEYLETKYICLGGLN

SEQ ID NO: 42145 - protein, 632 aa, Xanthomonas axonopodis pv. citri str. 306
MTQESSAPLLFADLGLSDAVMKAVANVGYESPSPIQAATIPALLAGRDVLGQAQTGTGKTAAFALPVLSNADLNQVKPQALVLAPTRELAIQVAEAFQKYAEAIPGFRVLPVYGGQPYAQQLSALKRGVHVVVGTPGRVIDHLDRGTLDLSQLKTLVLDEADEMLRMGFIDDVEAVLKKLPEQRQVALFSATMPPAIRRIAQTYLKDPAEVTIAAKTTTSANIRQRYWWVSGLHKLDALTRILEVEPFDGMIIFARTKAATEELAQKLQARGMAAAAINGDMQQAAREKTIAQLKDGKLDILVATDVAARGLDVERISHVLNYDIPYDTESYVHRIGRTGRAGRNGDAILFVTPREKGMLRSIERATRQPIEEMQLPSVDAVNDTRVARFMTRITETLAGGQIDMYRDLLQRYEAENNVPAIDIAAALAKLLQGDAPFLLTPPVRGVREESAPRQRNERADRGERPRFEPTFERGPRADGERAARPPRGDDTGERPRREPAPRGEPEFGMESYRIEVGHSHGVKPANIVGAIANEAGLESRYIGRIDIQDDYSILDLPADMPRELLAHLKKVWVSGQQLNMRKLEDGEAAAAASKPRFPRGGKPSGRPNGPGRPMDRAGAPHRKGPPKPRGE

SEQ ID NO: 42146 - protein, 334 aa, Oryza sativa Japonica Group
MEERYEALKELGAGNFGVARLVRDKRSKELVAVKYIERGKKIDENVQREIINHRSLRHPNIIRFKEVCLTPTHLAIVMEYAAGGELFEQICTAGRFSEDEARYFFQQLISGVSYCHSLEICHRDLKLENTLLDGSPTPRVKICDFGYSKSALLHSKPKSTVGTPAYIAPEVLSRKEYDGKATDVWSCGVTLYVMLVGSYPFEDPGDPRNFRKTISRILGVQYSIPDYVRVSSDCRRLLSQIFVADPSKRITIPEIKKHTWFLKNLPKEISEREKADYKDTDAAPPTQAVEEIMRIIQEAKVPGDMAAADPALLAELAELKSDDEEEAADEYDTY

SEQ ID NO: 42147 - protein, 559 aa, Nicotiana tabacum
MGSSGDAWKLKDHPKLPKGKTVAVIVLDGWGEAKPNEFNAIHVAETPVMYSLKNGAPEKWRLIKAHGNAVGLPTEDDMGNSEVGHNALGAGRIFAQGAKLVDLALASGKIYEGEGFKYVKECFEKGTLHLIGLLSDGGVHSRLDQVQLLLKGAAKHGAKRIRVHALTDGRDVLDGSSVGFMETLENSLAQLREKGIDAQVASGGGRMYVTMDRYENDWDVVKRGWDAQVLGEAPHKFKDPVEAVKKLRQEPNANDQYLAPFVIVDDNGKPVAAILDGDAVVTFNFRADRMVMLAKALEYENFDKFDRVRVPKIRYAGMLQYHGELQLPSHYLVSPPEIARHSGEYLVRNGVRTFACSETVKFGHVTFFWNGNRSGYFNEKLEEYVEIPSDSGITFNVKPKMKALEIAERTRDAILSGKFDQVRVNLPNGDMVGHTGDIKATIEACKSADEAVKMILEAIEQVGGIYLVTADHGNAEDMVKRNKKGEPALDKNGNIQILTSHTCEPVPIAIGGPGLAPGVRFRQDLPTGGLANVAATFMNLHGSEAPSDYEPSLIEVVDN

SEQ ID NO: 42148 - protein, 299 aa, Glycine max
MEEIVPVVDFQRLSEEEERKKLRKTCEKPGCFRIINHSIPLTLMADMKSVVKYLHDLPTEIKMRNKPSSVPESGYRAASTTTPLYEGMGIYDMHASPQAFEDFCSNLNVSPRHRQIIKEYGQAIHDLASNVSQKMAESLGIVDNDFKDWPFILRTIKFSFTPDVIGSMAAQLHSDTGFITLLQDDEHVSGLEMIDDFGTFKAVPPIPGAFLCIVGDVGHVWSNGNFWNARHRVICKETGTGYSFGAYMLSPRDGNVEAPKKLVEVDHVQRYRPFKYEDLRDFKITTGKRVEVLDQYRIC

SEQ ID NO: 42149 - protein, 315 aa, Digitalis purpurea
MAEEIRFFKLNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFIPTDIPGTWKAMEALYDSGKARAIGVSNFTLKKLSDLLDVARIPPAVNQVGCHPSCAQTKLRAFCKSKGVHLSGYSPLGSPGTPWVKHDVLENPILVDVAEKLGKTPAQVAIRWGLQMGHSVLPKSVHESRIKENIDVFSWCIPDDLFAKFSEIEQVSPGKPEFPVHPEISQYKTVEEMWDGGI

SEQ ID NO: 42150 - protein, 315 aa, Digitalis purpurea
MAEEIRFFELNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFVPTDIPGTWKAMEALYDSGKARAIGVSNFTLKKLSDLLDVARIPPAVNQVGCHPSCAQTKLRAFCKSKGIHLSGYSPLGSPGTPWVKHDVLENPILVDVAEKLGKTPAQVALRWGLQMGHSVLPKSVHESRIKENIDVFSWCIPDVLFAKFSEIEQVSPGKPEFPVHPEISQYKTVEEMWDGGI

SEQ ID NO: 42151 - protein, 269 aa, Agrobacterium tumefaciens str. C58
MTGQNDGLDQRFALAKTLAEEAGSMALDYFNKRDSLVIETKRDLQDVVSIADRNVETMLRERVAAAFANDGFLGEEHGYQDGTSGYTWVVDPIDGTAPFVNGMPSWCVSIAVIRDGAPVIGVIKVPCSQEIYAAAQGHGATLNGARLQLDPSRNLQNALTGIGSNNYVTPQCVGHIISDVLARGGNFIRNGSGALMLAYVAAGRLVGYYEPHMRAWDCMAGFCLVNEAGGRSMPFSLEGEKLFEGQPVLAGNASCYQELVDIHEAARDA

SEQ ID NO: 42152 - protein, 581 aa, uncultured marine group II euryarchaeote 37F11
MMKQRVHEAMMTGQFMSWSPDAETQNLIWHLSLQNAFEYDGKGAAGSVIGRIMSTRADLRQHGGQIGPLVAQSVAKANTLAQENGMDHVESLLQREAPHLLEGRQKQERREGLPPLKNTEGKEIVLRFAPNPNGPLSFGHARGVVINGTYAHEHKGTLILRFDDTDTTVKPPMLDAYDIIPKEVEWLLGRPADRIVLASDRIPLYYDHAERMLKEGFGYICQCPAEDFRTFRETKENCPCRDKSVEMNAEGWRMMLDGSYNPGDAVVRVKTDMGLKNPALRDWPALRIQDTQKNPHPRPQIGSTYRVWPLLDFQSAVEDQLQGVTHIVRGKDLMDSTRKQTLLYEHFGWEYPETIYWGRVKVHEWGGFSTSKMRASIESGAYTGWDDPRLPTLQGLQLRGIQAEALRNFWIELGVTQKDISVPLATLFSHNTKRIDDDAPRLSFVRNPVEIDLHGDIPDHIEIPVHPNHESMGMRIISMSSNQILIEKEDEKHPTYRLKEFADIEIGGQVGSISRSDRRPIIHWVSTDSSKEATLTLPLQDNIEHIQGLVEDHEYPVGTIIQLERIGYAIIREDDFLLMHE

SEQ ID NO: 42153 - protein, 72 aa, Pisum sativum
LKFLQAPYGKHHRPGWGPNLSPPLAWFLMESPTLWFTLYLFPFGNNSSNPKSIILITPFLIHYFHRTIIYPL

SEQ ID NO: 42154 - protein, 467 aa, Lactobacillus acidophilus NCFM
MQQFGVIGLSVMGKNLALNVRNHGFSVSGYSIDKPEVDALAKYEDDKLKPCYTLEEFVNSLEKPRKILIQIMAGDPVDQTLHKLLPLLDKGDIVIDGGNSNYHDTNRRYHEMEKHGIHFIGMGVSGGEEGALNGPALMPGGDEEAYKEVAPILEAIAAKNKDGKPCVSYMGPEGAGHYVKMVHNGIEYAIMQEFSEVYSLLRDVAHKSNGEMSEIFDKWNHSVVEAYLSEITSKVLKQEDDLTPDHIIDHILNVASYKGTGNWTLEDGVALGAPVTVIAEAVMARFMSKQTHLALKSGIKPTEFKYDGEIPDDLVDEFGKTLQLAQAVAYAQGFQELTMAAKAYDWDLRYKSIAQGWEAGCIIRSAMLKDIEDAYADGKELTNLFEDGYFRKLMEDNLPALRKSVEFATKAGVPTPTLSAALNYLESIFNPKLPANMIQGQRDYFGAHTYQRNDREGVYHTEWYEEK

SEQ ID NO: 42155 - protein, 475 aa, Rickettsia conorii str. Malish 7
MNLLKNITGKNYINGEFIEFGKQISVINPATLKEIATVPNLGLSEINSAINNTVTSFSLWSQSSFEARIAILRRWYNLVIENIEELSYILTLEQGKVLAESKKEILYGASFIDWYTYAIHNIHSTIKPGNSNTHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDIGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 42156 - protein, 347 aa, Chlamydomonas reinhardtii
MLQIFRGVFARSVGPARQNLALPAANKAFSAASAAICWPPVPAVKLTEQQAKSRAHFPNLIVVESAANPDTMATATAPALNKRIGFLGSGQMAEALARGLMKRGLVSGEHIACNDPNPARTNLFKSFGATPYESNADVARNADVIFVAVKPQHVAQVLSEVRPVLTEGHTVVSIAAGITIDKLVEAAGPDAHVVRVMPNTPCLVGETAAAMCLGGKANADDETLVRTIFEAVGKIYTVDEKLLAAVTGLSGSGPAYVFLMIEALADGGVRAGLPRDIAQALAAQTVLGSAKMVMETGTHPGALKDMVTSPAGTTIAGVHELERAGIRAAFMNAVVAATDRANQLSKM

SEQ ID NO: 42157 - protein, 278 aa, Zea mays
  misc_feature (121)..(121): Xaa can be any naturally occurring amino acid
MFLMIHSPLFVKKKKKKKTKRKAASAAPPLPVFLTPVAPPLATRAASPPRPATTAMSRRGDWVYENNGGTCVAIAGADYCVVAADTRLSVGYSILTRDHSKICDLADKCVLASSGFQGDIXVKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPARDAVTPLSESEAIDLVKDVFASATERDIYTGDKLEIVVINKVGTKREYIDLRKD

SEQ ID NO: 42158 - protein, 358 aa, Ralstonia eutropha JMP134
MITNQQYKIAVIPGDGIGNEVVPEGIRVLEAASAKFGFKLAFTTYDWSCARYHSQGSMMPSDGIERLRDSDAIFLGAVGFPGVPDHVSLWNLLIPIRREFDQYVNLRPVRLLPGVPCPLANKKPGDIDFWIVRENTEGEYSQVGGRMFAGTEHEFVTQEAIFTRRGTDRIMRYAFDLAKKLGRNHVTSATKSNGIFHSMPFWDERFAAVGAEYPDIRTDQYHIDILAARFAMSPERFDVVVGSNLFGDILSDLGPGITGTIAVAPSANINPERKYPSMFEPVHGSAPDIAGQGIANPIGQIWSGAMMLEHLGQPEAAAAIMQAIETVLTHPDRVHTPDLGGRASTQQMGAEIARAVLA

SEQ ID NO: 42159 - protein, 526 aa, Oryza sativa
  misc_feature (512)..(512): Xaa can be any naturally occurring amino acid
MGACFSSHTATAAADGGSGKRQQRKGDHKGKLPDGGGGEKEKEAARVEFGYERDFEGRYQVGRLLGHGQFGYTFAATDRASGDRVAVKRIDKAKMVRPVAVEDVKREVKILKELKGHENIVHFYNAFEDDSYVYIVMELCEGGELLDRILAKKNSRYSEKDAAVVVRQMLKVAAECHLHGLVHRDMKPENFLFKSTKEDSPLKATDFGLSDFIKPGKKFHDIVGSAYYVAPEVLKRRSGPESDVWSIGVITYILLCGRRPFWNKTEDGIFREVLRNKPDFRKKPWPGISSGAKDFVKKLLVKNPRARLTAAQALSHPWVREGGEASEIPVDISVLSNMRQFVKYSRFKQFALRALASTLKEEELADLKDQFDAIDVDKSGSISIEEMRHALAKDLPWRLKGPRVLEIIQAIDSNTDGLVDFEEFVAATLHIHQMAELDSERWGLRCQAAFSKFDLDGDGYITPDELRMVQHTGLKGSIEPLLEEADIDKDGRISLSEFRKLLRTASMSNLPXVQEDLQIHNPCERR

SEQ ID NO: 42160 - protein, 514 aa, Zea mays
MEDHHHHTATIAHTWLAAMAIAVLPIVSVLILAATKHKQMGRTVFAPPKRREPPVAEGAPLLGVLPAILTRSLQGVICDQYLKLGSVFTLSSLGVKVTFLVGPEVSAHFFHAAESEISIGDVYKVTVPIFGKGVGYDVDNDTRNEQHRFFADTLRPAKLRSHARLMVREVEEYFARWGQSGTVDLKQQVEDVLLLIASRCLLGKEVRDHMHDEVSSLLRELIGGLHLVSLFFPYLPTPAHRRRDRARARLEEIFSGIARLRKSSCSSGRGAGDDGDRDHDMLQGLLDSRYRDGRGTTEAEVTGLLVALLFAGHHTSATVTTWTAARLLRHTEWLHAATEEQRLLQRNDQNDAAAIDYDVLLRMDVLHRSVKEALRLHPVTPMILRRARRPFTVRTQDGSEYEVPEGRMLASPLVVNNLLQGIYRDPDVFDPDRFGAWREEDRVGGDLAYTSFGAGKHACMGEGYAYLQIKVILSHLLRNFELRLLSPFPETENMISMRPKGEVMVSYRRRSLLQ

SEQ ID NO: 42161 - protein, 294 aa, Ralstonia eutropha JMP134
MKKTVGMIGIGMMGHGIATNVAKHGYPLVVLEHPGNQPLDALLKAGAKTAPTISELAGQADIVILCVTGSPEVEDVLFSAQGLLSALRPGTVVIDCSTAIPSSTERIAAAVQKAGGKFIDAPMTRTPKEAAEGRLNLIVGGDESIYQECRPLLQSFAENITFAGPVGSGHRLKLLHNFVSLGFSAVLAEAAACAARADVSPEVLVDVLAKGGGAGVILERLRPFIERGDSSGFRFTISNALKDMTYYDTMASEVGASHATASAIRETYAGAYGQRSNGTVPELVALLAEPAPVR

SEQ ID NO: 42162 - protein, 276 aa, Chlamydomonas reinhardtii
MATATAPALNKRIGFLGSGQMAEALARGLMKRGLVSGEHIACNDPNPARTNLFKSFGATPYESNADVARNADVIFVAVKPQHVAQVLSEVRPVLTEGHTVVSIAAGITIDKLVEAAGPDAHVVRVMPNTPCLVGETAAAMCLGGKANADDETLVRTIFEAVGKIYTVDEKLLAAVTGLSGSGPAYVFLMIEALADGGVRAGLPRDIAQALAAQTVLGSAKMVMETGTHPGALKDMVTSPAGTTIAGVHELERAGIRAAFMNAVVAATDRANQLSKM

SEQ ID NO: 42163 - protein, 336 aa, Pseudomonas syringae pv. tomato str. DC3000
MQPDIAPNPHSTRPGLSRRFSVAPMMDWTDHHCRYFMRLLSSQALLYTEMVTTGALLHGDRERFLRHDETEHPLALQLGGSTAAGLAACARLAEAAGYDEVNLNVGCPSDRVQNNMIGACLMAHPQLVADCVKAMRDAVGIPVTVKHRIGINGRDSYAELCDFVGTVHDAGCQSFTVHARIAILEGLSPKENRDIPPLRYDVVAQLKTDFPELEIVLNGGIKTLEQCSEHLQTFDGVMLGREAYHNPYLLAQVDQQLFGSVAPVISRHAALESMRPYIAAHIASGGNMHHVTRHMLGLGLGFPGARRFRQLLSVDIHKAENPLLLLDQAAKFLEGH

SEQ ID NO: 42164 - protein, 486 aa, Ralstonia eutropha JMP134
MQIQNPSLFRQQCHVNGQWVDAADGEVVPVTNPATGQQLGTVPRMTAADVQAAIAAADRALPAWRATSSRERSRLLRRWFDLCMAHQEDLATILTLEQGKPLKESRGEIAYGSGFIEWFSEEARRIYGDVIPAPSSDRRIIVIKQPVGVVAAITPWNFPNAMITRKAGAALAAGCTIVIKPASATPFSALALAALAKEAGIPDGVLNVVTGSASVVGGELTSSPVVRKLSFTGSTDVGKTLLEQCAGTVKKVSMELGGNAPFLIFDDADLDAAVAGVMASKFRNAGQTCVCANRIFVQDGVYDAFAEKLRIAVEAQVVGDGMAPGVDLGPLIDDAAIEKVREHIYDAVSLGAQVFTGGRAHALGGRFFKPTILTDVSPKAKLMNEETFGPLAPLIRFKTEEEAVAMANDTPFGLAAYFYTTNYARSWRVAEALECGIVGLNEGLISTEVAPFGGVKESGVGREGSKYGIEDYVEVKYICAGGLALR

SEQ ID NO: 42165 - protein, 479 aa, Polaromonas sp. JS666
MSTFVDRHGLWSEDQLKQARDLVHRIDAGEIDVVRFAWPDQHGLLRGKTLVASEARAALWDGVNLTSTLLAKDTSHQTVFPVFAAGGGFAIEGFQGGADFTVVADPSTFKVLPWTPRTGWVLCDAYMPDGKPCPYATRQILQRAVRQLGEIGLNFIAGLEVEFHVFKLEDARMGLGDSGQPGEPPRVSLLSHGHQYLTELRYDRVDAVMELLRSQLLALGLPLRSLEVEYGPSQFELTFGPTAGVLPADTMVLLRSAIKQICQRAGYHATFMCRPRIPNVMSSGWHLHQSLTRKSDGVNAFMPEVAGQVLSDIGLHYLGGLKQHACGAAVLASPTINGYRRYRPFSLAPDRAIWARDNRGAMLRVLGGVGQTATRIENRVGEPTANPYLYLASQLFSGLDGIRKKTNPGPSADAPYETPAESLPRSLGDALTCLRKDEMLNEQMGKTFVDYLCDIKEAEIARFNLEVSEWEHREYFDMF

SEQ ID NO: 42166 - protein, 363 aa, Solanum tuberosum
MSCYKGKYADELIKNAAYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIQKCADVTERVLAACYKALNDHHVLLEGTLLKPNMVTPGSESPKVAPEVIAEYTIRALQRTMPPAVPAVVFLSGGQSEEQATVNLNAMNKLQNQKAMVAFLLLWTCSSAEYPQGVGRKRRECAESTSCIPYQVQGQLRCYTRKVCRSFQLKRGRFREPPCQGLQVLDQSF

SEQ ID NO: 42167 - protein, 167 aa, Zantedeschia hybrid cultivar
MAADAAAAGASKKLTLKSSDGEVFEVEETVAMESQTIRNLIEDDCTADGVPLPNVTGRILAKVIEFCKKHVEIAALKADEGVDRAADEELKVWDADFVKVDQTTLFDLILAANYLNIKSLLDLTCQTVADMIKGKTPEEIRKTFNIKNDFTPEEEEEVRRENQWAFE

SEQ ID NO: 42168 - protein, 199 aa, Euglena longa
AGGIAEMAHLNASVRTSTDQLDAVGNTTKAVTKGYAIGAAGLAALVIYSTYIEDLHHYFPNLNIDFNLQDPFVIVGLFAGGILPYLFCSFGMMAVSRAGGKIVEEVRRQFKEIKGIMTGENKPQYSLAVDILAKAAIYEMIIPSLLPVVAPIILYFVMKHIVGQAAAFTALGAMILGCLLTGMFLAISMTSGGGAWDNA

SEQ ID NO: 42169 - protein, 398 aa, Xylella fastidiosa Ann-1
MNTPTHSHPHPFGSTSTIRCERAAAELRTGRPVLLIDAHARRHAVMALDSMTAQSFATFANAVGNTHYLFLTPVRSNVLGLEAPQGARIPLATLSYDSLVKLAYLRQPTHPTTWVSGDIMDAAATEITRLALLLPAIVASPLTQHTEHAFADCQTLDLADLNTAAACASTTEYELVTRTPVPLRDLGMSEFIVFRGGIAQRDQVAILIGQPDLNSAVPVRVHSSCLTGDLFGSLKCDCGDQLRHGLATLKALGGGVLLYLDQEGRGNGIAAKIRAYGYQHVGLDTIDADAQLGFGPDERRYTGAVMMLRALGITRIQLLSNNPTKVERLRAAGIIVEQRIPVIGQITEQNEHYLRTKVSRAGHDLDIDALIMTSQTPQDPSETVDGETVKPIAKTGHA

SEQ ID NO: 42170 - protein, 522 aa, Oryza sativa Indica Group
MAAPLSTAAASWLSDSASSPPRVRLLIGGEFVESRADEHVDVTNPATQEVVSRIPLTTADEFRAAVDAARTAFPGWRNTPVTTRQRIMLKYQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTHDVVNNICDDEDIKAVSFVGSNIAGMHIYSRASAKGKRVQSNMGAKNHAIILPDADRDATLNALIAAGFGAAGQRCMALSTAVFVGGSEPWIRPGIREDELVKRASSLVVNSGMASDADLGPVISKQAKERICKLIQSGADNGARVLLDGRDIVVPNFENGNFVGPTLLADVKSEMECYKEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTVTQQWKESPAQRVSLSMPTSQK

SEQ ID NO: 42171 - protein, 106 aa, Brassica napus
MRIIVSILFVASLLLITSSLASATISGGGGAAALAPEIKVGPELDKWCGGKCEVRCKDAGMNDRCLKYCGICCKECKCVPSGTYGNKHECPCYRDKLSSKKTPKCP

SEQ ID NO: 42172 - protein, 204 aa, Agrobacterium tumefaciens str. C58
AGGIAEMAGLDPDVRKATDALDAVGNTTKAVTKGYAIGSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAIPCTSGG

SEQ ID NO: 42173 - protein, 356 aa, Xanthomonas axonopodis pv. citri str. 306
MRMRAMHFERFEQVPEILQLPDPTPSDDGVVIKVAATGICRSDWHGWMGHDPDIALPHVPGHEFAGEVVAMGKRISGFAIGTRVTVPFVSGCGRCAQCHGGNQHVCSNQFQPGFTAWGSFAEYVAIDFAETNLVRLPESIDDATAASLGCRFATSFRAVVDQARTGPGEWVVVHGCGGVGLSAVMIAAALGAQVVAVDIFDDKLAFAVECGAVATVNASKAADTVEAIREITKGGAHVSIDALGSPATCFNSISNLRRRGRHVQVGLMLGEHATPRIPMAQVIGHELEIYGSHGMQAWRYDAMLAMIQAGKIAPQRLIGKRVGLDEAIAVLTGMDATRDLGISVIDRFQPVSPPAS

SEQ ID NO: 42174 - protein, 287 aa, Oryza sativa Japonica Group
MVADPPLQKVTLGSTVHGSALLEDGPNPLPSHLSPSPSLLPSPKRTPTCRLSPSSRRLDRSGRGREEGLNLKTPKAERDLSTSIVNDFGDGTYTVAFDEDKIYTTVTDSGEEVEEWLDEIVRIHHRRLDHLIVGLDVEWNPASGFCALGPVAVLQICVGRRCLVFQIIHADYVPDQLGDFLGDGRFTFVGVGIHDDVDKLREHYDLEVENAVDLRYLAAQTIGKPALRSTGLQGLVWEVMDVWMEKPHHVRVSAWDSRQLTLDQVMYACADAFASFEVGRSLYDDYE

SEQ ID NO: 42175 - protein, 343 aa, Rickettsia conorii str. Malish 7
MNLLLQPPQNVAAAHNRIKQYLHLTPIVHSESLNEMLGHEIFFKVESLQKTGAFKVRGVLNHLLELKEQGKLPDKIVGYSTGNHGIGLAYASKLFGIKTRIYLPLNTSKVKQQAALYYGGEVIYTYTRQEAEEKAKEDEKQGFYYMHPSDSDSTIAGAGTLCYEALQQLGFSPDAIFASCGGGGLISGAYLAKELISPTSLLIGSEPLNANDAYLSVKDNKTYRFNYAPNTIADGLKTLSISARTFEYLKKLDDFYLAEEYEIYYWTAWLTHLLKVICEPSSSINMVSVVNFLKTQSKPQKLLVLISGGNIDPILYNELWKEEYLSISPKSLCSDVISAKAAI

SEQ ID NO: 42176 - protein, 357 aa, Triticum aestivum
  misc_feature (200)..(200): Xaa can be any naturally occurring amino acid
  misc_feature (262)..(262): Xaa can be any naturally occurring amino acid
LAWSRPRCSGINAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTXGDIEATVVACKAADEAVKMVLDAVEQVGGIYLATADHGNAEDMVKRNKAGQPMLDKSGSIQXILTSHTLQPVPVAIGGPGLHPGVRFRSDIQTPGLANVAATVMNLHGFQAPAGLQDNLIESLTSKKKTLRPLKPKLLQPILSLKFWGGSRNDRIIE

SEQ ID NO: 42177 - protein, 329 aa, Methylobacillus flagellatus KT
MKISILGAGAWGTALALQISRRHQVSLWTRNQAHIVDMQVTRANLQYLGDFAFGDQLAVEGDLGRALDGADLIVSVVPTNGFRNALKEIKRLGCDAPVVWASKGLEAATAKLPHEVAQDELGDSRHWGVLSGPSFAAELVRGLPTAVTLAANDAEFAARAGAMLHGGNFRVYTSTDVIGVSVGGALKNVLAIAAGISDGMQCGNNARAALITRGIAEMTRFGVALGGAKETFMGLTGAGDLILTCTGQYSRNREVGLRLANGQTLQEILKTLGHVAEGVHTAREVVKRAGQLGVEMPITQEVDQVLSHGRSPRQAMENLLSREQKSEAL

SEQ ID NO: 42178 - protein, 161 aa, Solanum tuberosum
MGCFNSKVKKQFRGHEDPIALASQTAFSVSEVEALFELFKSISSSVIDDGLISKEEFQLALFKNRKKENLFANRIFDLFDVKQKGVIDFGDFVKGLHVFHPNAPQEEKVNFSFKLYDLDGTGFIERQEVKQMLIALLCESEMKLADETIESILDKIVTLYM

SEQ ID NO: 42179 - protein, 130 aa, Rickettsia conorii str. Malish 7
MLRGDVESIKIGNNTNVQDGSVIHASRFNGPVEIGDNITIGHLSLIHACTIHNNAFIGMRATIMDYAVIEEYAFIAAGSLILPKKIIKSQELWMGSPAKFVRYLTDQDLEYMQDNVRHYVELENVYKILV

SEQ ID NO: 42180 - protein, 409 aa, Myxococcus xanthus DK 1622
MSAVEGTNYYFRKAARIMDVGTPIETLLATPLREVKVQVSIEMDSGEIRTFLGYRIQHDNSRGPMKGGLRYHPMLDQDECASLASLMTWKTAVVNVPYGGAKGGIACDPSQLSIKELERLTRKYVDQVQDVIGPTRDIPAPDVNTNPQVMAWIMDQYSRYHGHSPAVVTGKPLELYGSKGREAATGRGLLYVAREILRDLGLPVKGTRFALQGFGNVGGHTAQLLWEDGGVVVAVADALGGVRNPQGLDIPSLFEHVKRTGTVTGFSGGASCSNDDVLGADCEVLIPAALGHVLTRENAHAVRAKLIIEGANGPTQPEADEIFEKRGIFVVPDVLASAGGVTVSYFEWVQNLQHLSWEEDRVNAELEKSMKEAYERVAQVARSRKVSMRTAAYILAIGRVGKATVLRGI

SEQ ID NO: 42181 - protein, 488 aa, Pseudomonas syringae pv. tomato str. DC3000
MAHRHASGHSTSVLRVAQMSVATRFIDDQLTRITPAAAETLYQFDESPLLARQSRQESNARSYPRRIPLALKRAKGIHVEDVEGRRFIDCLAGAGTLALGHNHPVIIDAIQQVISDELPLHTLDLTTPVKDQFVQDLFGLLPPALANEAKIQFCGPTGTDAVEAALKLVRTATGRSTVLSFQGGYHGMSQGALSLMGSLGPKKPLGALLSSGVQFLPYPYDYRCPFGLGGEQGVRANLHYLENLLNDPEAGVQLPAAVILEVVQGEGGVIPADLDWLRGVRRITEKAGVALIVDEIQSGFARTGKMFAFEHAGIIPDVVVLSKAIGGSLPLAVVVYRSWLDTWLPGAHAGTFRGNQMAMATGSAVMRYLQEHNVCEHATAMGARLVGHLQALQRDFPQLGDIRGRGLMLGVELVDPAGARDAQGHPPVFARLAPLIQRECLKRGLILELGGRHGSVVRFLPPLVITAEQIDEVAEIFGRALNAAVAQL

SEQ ID NO: 42182 - protein, 206 aa, Glycine max
  misc_feature (57)..(57): Xaa can be any naturally occurring amino acid
  misc_feature (107)..(107): Xaa can be any naturally occurring amino acid
GGPFNLGELARICKGGCLIRGVFLAKNKKAYQRTPYLASLIVDPEFSREMVQSQPPXKRVLGLPVSTGISTPRMWASPASFDTHRRARLPANLVQAQRDLFGGHTYXRVVPPGAFHTEWTKFAPKSGTGVGAPNSLIMGFGCLINFGPGQPLSGNCLFLLRIFGRQKPATVFLLNLFLILINQRGVFWLPKKKKKKKKKKKKKKPK

SEQ ID NO: 42183 - protein, 325 aa, x Doritaenopsis sp.
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDREWIEVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 42184 - protein, 472 aa, Oryza sativa Indica Group
MEPRVGNKFRLGRKIGSGSFGEIYLGTNIQTNEEVAIKLENVKTKHPQLLYESKIYRILQGGTGIPNVRWFGVEGDYNVLVMDLLGPSLEDLFNFCSRKLSLKTVLMLADQMINRVEFVHSKSFLHRDIKPDNFLMGLGRRANQVYIIDFGLAKKYRDTSTHQHIPYRENKNLTGTARYASVNTHLGIEQSRRDDLESLGYVLMYFLRGSLPWQGLKAGTKKQKYEKISEKKVATSIEALCRGYPTEFASYFHYCRSLRFDDKPDYSYLKRLFRDLFIREGFQFDYVFDWTILKYQQSQIASAPPRAVGHGAGPSGLAPPALQNDRQSGVDEGRTSGWSSMDRRRAPPPIASVGTLAKQKAPVGNDASFSKEPVISASNFLGRSSGSSRRPAVSSSRDVMPTDTSEPSRTRATDASPGAFRRTSGPQKSSPVNSAEPKHSSSARHSSNVKNYESALKGIEGLNFDGDERVQY

SEQ ID NO: 42185 - protein, 469 aa, Bacillus cereus G9241
MEKLQIGVVGVGVMGKSLALNFESKGYSVALYDISKEKVDEIIEENRGKKLVGTHIVEEFVKSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 42186 - protein, 190 aa, Haemophilus somnus 2336
MSAPNIQVLPEDSGIEIAFAGRSNAGKSTALNALTQQKNLARTSKTPGRTQLINLFQVEPNCKLVDLPGYGYAAVPEQMKLQWQKSLGEYLQKRECLGGLVILMDIRHPLKDLDQQMIEWAVSADLPVLLLLTKADKLSQSARSKQVKMVRESILPFQGDVQVEAFSAQNKIGIERLSEKLDQWFSPLFS

SEQ ID NO: 42187 - protein, 115 aa, Zea mays
  misc_feature (34)..(34): Xaa can be any naturally occurring amino acid
  misc_feature (52)..(52): Xaa can be any naturally occurring amino acid
LTFLSETAEATMAGAKAAAVATVAAAVPTVSSQXPFSSSMVHSMSHECVTCXFQLASVRMLPWAKAHLNPTGQALIISTVAGMAYFIVADKTILSMARKHSFDDAPDHLKNTSFH

SEQ ID NO: 42188 - protein, 365 aa, Yarrowia lipolytica CLIB122
MYSTGAKTLKIGLIPGDGIGREVIPAGRKILENLPSNKLKFEFVDLKAGFELFKQTGTALPDETVDELRKCDGALFGAVSSPTTKVAGYSSPIVALRKKMGLYANVRPVKAVQATDKKVDLVIVRENTEDLYIKEERAYEQDGQKVAEAIKRITERATDKIATIATKIALQREQVRKLEGGKLFHEKPILTITHKSNVLSTSDGLFREVARASAEKELKAEGVSADAIIINEQIVDSMVYRLFREPQFFDVVVAPNLYGDILSDGAAALVGSLGVVPSANVGDDFVIGEPCHGSAPDIEGKGISNPIATIRSTALMLEFLGYPEEAAKIYKAVDANLVEGKLLSPDLGGSASTEQVTNDIISKMN

SEQ ID NO: 42189 - protein, 334 aa, Vibrio parahaemolyticus RIMD 2210633
MAFNLRNRNFLKLLDFSTKEIQFLLELSAELKKAKYAGTEQKTLQGKNIALIFEKSSTRTRCAFEVAAFDQGAQVTYIGPSGSQIGHKESMKDTARVLGRMYDGIEYRGFGQSIVEELGTHAGVPVWNGLTDEFHPTQILADFLTMQEHSRGKQLHEMTFAYLGDARNNMGNSLMVGAAKMGMDIRLVAPKAFWPEEHLVATCQDIAKQTGAKITLTENVEEGVKGCDFLYTDVWVSMGEAAEAWDERVALMTPYQINMDVIKQTGNPHVKFMHCLPAFHNDETTVGKEIAEKYGMKGLEVTEDVFESEYSIVFDEAENRMHTIKAIMVATLGS

SEQ ID NO: 42190 - protein, 523 aa, Penicillium expansum
MIIVDNLWSLAVACGLLATFLNILWGRFKEYQGRKAHGCGVIPSYPQWDRIFGLDLALSQMKALRGDTFIPWLAAMHEGQPSTFKVRFLGKRQIYTTETENLKAMTAINWKDFGISPLRRSTKAFHPFADKGVNTVDGDDWVFSRFLIKPFFNRDVYTNTDRIRPYVDSLLSLLPPDGETFNIQPLLQRWFLDLTTDFILGEPMGALNHPAKAKITWAMLDVLRGSRQRMQVVRIIKWFNWDWWLKAVYEVHAFVDTHITATYKEIETRKARIAAGEKVGPEREDLLWYMASHDSDYEDLRSQLALLLVPNNDTTSIFISNALWHLARHPDAWARCREEVLTSVQGSEDEAVGQLSFSTLRGMKFLNACLDETLRLNPNNVTQVRICMNDTTLPRGGGKDGQYPIFVRKGDMVQVTKTVQQRNREYWGEDADDFRPERFLELKPFWEFVPFSGGPRRCPAQMMVMTEAAYMLARLVMRYERIDSRDANPYQAIMRIGPSNKTGVLVALHKAREGNSIDERKST

SEQ ID NO: 42191 - protein, 535 aa, Oryza sativa Japonica Group
MGFLNLVGNSFGCSASGERLVSAARDGDLQEARALLEYNPRLAWYSTFGGRNSPLHYTAAQGHHERYSYSRFASTSVVKQSSGGLFSWLLGEKSSQLPPLDVPLPGITLPPPLPDFVEPSKTKVTTLPNGIKIASETSVSPAASVGLYIDCGSIYETPASSGASHLLERMAFKSTTNRSHLRLVREVEAIGGNVSASASREQMCYTYDAFKAYVPEMVEVLIDSVRNPAFFNWEIKEQLEKIKAEIAEVSDNPQGLLLEALHSAGYSGALREAPNGTSENYTAPRMVLAASGVEHDELVSIAEPLLSDLPSVKRPEEPKSVYVGGDYRCQADSDKTHIALAFEVPGGWFEEKTAIIVTVLQMLMGGGGSFSAGGPGKGMHSRLYLRILNNYHQIESFSAFNSIYNHSGLFGIHATTSPNFASKAVDLAAGELLEVATPGKVTQEQLDRAKQATKSAVLMNLESRVVASEDIGRQILTYGERKPIEHFLKDLEAITLNDISSTAKKIISSPLTLASWGDVIHVPSYESVSQKFFSK

SEQ ID NO: 42192 - protein, 517 aa, Methylobacillus flagellatus KT
MTVTPALLVILDGFGYREDSHDNAIALANTPNIDRFWTQYPHTLINASETFVGLPRGQMGNSEVGHLNIGAGRVVFQDFERINQAIASREFFSNPVLIEAVNKAKAGHKAVHILGLLSDGGVHSHQDHIHATIEMAVNAGVEKVYVHAFLDGRDTPPISAKPYLEKLEQACASIGGGKIASICGRFYAMDRDKRWPRVEAAYNLITDGQGEFASASALQGLEAAYARDEKDEFVKATAIAAAGEQPVTMEDGDVVIFVNFRSDRARQLTHALLDPDFEGFNRRRQPKLAGFYTLTLYDKAETRAKPIFAPVEIRNTFGEYVAQHGLKQLRIAETEKYPHVTFFFNGGEEQVFAGEDRILVPSPKVATYDLQPEMSAYEVTDRLEAAILSRKYDAIICNYANCDMVGHSGDLSASIKAVETIDTCIARIVKAMESIGGQMIITADHGNVEQMRDYENNQPHTQHTTNQVPLFFIGKPATLAAPGTGSLCDLAPSLLAMMGLKQPPEMTGKSLVAFQAA

SEQ ID NO: 42193 - protein, 525 aa, Salmonella typhimurium LT2
MTENIHKHRILILDFGSQYTQLVARRVRELGVYCELWAWDVTEAQIRDFNPSGIILSGGPESTTEENSPRALQYVFEAGVPVFGVCYGMQTMAMQLGGHVEGSNEREFGYAQVEVLTDSALVRGIEDSLTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVMDMFGDHFGLNIVHVPAEERFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 42194 - protein, 425 aa, Vitis vinifera
MDIATSLSCLLFFITILPALTASPILFQGFNWESSKKEGGWYNFLINSIPELAASGITHVWLPPPSQSVSPEGYMPGRLYDLNASKYGTQDELKTLIKVFHSKGVQCIADIVINHRTAEKQDARGIWAIFEGGTPDDRLDWTPSFICKDDTPYSDGTGNPDSGDDYSAAPDIDHINPRVQQELIDWMNWLKIEIGFDGWRFDFARGFSPAFTKFYMAKTRPKFAVGEIWKSLSYRSDGKPSYNQDSHRRELVEWVRGAGGAVNAFDFTTKGILQAAVEGELWRMKDLNGKPPGMIGLMPGNAVTFIDNHDTGSTLQHWPFPSDKVMQGYAYILTHPGIPSIFYDHFFEWGLKEEIMKLIIIRSRNRIKPNSAVRILASDSDLYVAAIDGKIIVKIGPRFDVGNLVPKSFKKIATSGKDYCVWEKK

SEQ ID NO: 42195 - protein, 223 aa, Glycine max
MGCYCSTSKKTEAQGYEEPTVLASVTPCEYHDPSLNVTVSEVEALHELYKKLSNSIIEDGLIHREEFQLALFRNKNKKNLFADRIFDLFDLKRNGVIEFGEFVRSLGVFHPNAALEDKITFAFRLYDLRQTGFIEREELKEMVLALLHESDLELSDDMIETIVDKTFSDADINGDGRIDQDEWKAFVSKHPSLIKNMTLPYLKDITLAFPSFVTGTDIEESEM

SEQ ID NO: 42196 - protein, 396 aa, Vibrio angustum S14
MFEKITAAPADPILGLTEEFKADTRATKINLGVGIYKDETGNTPVLATVKKAEAILLEKEKTKSYLSIPGTPEYGLAVQELLFGNDATIITEKRAQTAQAPGGTGALRVAAEFIKRQLGDVKVWISNPTWANHHGVFGAAGLETQQYSYYNAETSDIDFDAAVADLSQASEGDIVLLHGCCHNPTGIDPTTEQWQVLAKLCIEKKLLPMFDFAYQGFARGVEEDAQGLRIFADQLPELLVASSFSKNFGLYNERVGAFTLVGKTAEQAATAFSQVKSIARVIYSNPPAHGAAIVTTILNNAELRAEWEQEVADMRDRIQEMRTLFVTTLKELGVTNDFSFIERQNGMFSFSGLSKDQVTQLKTDFAIYIVGSGRISVAGMTKDNMMPLCKGIAAVL

SEQ ID NO: 42197 - protein, 428 aa, Arabidopsis thaliana; identical to SEQ ID NO: 827

SEQ ID NO: 42198 - protein, 396 aa, Myxococcus xanthus DK 1622
MSRPVAAQRVTRFATTVFSEFSALAARHGAVNLGQGFPDFDGPAAIKEAAQRAIRDGGNQYAMGAGARELRVAIAEHSARFYGQTVDPDTMVTVTSGATEAILDTLLGLVDPGDEVVAFEPFYDSYDANITFVGATARFVPLRPPDADHAQWWFDRDEVRAAFSPRTRLLILNTPHNPTGKVFTRDELTFLGELCAEFDVKVLSDEVYEHLVFEPARHLRPATLPGLAERTVTVSSGGKTFSLTGWKVGWVIAPPPLRDAVQRAHQFVTFATAAPLQAAMAEALRLPDAYFTELTASYAAKRERLLTGLREAGLTAFAPEGSYFILADITRQGFADDVAFCRHLVSKVGVAAIPPSVFYGPAHRHLGQGLARFAFCKTDAVLDEAVRRLRAGLSPR

SEQ ID NO: 42199 - protein, 369 aa, Solanum tuberosum
MSQNGKLMPNLDQNSTKLLNLTVLQRIDPFIEEILITAAHVTLYEFSIDNSQWSRKDIEGSLFVVKRSSQPRFQFIVMNRRNTDNLVEDLLGDFEYEIQLPYLLYRNASQEVNGIWFYNQRECEEVANLFDRILGAYSKVPTKSKVPLTKSEFEELEAVPTMAVIDGPLEPSSSTASNAPHLPEDNSFVNFFSNAMTIGNASSTAVQGQLYHSSSATLPPPRPPASVPSSSAPVLLPSPPLSASSLLRPLHEAPEPDVSAKWSSNLVKPSSFFGPPPASSPLMPPISSSVPTAPPLLPLGNLQRPYGAPLLQPFPPPTPPPSLTPTSSSIPNNIPVVSRDKVREALVMLVQDDQFIDMVYRALLNAHHS

SEQ ID NO: 42200 - protein, 254 aa, Solanum tuberosum
MGRTFFVGGNWKCNGTSEEIKKIVATLNAGQVPSQDVVEVVVSPPFVFLPLVKNELRSDFHVAAQNCWVKKGGAFTGEVSADMLVNLGIPWVILGHSERRAILGESNEFVGDKVAYALSQGLKVIACVGETLEQRESGSTMDVVAAQTKAIAERVKDWSNVVVAYEPVWAIGTGKVASPAQAQEVHAELRKWLQANVSAEVAASTRIIYGGSVSGANCKELAGQPDVDGFLVGGASLKPEFIDIIKAAEVKKSA

SEQ ID NO: 42201 - protein, 501 aa, Oryza sativa Indica Group
MKEKGSRAAVDERYAQWKSLIPVLYDWFANHNLVWPSLSCRWGPQFEKATYKNRQRLYLSEQASAPKISCSFSFFCCRDVLKLKFMTDGTVPNTLVIANCEVVKPRVAAAEHISQFNEEARSPFVKKYKTIIHPGEVNRIRELPQNSKIIATHTDSPDVLIWDVEAQPNRQAQLAQMESRPDLVPPDSRPDLILRGHKDIAEFALAMCPAEPYVLSGGKDKSVVWWSIQDHISALGDSSKTESSPGASGSKGKTANDKDSPKVDPRGIFLGHDSTVEDVQFCPSSAQEFCSVGDDSCLILWDARSGTGPAVKVEKAHGGDVHCVDWNLHDVNYILTGVHLVQEAVDTLLDILRIILSVCGTGEIWVLEELAFQFTNLRVIKLLFFVFRHWSPDKASVFGSSAEDGFLNVWDHEKVGNKKNPNAPAGLFFQHAGHRDKIVDFHWNSSDPWTIVSVSDDGESTGGGGTLQIWRMSDLIYRPEDEVLAELENFKTHLASCAPRS

SEQ ID NO: 42202 - protein, 611 aa, Pseudomonas aeruginosa PAO1
MDQNAILLALGGIGAAALLSQWLAWRLRLPAILFLLLSGIVAGPLLGWLDPDEMFGPLLFPLVSLAVALILFEGSLTLHFSEWKEIGTVVHRMVTIGALSTWGVIALAAHYLLDFSWEMALLFGTLTLVTGPTVIVPMLRVVRPKAAVANILRWEGIVIDPIGALLAVVVYSFIISSGEGDGWLHSLQTFGGVILCGSLFGILGGWALGIVLRRHWLPDYLHNLATLAAVLGVFIASNRVMHESGLLAVTLMGMGLANMKGVDVRQILHFKENLSVLLISGLFILLAARLDINALLGLGPAALLVLLLIQFVARPLNVALSTWGSPLSWRERALLSWIAPRGIVAAAVSAIFAIRLSAEGHAQAALLVPLTFLVIIGTVVLQSATARPLARLLKVAEPSPSGYLIVGANPVGRAIGKALKSLGSRVLLTDSSWENIRAARMDNLPTYFGNPTSQHAEAHLDLVGIGHLLGVSPAGELNTLAAMRFRHEFGHRQLFGLPTSQEAKRTDKHRSSDEHRGRPLGQRPLTYAQFASLLSRGAEIRTTLLTDTFGWNDYQALHGESAILLFARDPNGRMHVATPQSTLAPGTGWTLLSLIDAEPSVSKSQATEIAD

SEQ ID NO: 42203 - protein, 447 aa, Geobacter sulfurreducens PCA
MDFKSFGFHPAVATGIAAAGYETPTPIQAQAIPAVMAGRDVMGLAQTGTGKTAAFALPILHRLQQGERGRVRALVIAPTRELAEQINDSFVTLGRQTRLRSVTVYGGVGVNPQVQKLKAGAEVVVACPGRLLDHIAQGTIDLSRLEVLVLDEADQMFDMGFLPDIRRVLKHLPPRRQTLLFSATMPIDIRTLAQDILVDPVTVQVGTVAPAVTVAHALYPVEQHLKTPLLLELLRHTDTESVLIFTRTKHRAKRLGEQLEKAGYRAASLQGNLSQNRRQAALDGFRDGTFQILVATDIAARGIDVSQVSHVINYDIPDTAEAYIHRIGRTGRAARSGDAFTLVTSDDGAMVRAIERSLGAPIERRTVQGFDYSVPAPKKDVEFARPPREPRQARPHANQPKKGGAAASPSASGRPSHPKDSGRRQPGQGAPASGPSRQRPGSPRRPR

SEQ ID NO: 42204 - protein, 215 aa, Xylella fastidiosa Ann-1
MSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMTLTDGQPVWREGVITDNGNVILDVHHLCITDPVKLEQELNQIPGVVCVGLFARRCADLVIIGSEPPHIL

SEQ ID NO: 42205 - protein, 319 aa, Zea mays
MMAKANGAVHASTKEPLFSFGVIADVQYADIPDGRSFLGVPRYYRHSITVLQRAVNRWNEQGNIKFSINFGDIIDGYCPKDKSLWAVQKVLDEFDKFDGPTYHMIGNHCLYNLPRSQLVSLLKIATDSDRAYYDFSPCPGFRIVVLDAYDFSCLGWPHDHPVTIAAMKLLDEKNPNTDKNSPDGLVGVDRRFVKFNGAVGKEQVSWLNDVLQDASTQHQNVIICSHLPMDPGASSPAALMWNYDEVMAIVHQYNCVKACFAGHDHKGGHSVDSHGVHHRTLEAALECPPGTSAFGHVEVYPNRLLLVGFDRMADTEVRF

SEQ ID NO: 42206 - protein, 357 aa, Vitis vinifera
MGIYLSTPKTEKLSEDGENGRVRYGLSSMQGWRATMEDAHAAYPDLDASTSFFGVYDGHGGKVVAKFCAKYLHQQVLKNEAYTAGDLGTSVQKSFFRMDEMMRGQRGWRELAVLGDKINKFTGMIEGLIWSPRSSSDGNDHVDDWAFEEGPHSDFAGPTSGSTACVAIIRNNQLVVANAGDSRCVISRKGQAYNLSRDHKPDLEVEKERILKAGGFIHAGRVNGSLNLARAIGDMEFKQNKFLPPEKQIVTANPDINTVELCDDDDFIVLACDGIWDCMSSQQLVDFIQEQLILESKLSAVCERVLDRCLAPSTAGGEGCDNMTMILVQFKKPITATPSGEQSSSCNQADTEPKPTE

SEQ ID NO: 42207 - protein, 284 aa, Vitis berlandieri x Vitis rupestris
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAIKALGSFRSTPRV

SEQ ID NO: 42208 - protein, 286 aa, Vitis berlandieri x Vitis rupestris
MEGKEEDVRVGANKFSERQPIGTAAQGDDKDYKEPPPAPLFEPGELCSWSFYRAGIAEFIATFLFLYVSVLTVMGVVRADSKCSTVGIQGIAWAFGGMIFALVYCTAGISGGHINPAVTFGLFLARKLSLTRAVYYMVMQCLGAICGAGVVKGFEKGRYNSLGGGANVVNAGYTKGDGLGAEIVGTFVLVYTVFSATDAKRNARDSHVPILAPLPIGFAVFLVHLATIPITGTGINPARSLGAAIIYNKDHAWDDHWIFWVGPFIGAALAALYHQVVIRAIPFKSK

SEQ ID NO: 42209 - protein, 370 aa, Kalanchoe blossfeldiana
MAIEKQLQGEQTPLVFDASVLSHQTQIPKQFIWPDEEKPLPNLRELPVPLLDLNGFLAHDAAATNEAAKLVGEACEKHGFFLVVNHGVDAKLLADAHKYMDHFFDLPLAEKQRAQRKVGEHCGYASSFTGRFSSKLPWKETLSFRFSAEENKADIVREYFKSTMGEDFEHLGRVYQHYCKAMSRLSLGIMELLGMSLGVGRDYFRDFFEENDSIMRLNYYPPCQKPDQTLGTGPHCDPTSLTILHQDQVGGLQVFADNEWWSISPMADAFVVNIGDTFMALSNGRYKSCLHRAVVNSQSPRKSLAFFLSPKGDRVVSPPNQLVNPTVPRIYPDFTWPKLLEFTQKHYRADMNTLDAFSSWIQGHVLQYHT

SEQ ID NO: 42210 - protein, 286 aa, Vitis berlandieri x Vitis rupestris
MEGKEEDVRLGANKYTERQPIGTSAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGAGVVKGFQGHQYEVLGGGANVVAAGYTKGDGLGAEIVGTFVLVYTVFSATDAKRNARDSHVPILAPLPIGFAVFLVHLATIPITGTGINPARSLGAAIVYNKEHAWDDMWIFWVGPFIGAALAALYHQIVIRAIPFKSRA

SEQ ID NO: 42211 - protein, 788 aa, Agrobacterium tumefaciens str. C58
MEYGPSPEANGDVKQWLDAHGRSFGHYINGRFVSPDGRKTIAVSNPANGDKLAEIVCGNEEDVDQAIKAARAAFGKWSKLSGHARARYLYAIARHIQKRERFLSVLETMDNGKPVRETRDIDIPLVARHFYHHAGWAEMVEDEFHGFSPVGVCGQVIPWNFPLLMLAWKIAPALAAGNTVVLKPADLTPLTAIAFAEICHEVGLPAGVVNIVQGDGSTGAAICGHDGVDKVAFTGSTKVGRVIREQIAGSGKKLSLELGGKSPFIVFEDADLDAAVEGVVDAIWFNQGEVCCAGSRLLVQEGIAEKFYARLKKRLETLRVGDPLDKSTDVGAIVSATQVKRITDLVRKGVEEGGELWQSSNPLPPTGNYVAPGFFTDVDQASTVCQVEIFGPIAAATTFRTPDEAVSLANNTRYGLAASIWSENINVALDLAARVKAGVVWINCTNMLDAGAGFGGYRESGFGREGAREGLYEYLAADWEKNLSVSKPAEAFAPSALPNADSKKAIDGLDRTMKNYIGGKQARPDGGYSYSVTGKGNAVIGMAGIGNRKDIRNAVEAASKAGSWSSATAHNRAQVLYYLAENLNARRDEFVARIIDSTGVSEKKARDEFDASLRRISYYAAQADKFDGAIHSTKSRHVTLAMNEPWGIVGIVCPDEAPLLSLVSLVLPAIAMGNRVVVIPSSRHPLIAGDFYQVLDTSDVPGGVINIVTGERDMLAKTLAEHDDVAAIWYFGSAVGSAMVERASAGNLKAAWVNNGRQPDWLDRTQWQGRDYLRRAIQVKNIWVPYGA

SEQ ID NO: 42212 - protein, 287 aa, Vitis berlandieri x Vitis rupestris
MEGKEEDVKLGANKFTERQPLGTAAQTDKDYKEPPPAPLFEPGELKSWSFYRAGIAEFMATFLFLYITILTVMGVKKSSTMCASVGIQGIAWAFGGMIFALVYCTAGISGGHINPAVTFGLLLARKLSLTRAIFYIIMQCLGAICGAGVVKGFEGSQSYEVLGGGANVVNSGYTKGDGLGAEIVGTFVLVYTVFSATDAKRNARDSHVPILAPLPIGFAVFLVHLATIPITGTGINPARSLGAAIIFNREHAWDDMWIFWVGPFIGAALAAMYHQIVIRAIPFKSRA

SEQ ID NO: 42213 - protein, 420 aa, Staphylococcus epidermidis RP62A
MAEVKVPELAESITEGTIAEWLKNVGDNVDKGEAILELETDKVNVEVVSEEAGVLSEQLAEEGDTVEVGQAVAVVGEGQVNTSNDSSNESSQKDEAKEKETPKQSNPNSSESENTQDNSQQRINATPSARRHARKNGVDLSEVSGKGNDVLRKDDVENSQKSSSQTAKSESKSQNSGSKQTNNNPSKPVIREKMSRRKKTAAKKLLEVSNQTAMLTTFNEVDMTNVMDLRKRKKEQFIKDHDGTKLGFMSFFTKAAVAALKKYPEVNAEIDGDDMITKQFYDIGIAVSTDDGLLVPFVRDCDKKNFAEIEQEIANLAVKARDKKLGLDDMVNGSFTITNGGIFGSMMSTPIINGNQAAILGMHSIITRPIAVDKDTIENRPMMYIALSYDHRIIDGKEAVGFLKTIKELIENPEDLLLES

SEQ ID NO: 42214 - protein, 279 aa, Vitis berlandieri x Vitis rupestris
MSKEVSEEGQSHGKDYVDPPPAPLIDIAEIKLWSFYRAVIAEFIATLLFLYITVATVIGYKKQSDPCGGVGLLGIAWAFGGMIFILVYCTAGIAGGHINPAVTFGLFLARKVSLIRALAYMVAQCLGAICGVGLVKAFMKSFYNSLGGGANSVAAGYNKGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 42215 - protein, 570 aa, Vitis vinifera
MLRVLGRRASTSHQWRNPVSLLQKCQFCIGVLPDGVDRQSPSFSQNSAIMNDYISELKSHVQKVLGGGGAESVRRNRSRNKLLPRERIDRLLDPGSSFLELSQLAGHELYEEPLPSAGIITGIGPVHGRLCMFVANDPTVKGGTYYPITVKKHLRAQEIAAQCKLPCIYLVDSGGAYLPKQADVFPDRDNFGRIFYNEAQMSAEGIPQIALVLGSCTAGGAYIPAMADESVMVKGNGTIFLAGPPLVKAATGEEVSAEDLGGATVHCKTSGVSDYFAQDELHGLAIGRNIIKNFHMAGKLGIVNELQNIIPEFKEPVYDVKELRSIAPADHKQSFDIRSVIARIVDGSEFDEFKKLYGTTLVTGFARIFGQPVGIIGNNGILFNESALKGAHFIEICTQRNIPLVFLQNITGFMVGSRSEANGIAKSGAKMVMAVSCAKVPKITIIVGGSFGAGNYAMCGRAYSPNFMFLWPNARISVMGGAQAAGVLSQIERGNKKKQGIQWPKDEEEAFKAKVVEAYEKEGSSYYSTARLWDDGIIDPADTRKIIGLCISATTTNHAPEDTKYGVFRM

SEQ ID NO: 42216 - protein, 789 aa, Methylobacillus flagellatus KT
MLDYVIAFDKLRISDVPAVGGKNASLGEMISQLTAKGVRVPGGFATTAHAYRQFLAQDGLDKRINAELDKLDVDDVDALAATGEKIRQWIVDTAFPKELQDAIAEHYKALTADSGDDMTFAVRSSATAEDLPDASFAGQQESFLNIHGLDNILHAIKEVFASLYNDRAISYRVHKGFIHADVALSAGVQRMVRSNLGSSGVMFTMDTESGFRDVVFITSSYGLGETVVQGAVNPDEFYVHKPLLAQGFPAIVRRTLGSKLIKMVFSDSNVAGKSTHTVENSKEDSARYSITDEEILELARFAVLIEEHYKCPMDVEWGRDGVDGKLYILQARPETVKSQSGNVVEKFQIDSSGNTALITGRAVTQKVGSGPVRVVKHASQMNTVQPGDVLVADMTDPNWEPVMKRASALVTNRGGRTCHAAIIARELGIPAIVGSVNATDLLEDGKVVTVSCAEGETGYVYAGAVPFSVTQEEEAKLPPAPVKVMMNVGNPDMAFSFAQIPNDGVGLARLEFVINNMIGIHPKAILHLDSVPADLQEEIKRRSKGYESPRQFYIDKLAEGVATIGAAFWPKPVIARMSDFKSNEYRKLIGGEIYEPEEENPMLGFRGAARYISPDFEDCFELECIAMRKVRDQFGLTNVELMIPFVRTLDEARKVVEILAKHGLKRGENGLRLIMMCEIPSNALLAEQFLEYFDGFSIGSNDLTQLSLGMDRDSGLVAAGFDERDPAVKVLLEMAIDTANRLGKYVGICGQGPSDHPDFAEWLVEKGIKSVSLNPDTVISTWQRISKSK

SEQ ID NO: 42217 - protein, 183 aa, Solanum tuberosum
MNMYAYQQKALVGCVGVGETGRADISVSNGVVCPKPRKLGFFDSDSVNVEEPIRPYQLMQFINEEMEACELKAGAELLDIILTKGSYEVDRANFEVDSSPPFFYGSPPSRAGNPLIQDAQFGNHNFVPILPIPERAVAPSPPPPSSTIMSGGGCVRVKFGNKQAPVRIEGFNCRGNCGISAVA

SEQ ID NO: 42218 - protein, 338 aa, Yersinia pestis biovar Microtus str. 91001
MYVLVTGGSGYIGSHTCVQLIEAGYKPVILDNLCNSKSSVLARIHSLTGYTPELYAGDIRDRTLLDSIFAAHPIHAVIHFAGLKAVGESVNRPLEYYNNNVFGTLVLLEAMRAAQVKNLIFSSSATVYGDQPQIPYVESFPTGSPSSPYGRSKLMVEQILQDVQLADPQWNMTILRYFNPVGAHPSGLMGEDPQGIPNNLMPFIAQVAVGRRESLAIFGNDYPTPDGTGVRDYIHVVDLADGHVAAMKTLHGKPGVHIFNLGAGVGHSVLQVVAAFSKACGKPLAYHFAPRREGDLPAYWADATKAAEQLGWRVSRSLDEMAADTWHWQSKNPQGYPD

SEQ ID NO: 42219 - protein, 476 aa, Ralstonia eutropha JMP134
MKTSFINGKFVEGGDARANINPSDTHDVIDQFGEADALMATTAVDAAAESFRTWSQTSIQRRADALDSVGTELLARKEELGRLLSREQGKILPEGIAEVDRAGRIFKFFAGEAVRPAGVHAASVRDGVEIHVTSEPLGVVGIISPWNFPMAIPAWKIAPALAYGNTVVFKPAELVPSSAWALADIISRSGFPPGAFNLVLGAGRVVGNAMLTDPRVTGISFTGSTGVGARVMETAGRRFAKLQLEMGGKNPLVVLDDADLEVALNCSIQGSFYSTGQRCTASSRIICTKGIYPTFRKALAERVAALRVGHALHGDTQIGPVVDKSQLDSNLHYVSVGRAEGATLVCGGELLAKETRGFFMSPALFADVTNDMRIAREEIFGPVSCLIVADDFEHAIQIANDTDFGLSAGICTTSLRYATRFRREVKAGMVMVNVPTAGVDYHVPFGGTKASSYGAREQGSFARHFFTSTKTSYSGW

SEQ ID NO: 42220 - protein, 645 aa, Geobacter sulfurreducens PCA
MLHLRKLSKDFAGTSLFAEIDWHLKKGERVGLVGENGAGKSTLMRIVAGLVEQTSGELIFARGATVGYLPQDGIVTRGRGLLAEAMTALEDLQSLERELHELTSRLENISHDAPEHGECLERYGRLQEEFRLRGGYSMEAEACRVLDGLGFTTGDRQRDCGEFSGGWQMRIALAKLLLKKPNVLLLDEPTNHLDIEARNWLEGYLQEYPHSVILVSHDRFFMDQVCHRITEVWNGTLTDYHCSYSRYLTAREERVAALLEAKRRQDEEVAKIEDFINRFRYKADKAALVQSRVKQLEKIERIVLPPERKKIRFRFPDPPKSGRIVLELKGVTKAYGSHVVLDGIDLTVEKGERIALVGHNGAGKSTLMGVLAGKPFQGGERIAGHNVVADYFAQDQAQVLDGAKTAHEELLADAPFDMVPQLRDILGAFLFTGDDIHKRVEVLSGGERNRLALAKMLLRPSNLLLMDEPTNHLDLFSKEVLLDALKTFAGTVVFVSHDRHFIDGLATRVVEVEGGRLTSYHGDYEYYLRKKAADDCPAPQAAAGRSQVPDASAGSPTAESKEERQRQREEEKARQRDEKRRLKRLEELESAIAAEEGLLADLEARMADPAFFDDHEQARRGGEEHAGLTARIASLYEEWESVAAG

SEQ ID NO: 42221 - protein, 147 aa, Solanum tuberosum
MLPLSLLKTAQGHPMLVELKNGETYNGHLVNCDTWMNIHLREVICTSKDGDRFWRMPECYIRGNTIKYLRVPDEVIDKVQEETKSRGDRKPPGVGGRGRGRGGRDEGAAGRQAKGIGRGMEDAGAKGRGKGGPGAKSGGKGGGRGRG

SEQ ID NO: 42222 - protein, 111 aa, Brassica napus
  misc_feature (34)..(34): Xaa can be any naturally occurring amino acid
  misc_feature (36)..(36): Xaa can be any naturally occurring amino acid
  misc_feature (38)..(42): Xaa can be any naturally occurring amino acid
  misc_feature (48)..(50): Xaa can be any naturally occurring amino acid
  misc_feature (59)..(59): Xaa can be any naturally occurring amino acid
MAYSMLSSAAVVTSPAQATMVAPFTGLKSSSAFXVXRXXXXXFTSIVXXXRRVSCMPVXSLLSPVPPRRYPPVAPLFACALPARAFGPSAGLAFLPRLPPPARCRRRAFVS

SEQ ID NO: 42223 - protein, 412 aa, Oryza sativa
  misc_feature (188)..(188): Xaa can be any naturally occurring amino acid
MAPRKKKEVFASSQGKQIRFLHYKAETPPQRQEPNRLLLPKRPKPPTSSRPFSPPPPPPPPTRRRPMGSEEEPSQMRRALVDALAGAISGGISRTVTSPLDVIKIRFQVQLEPTTSWGVLRRDVYGPSKYTGLLQASKDILREEGLPGFWRGNVPALLMYMPYTAIQFTVLHKLKTFASGSSKTVLTXICVICPEDHLHLSPYLSYVSGAIAGCAATVGSYPFDLLRTILASQGEPKVYPDMRSAFLDIMKTRGFRGLYAGLTPTLVEIIPYAGLQFGSYDTFKRSMMTWNRYRYSHLNSGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWIGSKAGVE

SEQ ID NO: 42224 - protein, 199 aa, Triticum aestivum
  misc_feature (82)..(84): Xaa can be any naturally occurring amino acid
  misc_feature (141)..(141): Xaa can be any naturally occurring amino acid
MDLMIITSGQGASSSQAIYLHSTTMAPTVMASSATSVAPFKGLKSTAGLPVSRRSNGASLGSVSNGGRIRCMQVWPIEGIKXXXTLSYLPPLSTEALLKQVDYLIRSKWVPCLEFSKVGFIFREHNASPGYYDGRYWTMWXLPMFGCTDATQVINEVEEVKKEYPDAYVRIIGFDNMRQVQCVSFIAFKPPGCAQSGKA

SEQ ID NO: 42225 - protein, 450 aa, Pseudomonas putida KT2440
MQPDHSASGNGQLRKTLRLWHVIIIGLAYLTPMTVFDTFGIVSGITAGHVPSAYILALAGILFTAVSYGTLVKRFPQSGSAYTYTQRAINPHVGFLVGWSSLLDYLLLPMVNALLAKLYLSAMFPEVPEWMWVAGFVTLISLINMRSVNLVAHFNLLFVGVQVAIIAVFIYLCVRGLDQGEGLGTTWSLIPFADSQTQFSALAAGATILCFSFLGFDAVTCLSEETRDPAKTIPRAIFLTALIGGVVFITVSYFIQAYFPTMARFHDQEAALPEIALYVGGKLFQSIFIACTVINTIASGLASQTSVSRLLYVMGRDNVIPASVFARLHSRYKTPVLNIAVVGLISLSAIFFDLVTATSIINFGALVAFSFVNLSVINHCYLREGNRKGLANQLKYLVLPTIGFCIIVSLWLDLNAHSLMFGGIWAALGLVYLGWLTKAFRAAPPNYVAE

SEQ ID NO: 42226 - protein, 385 aa, Zea mays
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 42227 - protein, 109 aa, Vitis amurensis
RITAKGSYSEREAADICRQIVTVVHVCHFMGVMHRDLKPENFLMVSREENSPLKATDFGLSVFIEDNEVYKDVVGSAYYVAPEVLRRSYGKEIDVWSAGVILYILLSGV

SEQ ID NO: 42228 - protein, 174 aa, Pseudomonas aeruginosa PAO1
MKYRLGDARVETHPDSWIAPSAAVIGKVRLDAGASVWFGAVLRGDNELIHIGEHSNVQDGSVMHTDMGYPLTLGKGVTVGHNAMLHGCSVGDYSLVGINAVILNGAKIGKYCIIGANALIPEGKEIPDGSLVMGSPGKVVRELSEPQKKMLEASAAHYVHNARRYARDLVEDPA

SEQ ID NO: 42229 - protein, 109 aa, Vitis amurensis
RIIAQGHYSERAAAAICRAIVNVVHICHFMGVMHRDLKPENFLLSSKDEAAMLKATDFGLSVFIEEGKVYRDIVGSAYYVAPEVLRRNYGKEIDIWSAGVILYILLSGV

SEQ ID NO: 42230 - protein, 935 aa, Oryza sativa Indica Group
MLSLAASSLPSTRTHRPDAASHSSSSSVRLLRSLARSRRADLAHRALLLFRSLQSTPSPPPPHVSLPAVLSAAAFLSALPEGRQLHALAAKLGLAPSHTVVANSLLHLYSSCGLPGAALDLFRRIPDRSLVSWNTAVDALVGNGDHLAALDLFREMQRDTELAPDAYTVQSVLGACAGAGALSLGVYAHALLLRELGGDGDGEAVSRDMLINNSLVDLYGKCGALELAQQVFDRMPARDLASWNVMILTLANHGRVCESVELFDRMTQVEKMAPNAITFVAVLSACNHGGLVEEGRRYFAMMVDQYRIKPRIEHYGCMVDLLARAGFIEEALDIVAGMNCRPDAIIWRSLLDACCKKNAGLELTEAMAKLALEVPDDAVSGVYVLLSRVYASAQRWNDVGMVRRLMVEEGVKKEPGFSSIEMDGLVHQFVAGDTSHPQSEAIYEKLDEIQLKLTSAGYKPDLSEAPLVASIDNAKGAALRLHSERLAISFGLLNATPGAPIRILKNLRVCKDCHTISKLISKLYGVEIIVRDRIRFHHFKDGSCSCKDYWVTSCARHDLTKQKITCNQSYAQLISRRKEERLPRGEREITRLAARPRRGGSRELFERARTVRLRGHHDKYLYAEEDESRVSQDRSASSPNARWSVEPVPHAPGVLRLRSHYGRYLSASNEPFLLGVTGRKVLQALPHRLDSSVEWVPVRDGAHARLRTRYGNYLRANGGLPPWRNSVTHDVPHRHAGWILWTVEVVEVLPESLVPAPIASDDDPAAPHYKTPSRGPSPVPTPALAPASPPRHRPASPPSYLARPPPPPPGYIEPPQGYIEPPPPEPTLARIESTESFSLPLHKVDGRAIHYHIGDDNGDIGDDQEGHSFTFNGTSLEELLERLQEETGLNDVIICSRSPINGKLMPLRLQLPPNNAAMHIVLVRESSKGDLILVE

SEQ ID NO: 42231 - protein, 506 aa, Vitis vinifera
MIVEEENPPTPSEVVEENESNGGFCDFICAPIYWFKMLAMELHWSFVFGVVAVYGISQGLGGALARVGTEYYMKDVQKVQPSEAQIYGGITSIPWLVKPLWGLLTDVLPIVGYHRRPYFILAGLLGVISMLVLSFHKDLHLVLALFSLTAGSAGVAIADVTIDACVAQNSNLHPSLAADMQSLCALSSSVGALVGFSISGIFVHLIGPTGVFGLLTIPATLVLLVGIVLSEPHTPNFVYRQVNQKLLDACKAMWTTLKYPDVWRPCLYMYLSLALSLNIHEGLFYWYTDSKEGPLFSQETVGYIFSIGSVGSLLGAILYQYTLKDHPFRDLLFWTQLLYGLSGMLDLILVLRLNLKYGIPDYFFIVVAEGVSQMIGRLKWMPLLVLSSKLCPPGIEGTFFALLMSIDNLGILSSSWGGGFLLHILKVTRVQFDNLWMAILIRNILRLSPLALLFLVPRTDPNSSIIPSQILQNTKQAAHASHPENENKNEDGNIELLPLVNNVDSR

SEQ ID NO: 42232 - protein, 477 aa, Bordetella bronchiseptica RB50
MRTITSLIDGQWAGGAGDSENINPSDLSAPVCLVAQASAQQAAQAVEAARRAQPGWAATGLAARAQILKDIGRGIVANSQQLAHTLASEQGKTLPEARGEVQRAADIFDYYAGEVFRLGGEMFPSIRAGVEVEISREPLGVVALITPWNFPIAIPAWKTAPALACGNAVVLKPSEFTPATAVMLAEIIRAAGVPDGVFNLVLGTGADVGQVLTGHPAVAGVSFTGSSATGRKIAASAVAGHKKLQMEMGGKNPLVVLDDADLEIALACALDGAFHATGQRCTASSRLIVTPGIYNRFVQELAQRVMALNVGHALDERSQIGPVSNGAQFDKDLSYIALARDEAQRVVGGAALQRAQRGYYLQPCLALDVSLDARIAREEVFGPLACVLRAQDYEHALAIANDTEYGLSAGICTQSLKHATHFRRHVQSGLAMVNMPTSGVDFHVPFGGRGASSYGSSEQGHYAREFFTSLKTSYIRP

SEQ ID NO: 42233 - protein, 465 aa, Vigna radiata
MAVARSDSNSEPCTSYNCYNVAALTETILETSQVSNLKDRYVLGEQLGWGQFGVQDCSDKLTGEVLACKSIAKDRLVTSDDLRSVKLEIEIMARLSGHPNVVDLKAVYEEEGFVHLVMELCAGGELFHRLEKHGWFSESEARVIFRHLMQVVLYCHENRVVHRDLNPENILLATRSSSSPIKLADFGLATYIKPGQSLHGLVGSPFYIAPEVLAGAYNQAADVWSAGVILYILLSGTPPFWGKTKSRIFEAVKAASLKFPLEPWDRISESAKDLIKGMLCTDPSRRLTAQEVLDHCWMESNQTNQEQLGENQIQSCKQWDVGGSSFSASFSPGIRTLAFSLALLHVMLNRPTFTCRSSFSSFLEEPVTPCVLSAGFSFKSVGDSSGLEFSSPIPSMLSFSFLSPSPVVEHKSCKLGCSANMSDVDAIAGEASLESYFYYKILNLCIEHDAKETNRKPTEAKRSIE

SEQ ID NO: 42234 - protein, 573 aa, Oryza sativa Japonica Group
MAGVATGGVEDAYGEDRATEDQPITPWAVCVASGHSLLRDPRHNKGLSFTEKERDAHYLRGLLPPVVLSQELQEKRLLQNVRQFQVPLQRYMALMDLQERNERLFYKLLIDNVEELLPVVYTPTVGEACQKYGSIFRRPQGLYISLKEKGRILELLRNWPEKSIQVIVVTDGERILGLGDLGCQGMGIPVGKLALYTALGGVRPSACLPITIDVGTNNEDLLKDEFYIGLRQKRATGQEYSDLLDEFMAAIKQNYGQKVLVQFEDFANYNAFTLLEKYRANNLVFNDDIQGTAAVVLAGLIAAQKFVSGTLADHTFLFFGAGEAGTGIAELVALEISNQSKVPVEDARKKIWLLDSKGLIVSSRKDSLQPFKKRYAHEHEPVKDLLDAVKVIKPTALIGSAGVGQSFTKEVIEAMSSINERPIILALSNPTSQSECTAEQAYSWSKGRAIFGSGSPFDPVKYNDKLFVPAQANNAYIFPGFGLGVVISGAIRVKDEMILAAAEGLADQVTPEHVDKGLIYPPFSCIRKISANIAARVAAKAYDLGLASHLPRPKDLVKYAESCMYSPIYRSYR

SEQ ID NO: 42235 - protein, 427 aa, Vibrio angustum S14
MQEANNIDIDFDKEHVWHPYTSTVTPLPCYPVTSAQGVYLTLEDGTQLIDGMSSWWSTIHGYNHPVLTEAAKAQLDKMSHVMFGGITHQPAVDLCKKLIAITPDPLDKVFLADSGSVAVEVALKMALQYWHAQNESRAKFLTVSHGYHGDTFAAMSVTDPTNSMHSIYKGFLPEHIFAKSPECGFGDNWDETDIADFEEKMRLHHQDLAAVIIEPIVQGAGGMRFYHPTYLKRIRELCDKYNVLLIADEIAVGFGRTGKLFACEHAEISPDIMCLGKALTGGYMTLSATLTTKHVADTVCSGEAQCFMHGPTFMGNPLACAVANASLDLLAENKWQQQVTNIEQQLAQELPLIAELENVKSVRWLGAIGVVELHHPVEMKSIQEKFVQQGVWVRPFGKLVYIMPPFIISSSQLTLLTTAIKKVISSI

SEQ ID NO: 42236 - protein, 165 aa, Xanthobacter autotrophicus Py2
MVTTRKESAGDASLNAGLEGARVLIVEGRYYEALADELLAGARAVLEAAGVEVEVITVPGALEVPIAAEIALEAAEITGNAVDAVVGLGVVIRGETYHFEIVAGESARGLMDLGMAHALPVGNGILTVDTEAQAWERARVSEGNKGGGAAEAALTLLRLRRRLEA

SEQ ID NO: 42237 - protein, 129 aa, Brassica oleracea
VSCSAGPVGDDMFHWQATIMGPTDSPFSGGVFLVSIHFPPDYPFKPPKVSFAPRFTTDINSNGSICLDILKEQWSPALTISKVLLSICSLLTDPNPDDPLVPEIAHTYKTDRVKYESTARSWTQKYAMG

SEQ ID NO: 42238 - protein, 431 aa, Synechococcus elongatus PCC 6301
MIHEVFMPALSSTMTEGKIVEWVKAPGDRVEKGETVLIVESDKADMDVESFYEGYLATIIVPAGGNAPVGEAIALIAETEAEIEVAKQQAAGAGSAAATPATPAATAAPEPVAVSPEPVAAPTATRSDRLVASPRAKKLAKSLGVDLGSLTGSGPHGRIVAADVEAAAGVTAKPAIATPVAPAVVTAPVAAPVATAPAAPAPTPAIAPGQFVPYSTFQQAVVRNMEASLNVPVYRVGYTITTDAIDSLAKQLKPKGVTITVLLAKAVAATLAKHPLLNARVTETGVQYNEAINVAIAVAMDDGGLLTPVLGRADQTDLYSLARNWKDLVARSRTKQLKPEEYTTGTFTLSNLGMFGVDRFDAILPPGTGAILAIGASKPTLVATADGLFGVKRQMQVNLTCDHRHIYGAHAAAFLKDLADLIENRPESLTL

SEQ ID NO: 42239 - protein, 173 aa, Oryza sativa Indica Group
MSNPELSSEKKASLVETLKNKLQALAEQHVDVLESLAPVVRKRVDVLIEIQSQHDELEAKFLEEKSALEAKYHKLYGPLYSKRSEIVSGVLEVEGETEEREEKGVPDFWLKAMKNNEILAEELAHVARSTLRDKIIPHAVSWFTGEAVQDEDYGASWVDDEEDDDDEYSDEEA

SEQ ID NO: 42240 - protein, 511 aa, Rickettsia conorii str. Malish 7
MTINPSNVENSSSKINSYFSKLTDYIWPIKRHEVSKFLFITLLMFCILFIQNLIRALKDSIVTTMIGAEIISFLKFWGVMPSAFLMTAIYVKLVNKMKAENIFYLIISIFLTFFALFAYVIFPNHEMLHFSPVTVQNLMASLPNLKWFIWLLSKWSFSLFYIIAELWPNVVFALLFWQFVNNITTVEESKRFYPLFGLLSQTGIYLAGQFLENLSNINDYVTNKFALQSSFHTLSIQIILTIVLILGIIAIKTFWLLNHKVLDKEHMALLRFKAKKKSMTIAESFQMLLSSRHIRLIATLLICYGIAINLVEGPWKAAATKIYKTPTEYAAFIGSYLSYTGVFTILFVVLGSNIVRRLGWFTAAVITPLIVFITGILFFAVNNFERFAGLIIANFILTDPALIAITIGAIQNVLSKSSKYTLFDSTKEMAYVPLDPEIKIKGKAAADVIGTKLGKSGSAFLQSLVFIILPSASYQSISTCLMIIFIITCLTWLWATKALNKEYKNSIKFSQ

SEQ ID NO: 42241 - protein, 427 aa, Xanthobacter autotrophicus Py2
MTAIVDIIGREILDSRGNPTVEVDVVLEDGALGRAAVPSGASTGAHEAVELRDGDASRYLGKGVGMAVDAVNGEIFDAIGGYEAEDQAHIDAALLALDGTPNKGRLGANAILGVSLAVAKAAAESKGLPLYRYVGGVNARVLPVPMMNIINGGAHADNPIDFQEFMILPAGAPSFAEGLRWGAEIFHTLKKGLKDAGHNTNVGDEGGFAPNLASAEAALEFVLKAIEKAGFKPGEDVYLGLDCASTEFFKNGVYNYEGEGTVRDIEAQVAYLAELVAKYPIVTIEDGMAEDDWVGWKLLTDTVGSKCQLVGDDLFVTNVERLSRGIKDGVGNSILVKVNQIGSLTETLDAVEMAHKAGYRAVMSHRSGETEDATIADLAVATNCGQIKTGSLARSDRTAKYNQLLRIEQELGDSARYAGKAALKALA

SEQ ID NO: 42242 - protein, 405 aa, Escherichia coli CFT073
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAAAPAAQPTLAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEDPTRLLLDV

SEQ ID NO: 42243 - protein, 310 aa, Synechococcus elongatus PCC 6301
MRKPFLKSIGRLLVVVLLVGSLTLSAAQSAWAARGGRIGGGSFSAPSRSFSSPSRSYSGGGGGYYRGGGGFGFPFVLPLFFGGGGGLFGFLIMIAIAGFLLRAFQNASGGEGNNARLAPVSNSQVAIAQVQVGLLAGARSLQRDLEALAMRANTNSKTGLANVLQETTLALLRHPEYWAYGSAEAQKVTWGTAENAFNRLTLMERSKFSGEGVSNVDGQVKQATHTATAIDPLSQAPAEYIVVTLLVAATTQLRLPALNSTSDLQQALRQIGAIGSESLLAVEVLWSPDSESESLTRDDVMANYPDLRVL

SEQ ID NO: 42244 - protein, 371 aa, Oryza sativa
MGFSGGFVRGSICRSPLSSPFLRGWWWLRRCPHHHHLTSPQLASSALTNRSARRRGLDWVGLDWRERMAAPSSLASSHLSRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 42245 - protein, 558 aa, Vitis vinifera
MGNTCVGPSISKNGFFQSVSAAMWRSRAPEGSASYTNGETMDEPQATTKEPGSPLPVQNKPPEQMTIPKEEQPTKPKKPHQIKRVSSAGLRIESVLQTKTGNFKQFFILGRKLGQGQFGTTFLCVQKATRKEYACKSIAKRKLLTDEDVEDVRREIQIMHHLAGHPNVISIEGAYEDAVAVHVVMELCKGGELFDRIIQHGHYTERKAAELTRTIVGVVEACHSLGVMHRDLKPENFLLVNEEEDSLLKTIDFGLSVFFKPGEKFTDVVGSPYYVAPEVLRKRYGPEADVWSAGVILYILLSGVPPFWAETEQGIFEQVLHGDLDFSSDPWPSISESAKDLVRRMLVRDPRRRLTAHEVLCHPWVQVDGVAPDKPLDSAVLSRLKQFSAMNKLKKMALIVIAENLSEEEIAGLKEMFKMIDTDNSGQITFEELKAGLKRVGANLKESEIYDLMHAADVDNNGTIDYGEFIAATLHLNKVEREDHLFAAFSYFDKDGTCEEFGLEDVRLEEMIREVDQDNDGRIDYNEFVAMMQKGNPGIGKKGLQTSFSMGFREALKH

SEQ ID NO: 42246 - protein, 842 aa, Pseudomonas aeruginosa PAO1
MNNKNLALKAPLSGPVMPLNRVPDPVFSSGTLGEGIAIDPLNDCLHAPCAGLVSHLARTRHALSLRADNGAELLLHVGLDTVQLQGEGFEALVEEGARVIEGQPLLRFDLDRVARGSRSLITVMILTNGDGFQVRPLTTNPVEVGAPLLQLSPEKAEQRPANPAPGEGSAQRQVRGRARVAHHGGLHARPAALLRKTAQGFSSQAELHFAGQVASVDSLVGIMGLGVAEQDEVEVICRGEDSEAALGALLAALASATAGAPKDAPRAIAPGEPARPAAVAGTLAGVCASPGLASGPLARLGAISLPADDGRHRPEEQHLALDQALQRVRDDVQGSLQQARLGGDENEAAIFSAHLALLEDPGLLDAADMLIDQGVGAAHAWHRAIQAQCEILQALGNLLLAERANDLRDLEKRVLRVLLGDTAPLRVPAGAIVAAREITPSDLAPLVDAGAAGLCMAEGGATSHVAILARSKGLPCLVALGAGLLELEEGRQVVLDAGQGRLELSPDARRLEQVALQVAQREEQRRRQQADAQREALTRDGRRIEIGANVASPREAAEAFANGADGVGLLRTEFLFLERRAAPDEEEQRNAYQEVLDAMGQRKVIIRTIDVGGDKHLDYLPLPVEENPALGLRGIHLGQARPELLDQQLRALLRVEPLERCRILLPMVSEVDELRAIRRRLGELATQLGIERLPELGVMIEVPSAALLADQLAEHADFLSIGTNDLSQYALAMDRCHAGLADRIDALHPALLRLIAQTCAGAARHGRWVGVCGALASDPLATPVLVGLGVEELSVGPNLVGEIKTRVRQLDAAECRRHAQALLDLGSARAVRDACLQHWPLA

SEQ ID NO: 42247 - protein, 303 aa, Prochlorococcus marinus str. MIT 9303
MERWKSGRADNRSFDFSYQFFFSPMNLFADLLASTSEARATATGPRIQQRRGVEIKSSRELAIMRKASHIVATVLREIMEMAEPGQTTTDLDVYAERRIREMGATPSFKGYHGFPASICASINNEVVHGIPGPKRVIKSGDLLKVDTGAYYEGYHGDSCITICVGEVPESGRKLSRVAQESLMAGLSKIRAGNTLLDIAGAVEDHVKAHGYSVVEDYTGHGVGRNLHEEPSVFNFRTDDLPNITLRSGMTLAVEPILNAGSKACRTLKDRWTVVTQDGSLSAQWEHTIVVTSDGCDILTDRGD

SEQ ID NO: 42248 - protein, 232 aa, Neisseria cinerea
DQGAGVTYLEPSASQIGHKESIKDTARVLGRMYDGIEYRGFGQDVVEELAKYAGVPVFNGLTNEFHPTQMLADALTMREHSGKPLNQTAFAYVGDARYNMANSLLVLGAKLGMDVRIGAPKTLWPSENIVARARAVAEETGGKILLTENTKEAVKGADFIHTDVWVSMGEPKEVWQERIDLLKDYRVTPDLMAASGNPQVKFMHCLPAFHNRETKVGEWIYETFGLNGVEVT

SEQ ID NO: 42249 - protein, 169 aa, Magnetospirillum magnetotacticum MS-1
MARCTRRRRTLCRPEDYAFGPVAIENAWSDDWPSFWAERRLLCHAGHLSTALIRRIERLAADLPNRLPRRPRPSLLHGDLWGGNVLVAGDRVAGLIDPACSHGHAEVDLAMLGLFGRPGPAFREAYGPPEPGEAERRPIYALWPALVHLRLFGAGYRGMVEGILEAAGV

SEQ ID NO: 42250 - protein, 153 aa, Vitis vinifera
MKNQQHHEAMDGLLNLFTKANHDLTLVQHRLEKEFQQIYPHNANPMILVSRIKKLQEDLCSLKEQCQELLAAKQDLIDKARTTLVGNRSLLQRMQAPMGIPLASDSDDPAYANFNQIIDEWTNQVRSRTGDVTHESESEDINKMLFSAIVQSN

SEQ ID NO: 42251 - protein, 230 aa, Brassica napus
MKPSEPPKLVAASSNISNDPSASEKGEATSQQQSSNGYALTVDEVIEQHIGALGFAQIVHALLVSIAWTFDAQSTLISIFSDAKPAARLLTTGAIVEGSMLCGLSTGEWEWVGGKSDTIVSEWNLICQHKFLVALPSTLFFIGSLFGSGVYGYLADSWFGRKKTLFISCLLTFVTALAISFSPNVWVYAFLRFANGFFRSGIGSCCIVLATEVVGKKWRGQVGQYGFFFF

SEQ ID NO: 42252 - protein, 351 aa, Oceanobacillus iheyensis HTE831
MKAAVWYGKHDIRVENKEEPIIKPGKVKIKVAWTGICGSDLHAYHGAEGVVQVGEPHPVTGEMAPLTLGHEFSGVIHEIGEGVSGLSVGDRVAIEPAIKCGKCENCVRGNYNLCEHNGFVGLQSDGAFAEYAIVDPHMVHKLPDNISFEEATAIEPTAVSFHALKLSNMKAGDTVAVFGVGPIGLTAILCAKAAGASRIYAIDVSNERLEMAQKLGATTVINAIEENAAEKIYAETGSGVTIAFDCAGAEATVNSAIDSLAKGGQLVIVSIIPEPIKVNLLQANLKEINILATIGYRDVYKDVIAMVESGQLDLKPIITKKIGLDDIIEEGFHALTNDKSQAKILVSPTGV

SEQ ID NO: 42253 - protein, 629 aa, Aspergillus nidulans FGSC A4
MDAKPQRIRVRGDENAPFPLAATKTLHQRTKSTTALSATFQNGASKNGARRAAFGDVSNTASLVHGNRDDASLAGRKPSKLLEKGSMATEKKSTALSQPAQRPVSMSGFKGLLNNVTNPKPLEVTKQAAGQQQSTNSRKTLNKRATVFKDHLEPLTESKELTSKESKPEPKEGNMKGHSKPSLGEHLQKDGKVEGTVSLNEKLESEMCKLEVLLSQPGAEEDEKEFPDLEDDDCKVQPMPKQTGEAHIAADSNGPAISSRVTCKSTTVSRASQDDLPHQSEPEEYWDDDDEENEEDDYITARSYRSRSENTTGGATTLLFPRYNQQVKRELALAKQIVEATRTVEDIEDDYCDTSMVAEYSEEIFEYIREQEIKMLPNAHYMDNQAEIQWSMRSVLMDWLVQVHHRFSLLPETLFLCVNYIDRFLSCKIVSLGKLQLVGATAIFIAAKYEEINCPSVQEIVYMVDGGYTVDEILKAERFMLSMLQFELGFPGPMSFLRRISKADDYDLETRTLAKYFLEVTIMDERFVGSPASFLAAGAHCLARLMLKKGTWSPAHVHYAGYTYSQLYPLVSLIVECCEMPRKHHSAIYDKYNDRRFKLASAYVEAEMRKNFRLPEPAIDRKTTLGQGH

SEQ ID NO: 42254 - protein, 198 aa, Zea mays
  misc_feature (140)..(140): Xaa can be any naturally occurring amino acid
MASSSDPWMKEYNEASRLADDISSMIADRGSLPQSGPEIMRHTSAIRRKIGILGTRLDSLESLLGKIPPKSITDKEMHKRQDMLSSLKSKAKQMATSFNMSNFTNREDLLGQSKKPDDMSRVAGLDNQGIVGLQRQIMKXDDLEDHVDVTNSRLQRVQKRLAILNKRTKGGCSCTCLLLSVVAIVILAVIVWLLVKYL

SEQ ID NO: 42255 - protein, 279 aa, Oryza sativa Indica Group
MGQQSLIYAFVARGTVVLAEYTEFTGNFTTIAAQCLQKLPASNNKFTYNCDGHTFNYLVEDGFSSNRIGILGIQGLAYCVVAVESVGRQIPIAFLDRVKEDFTKRYGGGKAATAAANSLNREFGSKLKEHMQYCVDHPEEISKLAKVKAQVSEVKGVMMENIEKVLDRGEKIELLVDKTENLRSQNSGIFIQWIAMEKLLIHVSVDRMRVWSMVMKYRIMVPKVIWLTVDMAQDFRQQGTKVRRKMWLQNMKIKLIVLGIIIALILIIILSVCHGFKCK

SEQ ID NO: 42256 - protein, 510 aa, Corynebacterium glutamicum ATCC 13032
MVVGDRREWRRQATGIIAGLVLAALVYLLFPSNSVETVMQSSGVDPETEYTNNAMRLTAAVTILMAVWWMTEAIPLAATALIPLVAFPAFQVVDFGKAAAPYANPTIFLFLGGFLMALGLQKWNLHRRMALAVVLAVGTKPKQLVLGFMVATGFLSMWVSNTATAVVMLPIGMSVLALTAETVGGMKNQKKFATGLMLSIAYSASIGSLGTLIGTPPNALLAAYMSESHDIHIGFGQWMILGVPIAVVFTIIAWLVLTTVFKPEMKEIPGGRELIKREIAEMGPWTAPQVTVGVIFAAAALAWVFIPLTLDWTGSQLSINDSLIGIAAGLLMFIVPANFKTGERILDWRTAGELPWDVLLLFGGGLSLSAMFTSTGLSLWIGELAKGLDALPIFILIFAIAVLVLFLTEFTSNTATAATFLPIMGGVAVGIGLTAGGEQNVLLLTIPVALSATCAFMLPVATPPNAIAFGSGYIKIGEMVKGGLWLNIIAVILITIFTYFVAIPLFGIML

SEQ ID NO: 42257 - protein, 165 aa, Triticum aestivum
  misc_feature (47)..(47): Xaa can be any naturally occurring amino acid
  misc_feature (49)..(49): Xaa can be any naturally occurring amino acid
  misc_feature (61)..(61): Xaa can be any naturally occurring amino acid
  misc_feature (67)..(67): Xaa can be any naturally occurring amino acid
  misc_feature (71)..(71): Xaa can be any naturally occurring amino acid
  misc_feature (109)..(109): Xaa can be any naturally occurring amino acid
  misc_feature (117)..(117): Xaa can be any naturally occurring amino acid
  misc_feature (119)..(119): Xaa can be any naturally occurring amino acid
  misc_feature (126)..(126): Xaa can be any naturally occurring amino acid
  misc_feature (134)..(134): Xaa can be any naturally occurring amino acid
  misc_feature (143)..(143): Xaa can be any naturally occurring amino acid
  misc_feature (146)..(146): Xaa can be any naturally occurring amino acid
  misc_feature (153)..(153): Xaa can be any naturally occurring amino acid
MAPTVMASSVTSVAPFQGLKSTAGLPVSRRSNGSSLGSVSNGGRIRXMXVWPIEGIKKFEXLSYLPXLSTXALLKQVDYLIRSKWVPCLEFSKVGFIFREHNASPGYYXGRYWAMWXLXMFGCTDXTQVIIDVXEVKTDNLTXYVXINGFDNXMRQVKGVKFIAF

SEQ ID NO: 42258 - protein, 277 aa, Rickettsia conorii str. Malish 7
MKISHINYNSFINTLSGRLQKNKQLEKIIAQFHQDYNLIPIIGVEIEFYLSHNIDIAKFEILSRKYLARFKIAKIKKEKGNNQFEIDLPPSVNLIQYIKNILEVKTILKKMAQQLNGYIDFSPKPFLDDYGNSMHFHINFNSEFNDYYIILAAQGLCHYMLDTLLAFMPTTLDYARINKKFMAPTHISYGGNNRSVAVRTPNAFPKRLEHRLSSPETDPYIAIFTILKSILLALKSPSSLQTIEKIYGNAFDPQYNLTPLPTSSQASFMLFKPDFFK

SEQ ID NO: 42259 - protein, 353 aa, Bacillus pumilus SAFR-032
MKWNGLIEEFQEFLPVNESTPKLTLNEGNTPLIHLSKLSEKLGIELHVKTEGVNPTGSFKDRGMVMAVAKAKEEGNDTVMCASTGNTSAAAAAYAARADMKCIVIIPDGKIAFGKLAQAVMYGAEIIAIDGNFDDALKIVRSICEKSPIALVNSVNPYRIEGQKTAAFEICEQLGSAPDVLAIPVGNAGNITAYWKGFKEYHEKKGTGLPVMRGFEAEGAAAIVRNEVIEQPETVATAIRIGNPASWKQAVAAADESNGKIDEVTDEEILHAYQLIAREEGVFAEPGSCASIAGVLKQVKSGEIKRGSKVVAVLTGNGLKDPNTAIDISQIKPVTLDADEDQILEHLEKAARV

SEQ ID NO: 42260 - protein, 267 aa, Salmonella typhimurium LT2
MHPMLTIAVRAARKAGNVIAKNYETPDAVEASQKGSNDFVTNVDKAAEAVIIDTIRKSYPQHTIITEESGEHVGTDQDVQWVIDPLDGTTNFIKRLPHFAVSIAVRIKGRTEVAVVYDPMRNELFTATRGQGAQLNGYRLRGSTARDLDGTILATGFPFKAKQYATTYINIIGKLFTECADFRRTGSAALDLAYVAAGRVDGFFEIGLRPWDFAAGELLVREAGGIVSDFTGGHNYMMTGNIVAGNPRVVKAMLANMRDELSDALKR

SEQ ID NO: 42261 - protein, 360 aa, Pseudomonas syringae pv. tomato str. DC3000
MSKQILILPGDGIGPEIMTEAVKVLELANQKYQLGFELTHDVIGGAAIDKHGVPLADETLDRARAADAVLLGAVGGPKWDTIERDIRPERGLLKIRSQLGLFGNLRPAILYPQLADASSLKPEIVAGLDILIVRELTGGIYFGAPRGTRVLDNGERQAYDTLPYSESEIRRIAKVGFDMAMVRGKKLCSVDKANVLASSQLWREIVEQVAKDYPEVELSHLYVDNAAMQLVRAPKQFDVIVTDNLFGDILSDQASMLTGSIGMLPSASLDTANKGMYEPCHGSAPDIAGQGIANPLATILSVSMMLRYSFNLTAAADAIEQAVSLVLDQGIRTGDIWSEGKVKVGTKEMGDAVVAALRNL

SEQ ID NO: 42262 - protein, 461 aa, Agrobacterium tumefaciens str. C58
MNIMQPLRADATAVADPQADISARLERLPITREVFWARNIVGAATFFDGYTVIAIAYAMPVLVREWGLTPSQTGMILSMGYLGQLIGAILFGWLAERIGRLKVLLFTILLFVSMDVACLFAAGAGMMMAFRFVQGIGTGGEVPVASAYINELIGSKGRGRFFLLYEVMFLLGLVGAGLIGYFMVPLYGWKAMFIVGLVPAMLMIPLRWFLKESPRWLAATGRYDEANVIVKRMEESARAAGKALPEPRIIATPAKRVSDWRELFQGIYLKRTLSIWAMWFCAYMVANGTITWLPTLYRQTFNLPLETSILYGFMTSAAGVVAAVICALLIDKVGRKRWYAGALLLAPVPLAILAWLGATSPMQVLIFAGLAYAIVQTVTFSLYLYSAEIYPTRMRAIGTGAGSAWLRLGSSAGPMLVGFVMSSMGIQYVFATFAFILIIGAVVTMLFAVETKGKVLEELSP

SEQ ID NO: 42263 - protein, 346 aa, Solanum tuberosum
MSSSKPLKLLHLLEGASSPLIGSIATAGKKLASIGLDNTEANRQAYRQLLLTTPGLGDYISGSILFEETLFQSTTDGKKFVDVLRDQNIVPGIKVDKGLVPLPGSNNESWCQGLDGLASRSAEYYKQGARFAKWRTVVSIPCGPSALAVKEAAWGLARYAAISQDNGLVPIVEPEILLDGDNPIERTLEVAERVWAEVFYYLAENNVVFEGILLKPSMVTPGAEHKEKATPDTIAKYTLTMLKRRVPPAVPGIMFLSGGQSEVEATLNLHAMNQSPNPWHVSFSYARALQNTVLKTWQGRPENVDAAQRALLIRAKANSLAQLGKYSAEGESEEAKKGMFVKGYTY

SEQ ID NO: 42264 - protein, 585 aa, Aspergillus nidulans FGSC A4
MDKDFLKGNPERSTSSDSTPVYGESTSRRASLGQRVLGSFQRDPNAHVTAFASFSDGKTYDIENATEKAANSPLHRSLRGRHLQMIAIGGSIGTGLFVSSGRVLATGGPASLLIAYALIGCMLYCAVHALGEMAVIFPVAGSFAHYSTRFIDPAWGFAMGWNYALQWLAILPLEIVAAAITVDYWESNISSAVWVALFWAAIVSINLFGVKGYGEAEFVFSSIKVIAVIAFIILGVILNCAGGQNGSYIGVKYWHDPGAFHHGFKGLCDVFVNAGFAFAGTELVGLAAAETANPRKSLPTAIKQVFWRITLFYIVSLTLVGLLIPYTEPRLINGTSTVDTKASPFVIAIKNAGIEVLDSVMNVVIMIAVLSVGNSAVYGSSRTLAALAEQQQAPRFLGYIDRKGRPLWAICIASAMGLLGFLAATDKQEVAFEWMIAISGLSSIFTWGSICLAHIRFRRAWKVQGNSLHDLAFRSQPGIIGSWIGFAFNCLVLVAQFWVGFAPIDYETMSASMLARNFFSKYLAAPVVLLFYIPYKLRFKTKILRAKDMDLRTGRRELNIQWLMKEERAQQAAWPAWKKIYKFFC

SEQ ID NO: 42265 - protein, 323 aa, Triticum aestivum
  misc_feature (181)..(181): Xaa can be any naturally occurring amino acid
  misc_feature (259)..(259): Xaa can be any naturally occurring amino acid
  misc_feature (270)..(270): Xaa can be any naturally occurring amino acid
MSSPTHVRKALHLAAMKAKLQGVVGHRLLLVTGLADFLLLFSARTLFSSSSRGSGAASRMSGGAGDWSCSKLPAPVAEALVHYATSNVTPHQTAGEIGVSLRVLQRRSPCNFLVFGLGHDSPMWAALNHGGRTVFLEEDASWIASVRSAHPGLESYHVTYDTRLTEADELIGLRDHPGCTXQPDLAAAAEASCGLALRGLPAVFQDVQWGLIMVDAPTGWTPEAPGRMDAIYTAGMAARATEPVHGATDVSLHDVDPHXVEDRFPKGFLXCEPYLRKRAGRIPEFAFPPHGKRPGTPFCPKNGLLSGTHFIQDLHYSRTAHLP

SEQ ID NO: 42266 - protein, 261 aa, Geobacter sulfurreducens PCA
MTATYLAVAAEAARRAGQLQRERLWTDHDIRYKGEIDLVTEVDQASEELIVAAIRAAFPDHDILAEEQTRETGTSRYRWIVDPLDGTTNYAHGFPWFCVSIALEIDGEVTVGVVYQPVMDELFSAVKGEGAFVNGSPIHVSSRAPLKQCLLATGFPYDRTRDNENNFDNFYRFQFAARAVRRAGAAALDLACVAAGRLDGYWELKLKPWDVAAGFLLVTEAGGRVTTHDGASFSVSEHRILASNGLIHDEMQRVLAAGDTL

SEQ ID NO: 42267 - protein, 183 aa, Solanum tuberosum
MGCFNSKVKKQFRGHEDPIALASQTAFSVSEVEALFELFKSISSSVIDDGLISKEEFQLALFKNRKKENLFANRIFYLFDVKQKGVIDFGDFVKGLHVFHPNAPQEEKVNFSFKLYDLDGTGFIERQEVKQMLIALLCESEMKLADETIESILDKTFVEADSNQDGKIDKSEWQIFVSQNLHY

SEQ ID NO: 42268 - protein, 319 aa, Synechococcus elongatus PCC 7942
MSLSPRSDRTEIRRSWGLDSIVSALSQASTDPLPHHLLSDQFYPLPSRESLGLILHGLRSVLFPRHFGDPELSVETTHYFIGNTLDKTLNLLNEQIRRELWLQHVTQGTPEATPAVLSQHASELTQAFAQALPEIKRLLDSDVNAAYLGDPAAQSISEILFCYPGITAITFHRLAHRLYQLGLPLLARITAEVSHSETGIDIHPGAAIGGSFFIDHGTGVVIGETCVIGDRVRIYQAVTLGAKSFPRDETGALIKGQARHPVIEDDVVIYAGATLLGRITVGRGSTIGGNVWLTRSVPAGSFISQAQIRSDNFESGGGI

SEQ ID NO: 42269 - protein, 525 aa, Pseudomonas aeruginosa PAO1
MSQDIHAHRILILDFGSQYTQLIARRVREIGVYCEIHPFDMSNEAIIAFAPRGIILAGGPESVHEADSPRAPQAVFDLKVPLFGICYGMQTMAEQMGGKVQGSDLREFGYARVDVVGKARLLDGIEDHVDDDGVLGLDVWMSHGDKVTEMPAGFHILASTPSCPIAAMADDARAYYGVQFHPEVTHTKQGLRILSRFVLDICGCAALWTPSNIVDDAIATVRAQVGSSKVLLGLSGGVDSSVVAALLHKAIGDQLTCVFVDNGLLRLHEGDQVMAMFAENMGVKVIRANAEDKFLGRLAGVADPEEKRKIIGRTFIEVFDEEATKLQDVKFLAQGTIYPDVIESAGAKTGKAHVIKSHHNVGGLPEDMQFELVEPLRELFKDEVRKIGLELGLPYDMVYRHPFPGPGLGVRILGEVKKEYADLLRQADHIFIEELRAFDWYHKTSQAFVVFQPVKSVGVVGDGRRYAWVVALRAVETIDFMTARWAHLPYELLEKVSNRIINEIAGISRVTYDVSSKPPATIEWE

SEQ ID NO: 42270 - protein, 329 aa, Synechococcus elongatus PCC 7942
MSTSGTFFADNSQTIGKTPLVRLNRIVKGAPATVLAKIEGRNPAYSVKCRIGAAMIWDAEQRGLLGPGKELIEPTSGNTGIALAFVAAARGIPLTLTMPETMSLERRKLLAAYGAKLVLTEGVKGMTGAVRRAEDIAASDPDRYVLLQQFRNPANPAIHEQTTGPEIWEDTGGAIDILVSGVGTGGTITGVSRYIKQTQGKPILSVAVEPEASPVISQQRSGLPLKPGPHKIQGIGAGFIPENLDLSLVDQVERVSNEEAIAYARRLAQEEGLISGISCGAAVAAAVRLAQQSEHAGKTIVVVLPDSGERYLSTALFDGIFNEQGLAVV

SEQ ID NO: 42271 - protein, 374 aa, Vitis vinifera
MAINQHHQQTPPQPPNSSSFLLDALYCEEERWEEEEEDECLQEEAYPSSTLLPLLLLEQDLFWEDEELLSLFSKEEQQASLGAGNGEMDGALAVARRQAVEWMMKVNAHYGFSAVTAILAINYLDRFLSSLHFQRDKPWMIQLAAVTCLSLAAKVEETQVPLLLDLQVEDSKYVFEAKTIQRMELLVLSTLQWKMNPVTPLSFIDHIIRRLGLKTHLHWEFLRLCERFLLSVVADSRFVRYLPSVLATATMLHVINHVEPCNPIEYQNQLLGILKIDKDKVTECHQLIVEVSNTHFYAQNNPHKRKYTKIPGSPNGVMDAYFSCDSSNDSWAVESSVSSSPVDPLFKKSRTQEQQMRLPSLNRVFVDVIGSSPR

SEQ ID NO: 42272 - protein, 545 aa, Xanthobacter autotrophicus Py2
MTTLSARLSDADEPHGSHRAASPLIGFIGPGGDTQPLSAHAFGSKAAQLWRMNALGLNVPPAFVLSTALCGKPHAEKRIGSLLEQGIAYLERVTARGFGDRRRPLLVSVRSGAEKSMPGMLETVLDVGMTAATTRGLMRLYGNPRLAADCRRRFIEGYCEVVAGLPRGPFEDVLRAVQTAEDVTSDRELDPEALDRLAGLYLDLARDRFGTAIPEEPMDQLRAAAEAVFRSWDAPKAQDYRRLNHLENLSGTAVTVQAMVFGNASARSGSGVAFSRDPATGANGLYADMLFEAQGEDVVSGRRQPVGLGRLEALLPDVATQLAAGVGALEAAYRDVQDVEFTFEDGRLFFLQTRSAKRTPRAALKIAVDLVAQGMRTEAEGLALLDGIDLSQVGTTRFTGTAEVAARGVAASPGTVSGRVAFDGEAAKRLSEGGDPVILVRPDVATDDIAGMALAAGVLTRVGGRTAHAAVVARQLGRVCVVGCAPLAIDLDSRSARLGRAQVQEGDWLSLDGDEGTVFVGRRESVVDRPEAELDTVAGWMARTR

SEQ ID NO: 42273 - protein, 280 aa, Glycine max
MAERETSESEDPSSSGSEYEDAQTVEGNGVKKKKGLSEYEKQRMPRIAENRARLEALGLPQIASSLKGSSQPHKATKGKEKKNKVNDDDDEEYEPEEDEGEQVSGSSSEENEDRKDEDFAIENASGSRKRKVKNKSLKKKARVSGKKHVSNSEYIDYDDDEALRQAIALSLQDSAEGSYLPDKNVVNTSKTEKKGSGHVQEDKGRKKNKKSFASRLQLTEDELIVHFFQLDEAGKGTISVRDIQRAATAHDFLWTDKELVDMIRYFDSDGDGKLRIRRSF

SEQ ID NO: 42274 - protein, 443 aa, Salmonella typhimurium LT2
MSSVKKIGLFACTGVVAGNMMGSGIALLPANLASIGGIAIWGWVISIIGAMSLAYVYARLATKNPQQGGPIAYAGEISPAFGFQTGVLYYHANWIGNLAIGITAVSYLSTFFPALNNPIPAGIACIAIVWLFTFINMLGGAWVSRLTTIGLFLVLIPVVLTAVAGWHWFDIATYHANWNTSTTTDSHAIVKSILLCLWAFVGVESAAVSTGMVKNPKRTVPLATMLGTALAGIIYIAATQVIAGMFPASVMASSGAPFAISTSTILGGWAAPLVSAFTAFACLTSLGSWMMLVGQAGVRAANDGNFPKIYGEMDKNGIPKKGLLLAAVKMTALMILITIMNSSGGKASDLFGELTGIAVLLTMLPYFYSCVDLIRFEGFNIRNSVSLICSVLGCAFCFIALMGASSFELSGTFIVSLIILMFYGRKMHQRQNNDSDNNTAEAL

SEQ ID NO: 42275 - protein, 363 aa, Buchnera aphidicola (Schizaphis graminum)
MKKKFRIAVLPGDGIGPEVMREAYKILNILERKFFLKLELREFDIGGIAIDREGIALPEKTLRGCENSDAILFGSVGGKKWDYLPIESRPERASLLPLRKHFNLFSNLRPAKLRVDLKNLSPLRSDIVRDGFDILCIRELTGGIYFGKPKGRFKNKNGEYAFDTEIYYDFEIERIANLAFELASSRRCKVCSIDKANVLESSVLWREIVKKVSKNYPDVHLSHLYIDNACMQIIKNPTQFDILLCSNIFGDIISDECAMITGSIGMLPSASLNNQKFGLYEPAGGSAPDIEGKNIANPIAQILSLSMLIRYSMNLNEIADKIDLSVHYALKEGYRTLDISDGKNYIKTNEMGDIIAEFLDNGK

SEQ ID NO: 42276 - protein, 164 aa, Triticum aestivum
RPSFGAEYDLDSFPLLLLPVSDSDDPDKGDGGNHWSLLVVDGASNPFCPRFVHHDSSGNANRSHAERYANGIRQLLPGRFGAAILYEGPTPQQNNGCDCGLYVAAVAKATLDWYTRPRQQRGTDWFTDVQAQVSVQSVSRLRADLRDLIKQLIQENKAGESGDE

SEQ ID NO: 42277 - protein, 417 aa, Bacillus pumilus SAFR-032
MTARERMDNVKELQIPSRTIMTPGPVEVDPRVLRVMSTPILGQFDPAFTQIMNETMTLLRSLFQTENEWAFPIDGTSRSGLEAVLASVIEPGDSMLVPVFGRFGHLLIEIGQRYGADVHTMECEWGTVFDPSDIIQEMKQVRPKIVAMVHGETSTGRLQPLEQIGEACRELDALFIVDAVATIGGTQVKVDEWKIDAAIGGTQKCLSVPSGMSPITYNDRVAAVVESRKKVEKGIATQDELQEQMDISPIKSNYFDLSQLQDYWSPRRLNHHTEATTMLYALREGVRVVLEEGLSERFKRHAYHEKALMKGLEAMGLELFGDPHCKMPVVTCIEIPSGIDGEAVRSDLLKHFGIEIASSFGPLAGRIWRIGTMGYSCRKENVLFVLAGLEAILIKHGASIHCGAGLQAALSIYEQGE

SEQ ID NO: 42278 - protein, 309 aa, Solanum tuberosum
MDVSISAISSRPIEKVIVHPLVLLSIVDHYNRVARDTRKRVVGVLLGTSFKGTVDVTNSYAVPFEEEDRDPSIWFLDHNYHESMFSMFRRINAKEHVVGWYSTGPKLRENDLNIHGLFNDYVPTPVLVIIDVQPKELGIPTKAYYAVEEVKENATQKSQNVFVHVPSEIAAHEVEEIGVEHLLRDVKDTTISTLATEVTGKLAALKGLDARLQEIRSYLDVVIDGKLPLNHEILYHLQDVFNLLPNLNVAELVKSFSVKTNDMMLVIYLSSLIRSVIALHNLINNKMLNKEHEKAEDSKPRAVPTTAGS

SEQ ID NO: 42279 - protein, 363 aa, Buchnera aphidicola
MHKQYHIAVLPGDGIGPEVMQEAYKILQVLREHFSLFIKTKEFDIGGIAIDNHGIALPKKTLIGCENSDAILLGSIGGKKWDTLPINERPERASLLPLRKHFNFFCNLRPSNLYKELNFLSPLRNDIVKHGFDILCVRELTGGIYFGKPRGRVTKKKLMYAFDTEIYYKFEIVRIAHLAFKLARSRKHKLCSIDKANVLESSILWREVVEEVSKEYPDVILSHLYIDNVCMQIIKDPNQFDVLLCSNLFGDIISDECAMITGSIGMLPSASLNEKNFGLYEPAGGSAPDIQGKNIANPIAQILSLSMLIRYSMNLNKIANKIDNAVINVLKKGYKTMDISKDQNYLKTNEMGDVIADFLKRDK

SEQ ID NO: 42280 - protein, 537 aa, Pseudomonas putida KT2440
MSGKFKKQLSLLDLTFIGLGAIFGSGWLFAASHVSAIAGPAGILSWFLGGFAVLLLGIVYCELGAALPRAGGVVRYPVYSHGPLLGYLMGFITLIAFSSLIAIEVVASRQYAAAWFPGLTKAGSSDPTVLGWLVQFALLGLFFFLNYRSVKTFAKANNLVSVFKFIVPLLVIGVLFTFFKPENFEVQGFAPFGLSGVEMAVSAGGIIFAYLGLTPIISVASEVKNPQRTIPIALILSVLLSTAIYALLQLAFLGSVPTEMLANGWASVTKELALPYRDIALALGVGWLAYLVVADAVISPSGCGNIYMNATPRVIYGWAQTGTFFKYFTRIDAESGIPRPALWLTFGLSVFWTLPFPSWEALINVVSAALVLSYAVAPVSVAALRRNAPHMPRPFRVKGMTVLGPLSFIIAALIVYWSGWNTVSWLLALQIVMFVLYLLCSRFVPTQHLSLGQQVRSSAWLIGFYALTILLSWLGSFGGLGVIGHPFDTVVVAACALGIYYWGAATGVPAHLVRLEGDDESEACAETSNGRPVAVAS

SEQ ID NO: 42281 - protein, 302 aa, Bradyrhizobium sp. ORS278
MGRVVVAGSINMDVVATAERHPRVGETVAGQSVMYFPGGKGANQAVAAAKLGAPTSLIGRLGRDAFGEQLRAFLAAQGIDLAAVKDSAGVSTGTAIITLAKADNTIVVIPGANAEVRADDVGQTALIAGDVAVSQFEIPQATIVTFFQRAKAAGATTILNPAPASAFAQGLFAVVDVLVLNETELGFLSGIDLGNAPTSQQVVDAVWKLDARTDQTVCVTLGARGAVAVAAGEARRVDGRAVKAVDTTGAGDCFVGALAARLSQGAAMTDAIAYANVAASISVQRMGAGPSMPTAEEVRALL

SEQ ID NO: 42282 - protein, 485 aa, Oryza sativa Japonica Group
MLPFVRSLRRLGPAAADGRLLLPLAPLSSKAAAPPPEYEMPSVTWGVIQGRKERLVSRVLALDFLRSAGVSDPAGELEAVELPSSLEVLQERLDFLLRLGLSTDDLSAYPLLLACSLRKNAIPVLSYLEKLGVTRARLAAFVRAYPACLHASVAVDLTPVVKSLRGLDVDRQDLPRVLERYPDILGLKPDGTISTSVAYLVGIVGVAPRDIGPMVTHFPFFLGMRVGTTIKPLCEYITSLGLPMRILARILEKRPYILGYDLEETVKPNVEALLSFGIRKEMLPLVIAQYPPILGLPLKTKLAAQQYFFNLKLQIDPDAFACAIEKLPQLVSLHQNIILKLVEFLRGRGISNEDVARMVVRCPQILLLRMELMKNSLYFFKSEMKRPISELLDYPEYFTYSLESRIKPRYMRVSTKGIRCSLDWFLNCSDQRFEERMRGDFIEGDAPGPSFTMGGKLQMPGSQLVSDDDNAESDDEVLYRRTVML

SEQ ID NO: 42283 - protein, 432 aa, Bradyrhizobium sp. ORS278
MVAGLQEQIREWKMTVYAGPVFEMAANQFNVIADHLGIPGDERDRLLLPKRAITVSCPIHKDDGTIAVFEGYRVQHLLTMGPTKGGTRFAPTVDIGEVAALAIWMSWKCALVGLPYGGAKGGVNVDLSKLSRRELESLSRRYMQEMIPFVGPHTDVMAPDMGTNEQVMAWFMDTYSMYQGQTVTEIVTGKPVFSGGTLGRREATGRGVAHVSRRVMDLLGIDPAKSTVVVQGFGNVGSYAALGFHQMGMKVIAVSDHTGALHDARGLDIPALMAHASKHGSIAGFSTELAFDPKDILTLACDILVPAAIERVIDAKVAANLKCRVIAEAANGPTTPDADLVLDQRRKEIFLIPDILCNSGGVIVSYFEWVQDLQQLFWEEEEVMRREYQILDRAFEKMVARAKADDIAHRTAAMAIGVEKVRNAKNTRGLFP

SEQ ID NO: 42284 - protein, 269 aa, Vitis vinifera
MKARLVVFPIKGRKWCFARSVDPAAADSQAAHTPSTLRDLWNRISSNPKPLNANAELLLDFASNKMNKAWVGLEKAPEGTLKNKLYGLGLRLLARVKPSEIFLKSISKEVSKVHVAYPSSLNARLVRRRLRHVALSMLETICSQMLIIHILLSNMLASRFLLVLPLPNIPFFWISFRTYSHWQALQGSERLLRLVSDCIETQKSDASNKSKDEIHKSLGCPWVLEPSEELEKLLCIGDANDGVNKNAVSDICKTFHLNKNDILKFWDSM

SEQ ID NO: 42285 - protein, 518 aa, Clostridium perfringens ATCC 13124
MSILIVKNMNHGFGDRAIFEDVSFRLLKGEHVGLIGANGEGKSTFMNIITGKLMPDEGDVQWSNKVRVGYMDQHAQLEKGKTIREVLREAFQYLFDMEVEMNGLYERMGEMSEDEMTKALERTATIQDMLDHNGFYMIDAKVEEVAAGLGLRDVGLDKDVTDLSGGQRTKVLLAKLLLETPDILLLDEPTNYLDEEHIAWLKNYLIGYENAFILISHDIPFLNSVVNVIYHVENRALTRYTGDYDNFMRVYEANKKQLEAAYERQQAEIAKLEDFVARNKARVATTGMARARQKKLDKMDRIELAAEKPKPEFNFKQGRTSGKLIFEARDLVIGYDEPLSKPLNIRMERGQKIALVGANGLGKSTLLKSLMGLIKPISGEVETGDYQSIGYFEQEIKEANYNSCIEEVWQEFPGYTQYEVRSALAKCGLTTKHIESSVAVLSGGEQAKVRLCKLINKETNILILDEPTNHLDVEAKDELKRALKEYKGSILLVCHEPEFYRDLVTDVWSCEDWTLKIV

SEQ ID NO: 42286 - protein, 200 aa, Vitis vinifera
MYTEFTGNFTSIAAQCLQKLPASNNKFTYNCDGHTFNYLVENGFTYCVVAVESAGRQIPIAFLERVKDDFNKRYGGGKAATAVANGLNKEFGPKLKEHMQYCVDHPEEISKLAKVKAQVSEVKGVMMENIEKVLDRGEKIELLVDKTENLRSQAQDFRQQGTKMRRKMWMQNMKIKLIVLGIIIALILIIVLSICHGFKC

SEQ ID NO: 42287 - protein, 475 aa, Solanum tuberosum
MVNYFEIFFYISIFLLGILSYYFCFSKKYNSSSKKNAYKLPPGSMGWPYIGETLQLYSQDPNAFFINRQRRFGEIFKTKILGCPCVMLASPEAARFVLVNQANLFKPTYPKSKENLIGQSALFFHQGDYHNHLRKLVQASLNPESIRNQIPYIEELSISALNSWVGGHVVNTYHEMKKFSFEVGILAIFGHLDGHVKEELKKNYSIVDKGYNSFPINLPGSLYRKSLQARKRLGKILSEIIRERKEKKVLEKGLLSCFLNAKEEKGLLVLNEDQIADNIIGVLFAAQDTTASVLTWILKYLHDNPKLLECVKAEQKVILQSNEQENHGLTWTQTRKMPITNKVVLETLRMASIISFAFREAVADVEYKGYLIPKGWKVMPLFRNIHHNPEFFPDPQKFDPSRFENAPKPNTFMPFGSGVHACPGNELAKLEILIMTHHLVTKFRWEVVGSGSGIQYGPFPVPLGGLAARFWKEST

SEQ ID NO: 42288 - protein, 146 aa, Lactobacillus delbrueckii subsp. lactis
  misc_feature (38)..(38): Xaa can be any naturally occurring amino acid
  misc_feature (122)..(122): Xaa can be any naturally occurring amino acid
  misc_feature (134)..(134): Xaa can be any naturally occurring amino acid
MTKVVIENVHAREIFDSRGNPTVEVEVTLSNGVVGRAXVPSGASTGENEAVELRDGGSRLGGKGVMKAVNNVNTAINNELQGADPFNQPAIDKAMIELDGTPNKGKLGANAILGTSMATAVXAAKATHQPLYRXLGGTDLSMPQTF

SEQ ID NO: 42289 - protein, 175 aa, Methylobacillus flagellatus KT
MSLCNVPAGKDIPNDFNVIIEISMRGEPIKFEVDKDSGALFVDRFMGTSMHYPCNYGYIPQTLSEDGDPVDVLVITPIPLQPGVVIRCRAIGVLTMEDDGGVDAKVLAVPLDKICPQYKDIKSYQDIPEFQLAPIAHFFEHYKDLEKGKWVKVGEWKGPEDAKAEIVAGVERFGK

SEQ ID NO: 42290 - protein, 143 aa, Mycobacterium smegmatis str. MC2 155
MRIADVLKNKGTAVVTISPQATVTELLAGLAEMNIGAMVVMGKSGLEGIVSERDVVRQLHKRGSSLLAQPVSSIMTSVVATCTPRDTVDRLNVLMTQNRVRHIPVLDDGRLAGIVSIGDVVKTRMEELETEQQQLQAYITQGR

SEQ ID NO: 42291 - protein, 480 aa, Methylobacillus flagellatus KT
MALRKTKIVATLGPASSEEAVIERLVDAGMDVVRLNFSHGSAQDHIARAELVRDISRRSGRPVGVLCDLQGPKIRIGKFENDRILLKAGDRFILDAACKLGNQERVGLDYKTLPSEVEPGAVLLLDDGRIVLNVEAVNGGEVHCTVAAGGVLSNNKGINRKGGGLSAPALTLKDQEDIRTAVALEADYIAVSFPRSGADIELARHLVREAGGHAAIVAKIERAEAIDALEEIIDAADVIMVARGDLGVEVGDAAVPGLQKRMIRTARMRNKLVITATQMLESMISSPIPTRAEVSDVANAVLDGTDAVMLSGETAVGHYPVESIQAMHRVCLEAEKEYDSHHLQAPINDEFEFIDEAIAMASVYAAEHLNVKAIAALTKSGSSVTWLSRSNTNVPIYALTTERDTRRKLTLYRGVYPYHVEFASQELSKILYDAEETLLRLGAVQRGDLMMLTFGEPIGKAGGTNTLQIVRVGEHRRERH

SEQ ID NO: 42292 - protein, 414 aa, Triticum aestivum
  misc_feature (148)..(148): Xaa can be any naturally occurring amino acid
  misc_feature (380)..(380): Xaa can be any naturally occurring amino acid
AYLGDTTEQVCTKKQAGTGPEFPGFRRPTRPLPTCWAVLLRLSLAPLAVWIFLAYKYWKTRIIIDAVEKFLRIQQMIGPTRYAYTDIVVITSHFRDKLGQGGYGTVYKGVLLPGGVHVAVKMLEGNSNCNGEDFISEVSTIGRIHHVXNVVRLVGFCSEEMRTALVYEYMPHGSLDQYIFSAEKSFSWDKLNEIALGIARGINYLHQGCDMQILHFDIKPHNILLDSNFVPKVADFGLAKLYPRGDSFVPLSAMRGTVGYIAPEMISRSFGVISSKSDVYSFGMLLLEMAGGRRNADPNMGSSSQAYYPSWVYDQLTQEEAGEISPVNADMHELEKKLCIVGLWCIQMRSRDRPTMSEVIEILDAGTDSLQMPSRPFFCXDEGHIHVDDSYHFTSGLTVVSEEESTAVSEEDNL

SEQ ID NO: 42293 - protein, 393 aa, Methylobacillus flagellatus KT
MTVINMTDLDLAGKRVFIRADLNVPVSDGKVTSDARITASIPTIRHALDAKARVMVTSHLGRPEEGVYSEENSLQPVADVLADKLGQPVRLIKDWVDGGFEVAEGEVVLLENCRFNKGEKKNAEETARKYAALCDVFVMDAFGTAHRAEASTYGVAQYAPVAAAGLLLVGELDALGKALCEPARPMVAIVGGSKVSTKLTVLESLAEKVDQLVVGGGIANTFLKAAGKPIGRSLSEDDLVPTAQCLMEKMAKRGAAVPIAVDVVCGKQFDANEPAVLKSAEDVADDDMIFDIGPESAKQLAEIILNAGTVVWNGPVGVFEFDQFGEGTKTIADAIAKTKAFTLAGGGDTIAAIQKYDIYDKVSYISTAGGAFLEFLEGKKLPAVEILEQRAKG

SEQ ID NO: 42294 - protein, 232 aa, Oryza sativa Japonica Group
MLGFRSQTPWSGPGAEPICGDAAAAVVAARKGMETPLTAVAEAFEELARRMEADGGELRLGPFGDTCALVSVLFSCLGMAFRFAEIEYVAKVNDLIGAAKSYGTLNDILDKDVENDCVKKQGSHSRNLRRVRLGLGLIKVLFEQFLSTQECSLYDAATTAYGQVCAPFHSWAVRKAVGAGMYTLPSREQLIVRLNETDCSVQKEMRRYIDASSPIIDYIDNLFLSRSISLDW

SEQ ID NO: 42295 - protein, 173 aa, Oryza sativa
HSSHMYHEAKSSFAHHGVKFSNLEVDLPAMMAQKDKAVAGLTKGIEGLFKKNKVTYVKGFGKLASPSEVSVDLSDGGSTVVKGKNIIIATGSDVKSLPGVTIDEKKIVSSTGALCLSEIPKKLVVIGAGYIGLEMGSVWNRLGSEVTVVEFAPDIVPSMDGEVRKQFQRMLEN

SEQ ID NO: 42296 - protein, 320 aa, Zea mays
MAAAWEVLAVLLVAAQVASAAQVTAPAFLWAPKNYGFSSDDAKEVVHYQTISPKSLAKSVLEEGGWSNFMCSREDTQNNVDVAIVFIGSKLQSSDISKDKQVDPALADTLKLSFTRSEFSMAFPYVSTTVDERLEDSLLSSFAENCNNGFGRNRITYTDTCTGQDLKKYHNMDAINDLVVSGVASRRANHPSGQTDVIVFCSGGFENPGTAKSEGELLSQLVDSLDLSGAKYTVLYASQPSGLLESPSGLPLGRHLAEKKTNGTKAVQGEKEKCDGECLVKSSLLEGTFVGIVLLIILISGLMCMMGIDTPSRFEAPQES

SEQ ID NO: 42297 - protein, 261 aa, Methylococcus capsulatus str. Bath
MLKKIREEFGCIFARDPAAQSFFEILTVYPGVHAVLIHRFSHWLWNHGLHWPARVLSYLARWATGIEIHPGATLGRRLFIDHGMGVVIGETAVIGDDCTLYHGVTLGGTSWQKGKRHPTLGNGVVVGAGAKVLGPITVGDGARIGSNSVVLRTVPAGATVVGIPGHIINPDRRAQEAQRLAIASRLGFDAYGMTPDMPDPVAHAINHMLDHIQALDQQVAKLKEVLRERGIDLEEAPLPDLDDCQLDPGEPQVTVNSSRTG

SEQ ID NO: 42298 - protein, 290 aa, Vibrio parahaemolyticus RIMD 2210633
MIKKCLFPAAGYGTRFLPATKSMPKEMMPVVNKPLIEYGVEEAIQAGMNGMCIVTGRGKHSIMDHFDKNYELEHQISGTNKEELLVDIREIIESANFTYIRQREMKGLGHAILTGRELVGDEPFAVVLADDLCVNEEEGVLAQMVALFKQFRCSIVAVQEVPADETHKYGVISGEMIKDDIYRVDDMVEKPEPGTAPSNLAIIGRYILTPDIFELIENTEPGKGGEIQITDALLKQAKAGCVLAYKFKGKRFDCGSVEGYIEATNYCFENLYLKDEKKSELGKHATKKEV

SEQ ID NO: 42299 - protein, 159 aa, Oceanobacillus iheyensis HTE831
MNITIVSVGKLKEKYLKQGIDEYKKRLNAYAKVSIIEVADEKAPETMSEAEMKEVKRKEGERILSSIAPDAFVITLEIEGKMLGSEQLAKKLDELATYGKSKVVFVIGGSLGISQDVQRRSDLALSFSKMTFPHQLMRLVLIEQVYRSFRINRGEPYHK

SEQ ID NO: 42300 - protein, 600 aa, Bradyrhizobium sp. ORS278
MSFINPDPFTTRPEIDGTFGVVTSTHWLATAVGMAMLERGGNAFDAGVAAAFTLQVVEPHLNGPGGDVPIILHDVKRGRTEVICGQGPAPAGATIAHYKREGLDMVPGTGLLAACVPGTFESWMLLLRDYGTMRLRDVLEPAISYARDGYPLVERVSATIQTVEQLFKTHWPTSAALYLTNGAVPKPGALFTNPKLAETYARILSEAESAGGNRDAQIERARKAWSQGFVAEAIDRFCRTQEVMDVSGSRHKGVLTADDMARWQPTIEAPLTYQYGRYTVCKAGVWSQGPVLLQQLALLKGFALDGLDPTGPDFIHWQIEAAKLAFADREAFYGDPNFADIPIETLLSDAYNDQRRKLITEKASLELRPGRLDGYGAEVKLREAAGHREAVGAMGSGEPTVGRFGEVRGDTVHFDIIDSQGNMISATPSGGWLQSSPVIPELGFCLGTRAQMFWLEENHPAALVPGKRPRTTLSPTMALRDGEPYVAWGSPGGDQQDQWNTQFFLRHVHAGMNLQESIDAPAWHSEHFPISFWPRTARPGVLVVEGRVPKTTVEELRRRGHVVEIGPDWSEGRLTAASRVGRRRRAAANPRGMQGYAAGR

SEQ ID NO: 42301 - protein, 336 aa, Methylococcus capsulatus str. Bath
MTIKIAINGYGRIGRNILRAIYETGRKDVEIVAINDLGDAQINAHLTRHDTVHGPFRGTVEVGEGEIIVNGDRIRVFSEKDPSKLPWGALGVDVVHECTGVFRTKAKCQPHLDAGAKKVIISAPADKNECDATIVYGVNEHTLKAAHTVISNASCTTNCLAPLVKPLLGKIGIVSGLMTTVHSYTNDQVLTDVYHKDLYRARAAALNMIPTKTGAAQAVGLVLPELDGKLSGFAIRVPTANVSVVDLTFIAARETDKDEINAILKAASESELKGILGYNDQPLVSSDFNHTTTSSNFDSTQTKVVGNLVKVLSWYDNEWGFSNRMLDTTVALMNAR

SEQ ID NO: 42302 - protein, 373 aa, Vibrio parahaemolyticus RIMD 2210633
MPIQSFIPPHRILMGPGPSDVYPQVLQALSRPTVGHLDPLFIAMMDELKQLLKYAFQTENEFTIAVSAPGSAGMETCFVNLIEKGDKVIVCRNGVFGERMRENVIRAGGEVVLVDDEWGAPVSVDKVEQALQQHPDTKILAFVHAETSTGAVSDAQTLGKLAKQYNVLSIVDAVTSLGGVPLKVDEWQLDAVYSGSQKCLSCVPGLSPVTLSPAAIEKIQSRTTPVQSWFLDQSLVLGYWSGEGKRSYHHTAPVNSLYALHEALLVLQNEGLENAWARHQLMHEKLKDGLQKLGFEFVVEEAYRLPQLNAIYVPEGIDEAKVRAHLLETYNLEIGAGLGVLAGKAWRIGLMGYGARAENVALCLKALEESLTE

SEQ ID NO: 42303 - protein, 488 aa, Methylococcus capsulatus str. Bath
MTRGIRRTKIIATLGPASESPEMLERILKAGADVVRLNFSHGTAEEHRIRAERVREISRRMQRYVAILADLQGPKIRIARFKGDRQVVLEEGQPFDLDTAFPPDQGDETQVGCAYEALPTDVEAGDTLLLNDGLIELKVKSVEGTRVRCVVTVGGVLSNHKGINKLGGGLSAPALTEKDKADLKTAVEIGADYLAISFPRSKEDMLEARELLHRAGSHMGLVAKVERAEAIKDGVIEGIIDASDAIMVARGDLGVEIGDARLPHEQKRLIRLARSRNKVVITATQMMESMIENPLPTRAEVSDVANAVIDGTDAVMLSAETATGKFPDRTVAAMVRVCKEAEKYPRTRQSSHRMDEKFHRIDEAIAMSAMYIANHLPVRAIGALTESGSTPLWMSRISSGIPIFALTPHEAVCRRVTLFRGVYPIFFNERAISDHHVLNRAIAEEFLKRNLVKMDDLVIMTKGDLTGRTGGTNALKISRISDVIAAAP

SEQ ID NO: 42304 - protein, 368 aa, Cryptococcus neoformans var. neoformans JEC21
MSIPAMAQQPYMSHSPPPLQHPKPTHIAYPPPEPPHTPAQSTDSSPYSQAQRISQDGYLRYSSPPAGEPLASSSGFSSYAPPPTGQQPVQSRQTYGQAGTPGVQGVHGYGVPGYAWPGMNDATAQMGMQFGKSAVAAGQEYVEKNFTRYLPLQLIKISFSVTNSYVLNKLRLILFPWRHKPWSRQSRRSTDNGAVEGWQAPRDDINAPDLYIPTMALVTYTLLCALASGLQSRFHPEVLGLSLSKALAVVITEFCAIKLGCYLLDVRGSGASGVELVGYGGYKFVGIIATIVVSLLGLGKMITLGVFIYTFAANAFFLLRSLKYVLLPDASVSSSVTTLSHSQRSRRVQFLFFVAVAQVLWMGWLSRV

SEQ ID NO: 42305 - protein, 411 aa, Vitis vinifera
  misc_feature (40)..(40): Xaa can be any naturally occurring amino acid
  misc_feature (74)..(74): Xaa can be any naturally occurring amino acid
  misc_feature (136)..(136): Xaa can be any naturally occurring amino acid
  misc_feature (187)..(187): Xaa can be any naturally occurring amino acid
  misc_feature (405)..(405): Xaa can be any naturally occurring amino acid
MNALAATNRNFRHASRILGLDSKLEKSLLISFREIKVECXIPKDDGSLATYVGFRVQHDNARGPMKGGIRYHPXVDPDEVNALAQLMTWKTAVVDIPYGGAKGGIGCTPRDLSMSELERLTRVFTQKIHDLIGTHXDIPAPDMGTNAQTMAWIFDEYSKFHGHSPAVVTGKPIDLGGSLGREAATGXGVVFATEALLAQHGKSIKGLTFVIQGFGNVGSWVARLIHERGGKIIAVSDITGAVKNQNGLDIVDLLRHKEETGCLTNFSGGDHMDPNELLTHECDVLIPCALGGVLNKENAADVKAKFIIEAANHPTDPEADEILSKKGVVILPDIYANAGGVTVSYFEWVQNIQGFMWEEEKVNYELQKYMTKAFHNIKAMCQSHNCSLRMGAFTLGVKRVARATXLRGWEA

SEQ ID NO: 42306 - protein, 341 aa, Aspergillus nidulans FGSC A4
MAPSFTETTSTYLEAPSKAPPNLVAPEPEHCPGPESDQAGQGDACAGCPNQSICASAPKGPDPDIPLITARLASVRHKILVLSGKGGVGKSTFSSLLAHGFASNPDSTVGIMDTDICGPSIPKMMGVESETIHISNAGWSPVWVSDNLGVMSVQFMLPNRDDAVIWRGPKKNGLIKQFLKDVDWGEMDYLIVDTPPGTSDEHLSVNSLLKESGVDGAVVVTTPQEVSLLDVRKEIDFCRKAGIRILGLVENMSGFVCPSCDHESKIFRATTGGGKRLAKKMGIPFLGAVPLDPRVGMACDYGESFVENFPDSPASLAIKQVVRAVGRFVGEDPDSVLPDAE

SEQ ID NO: 42307 - protein, 437 aa, Vitis vinifera
MDSTLNYKNSAHSQSHQPSITPIWRQMYHYCGAYTLLAEPLRNSTSRNKSRVTKLFLLRSKYSNEHKELKLGISHMKGPLDRTKVMVRHLPPMISEAAFLEQIDTVFKERYTLVKFCPGKNSQQRQSYSRAYLDFKRPEDVIEFAEFFDGHVFVNEKGTQFKTIVEYAPSQRIPKHWPKKDGREGTIFKDPEYLESLELLAKPFENLPSAEIQLERREAERAGAVKDTPIVMPLMDFVRQKRAAKGRRLSTTMYVLRDAAKNTSAKDKSTFILVPKRADQLLSDKSVNLAAGGGAEALKEESGVSGAVDAGKKKVLLLKGKEREISHHLQQQNVTSPVKNILGANAPKQNQRREGSGRIIRSILLNKDARQSQSSMFQSEQQSQASNLEKEKRPPRPPQLYTQPGNAKEGKGRRGCLIQGEEVKLMKIEWGLDGTPT

SEQ ID NO: 42308 - protein, 533 aa, Candida glabrata CBS 138
MSTENTSLVVELLEYVKLGLSYFQALPLAQRVSIMVALPFVYTITWQLLYSLRKDRPPLVFYWIPWVGSAIPYGTKPYEFFEDCQKKYGDIFSFMLLGRIMTVYLGPKGHEFIFNAKLADVSAEAAYSHLTTPVFGKGVIYDCPNHRLMEQKKFVKGALTKEAFVRYVPLIAEEIYKYFRNSKNFKINENNSGIVDVMVSQPEMTIFTASRSLLGKEMRDKLDTDFAYLYSDLDKGFTPINFVFPNLPLEHYRKRDHAQQAISGTYMSLIKERREKNDIQNRDLIDELMKNSTYKDGTKMTDQEIANLLIGVLMGGQHTSAATSAWCLLHLAERPDVQEELYQEQMRVLNNDTKELTYDDLQNMPLLNQMIKETLRLHHPLHSLFRKVMRDVAIPNTSYVVPRDYHVLVSPGYTHLQEEFFPKPNEFNIHRWDGDAASSSAAGGDEVDYGFGAISKGVSSPYLPFGGGRHRCIGELFAYCQLGVLMSIFIRTMKWRYPTEGETVPPSDFTSMVTLPTAPAKIYWEKRHPEQKY

SEQ ID NO: 42309 - protein, 494 aa, Staphylococcus aureus subsp. aureus MRSA252
MEKKNKQIDRGDLKQNLSEKFVWAIAYGSCIGWGAFILPGDWIKQSGPIAASIGIVIGALLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLLTSHQSLNGQLWLTGAVTQTAFGYIGLGVLAIAIMMGIFTGLNGFLMSSSRLLFSMGRSGIMPTMFSKLHSKYKTPYVAIIFLVSVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 42310 - protein, 406 aa, Bacillus pumilus SAFR-032
MNIKDVREQFPILHQQVNGHDLVYLDSAATSQKPRVVIDAMNEYYRSYNSNVHRGVHTLGTRATDAYEGAREKVRAFIRASSVQEIIFTRGTTTALNTVAISYARANLKEGDEIVITHMEHHANIIPWQQAAKATGATLKYIPLQEDGTLSLEDVKQTITHQTKIVAVTHVSNVLGTINPIKDIAKIAHDHGAILVVDGAQSTPHMQIDVQDLDCDFFAFSGHKMCGPTGIGVLYGKKDLLNNMEPAEFGGEMIDFVDLYDSTWKELPWKFEAGTPIIAGAVGLGKAIDFLNDIGMEEVSRYEHQLATYALERFKELDGATVYGPQHRAGLVTFNLDDVHPHDASTVLDTEGVAIRAGHHCAQPLMKWLGVSATARASFYLYNTEEEIDKLIAALRKTKEYFTNVF

SEQ ID NO: 42311 - protein, 382 aa, Pseudomonas aeruginosa PAO1
MIQSKLPNVGTTIFTRMSQLAAECGAINLSQGFPDFDGPPELREAVGRHIAAGHNQYAPMTGLPALREQVAKKIEQFYGRRVSADSEVTITPGATEAIFSAIQALVHPGDEVVVLDPSYDSYEPSVQLAGGRCVHVPLALPDFSIDWQRMAEAIGPRTRLVIINTPHNPSGALISREELDRLAALIRDRDIYLISDEVYEHLVFDGVAHTSVLSHDELYPRSFVVSSFGKTYHVTGWKTGYVVAPPALSAELRKVHQYVNFCGVTPLQWALADYMAGHPEHLRQLPGFYQAKRDLFCDLLLDSRFRFTRAPGTYFQCVDYSAIRPDLDDVAMAEWLTREHGVAAIPVSVFYEKAPDAMRLVRFCYAKREETLRQAAEKLCAI

SEQ ID NO: 42312 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYITRAFGNVKQMCRSHSCDLRMGAFTLGVNRVARATVLRGWEA

SEQ ID NO: 42313 - protein, 450 aa, Vibrio parahaemolyticus RIMD 2210633
MSAFNVAKFGGTSVANFEAMSRCATIIENNPNTRLVVSSACSGVTNILVELANGVQDQEHRAELLKNLAEIHDSILAQLEDATEASSEVYGILDTVTSLAEAASIQANTKLTDHLVACGELMSTHILAQLMRERGINAVRFDIREVLRTDDNFGRAEPNVEAIAQLAQEKLIPLCLDSVVITQGFIGSDEEGNTTTLGRGGSDYSAALIAEGVKASGLEIWTDVPGIYTTDPRIAPKASPIPEISFSEASEMANFGAKILHPSTLVPALRHDIPVFVGSSKEPEKGGTWIRHQVESSPLFRALALRCNQTMVTLRSANMFHAYGFLAKVFEILAKHKISVDLITTSEISVSLTLDQTDTSGGAPQLPQAAREELEELCKVEVEHDLCLVALIGNKMSERKGYAKQVFGTLEDLNLRMICYGASPHNLCFLVNESVAKQAIQKLHTELFEQ

SEQ ID NO: 42314 - protein, 444 aa, Vibrio parahaemolyticus RIMD 2210633
MSVYHTLCFLSAAAMLIAFVNSKIGKMQTTIAITAGSMVLSLLILIAGQNNWFHLTEIATETVTRINFEDFLLKGILGFLLFAGGLGIKLPNLKDQKWEITVLALGATLFSTFFIGFVLYGLCMLIGIQFDLVYCLLFGALISPTDPIAVLAIVKKLDAPKRISTQIEGESLFNDGFGLVIFVTLFTIAFGSEAPTVGSVTLLFIQEAIGGIVYGFLLGLVFHYLISATDDHSMELLLTIGVPTAGYAFAEYIHVSGPLAMVVSGIMIGNWTRFIGFSKESEDHLDHFWELVDEFLNGVLFLLIGMSMLLFKFHEEDWIMMAIAVPLVLASRYLSVFISYIGFKRYRKYNPWSVKILTWGGLRGGLALAMALSIPSGIWVVQDKLIDVKEIILVMTYSVVVFSILIQGSTITPMIEKAKAEEKKMEDEKLAQSSLAEQREQTEA

SEQ ID NO: 42315 - protein, 250 aa, Zea mays
FQNTRPKNPNSLITLHSLIKLEGWESLVTVISSDMRCWDAPEKADVLVSELLGSFGDNELSPECLDGAQRFLKPDGISIPSSYTSFIQPITASKLHNDIKAHKDIAHFETAYVVKLHRIATLAPPQQVFTFTHPNFSPNASNQRYTKLQFEMLPDMGSCLVHGFAGYFDSVLYKDVHLGIEPNTATPNMFSWFPIFFPLRKPIYVPEGSPIEVHFWRCCAPTKVWYEWAVTTPTPSPIHNSNGRSYWVGL

SEQ ID NO: 42316 - protein, 328 aa, Staphylococcus aureus subsp. aureus MRSA252
MADLLNVLKDKLSGKNVKIVLPEGEDERVLTAATQLQATDYVTPIVLGDETKVQSLAQKLNLDISNIELINPATSELKAELVQSFVERRKGKTTEEQAQELLNNVNYFGTMLVYAGKADGLVSGAAHSTGDTVRPALQIIKTKPGVSRTSGIFFMIKGDEQYIFGDCAINPELDSQGLAEIAVESAKSALSFGMDPKVAMLSFSTKGSAKSDDVTKVQEAVKLAQQKAEEEKLEAIIDGEFQFDAAIVPGVAEKKAPGAKLQGDANVFVFPSLEAGNIGYKIAQRLGGYDAVGPVLQGLNSPVNDLSRGCSIEDVYNLSFITAAQALQ

SEQ ID NO: 42317 - protein, 578 aa, Vibrio parahaemolyticus RIMD 2210633
MTFSTENNKQIVLGEELGPLSDNERLKKQSNLLRGTIAEDLQDRITGGFTADNFQLIRFHGMYQQDDRDIRNERTKQKLEPLHNVMLRARMPGGIITPTQWLAIDKFATEHSLYGSIRLTTRQTFQFHGVLKPNIKLMHQTLNNIGIDSIATAGDVNRNVLCTTNPVESELHQEAYEWAKKISEHLLPKTRAYAEIWLDGEKVESTEEDEPILGKTYLPRKFKTTVVIPPQNDVDVHANDLNFVAIADNGKLVGFNVLVGGGLAMTHGDTSTYPRRADDFGFIPLEKTLDVAAAVVTTQRDWGNRSNRKNAKTKYTLDRVGTDVFKAEVEKRAGIQFEASRPYEFTERGDRIGWVEGIDGKFHLALFIENGRLLDYPGKPLKTGVAEIAKIHKGDFRMTANQNLIVAGVPKSEKAKIEKIAREHGLMDDNVSEQRKNSMACVAFPTCPLAMAEAERFLPQFVTDVEGILEKHGLPENDNIILRVTGCPNGCGRAMLAEIGLVGKAPGRYNLHLGGNRAGTRVPKMYKENITDKQILEEIDLLVARWSKEREEGEAFGDFTIRAGIIQEVFVSKRDFYA

SEQ ID NO: 42318 - protein, 267 aa, Triticum aestivum
TSPINKVLARRLIFGKGYDKLVETDERRKKINKFKESAWKFVYYLSAELFSLSVTYNESWFTNTRYFWVGPGEQLWPDQKMKLKLKAVYMYAAGFYVYSIFDLLFWETRRKDFGVMMSHHVATVVLIVVSYICRLSRPGSVILPLHDASDIFLEIGKMAKYSSCEWLAVVAFLLLGASWILLRLIGFPFGILRSTSYEIAMIVDNENRKIYRTSDYYLFNTLLFSLLVFHIYWGVLIYRMLVKQIQSRGHVGEDVRSDSEGENNHED

SEQ ID NO: 42319 - protein, 210 aa, Methylococcus capsulatus str. Bath
MKIPPVSIRYLRSILELKDAPPDQGCEVAFAGRSNAGKSSAINTLANVGGLARVSKTPGRTRMINFFSIDDGRRLVDLPGYGYAKVPGEIHRRWEAALEQYLRYRQSLRGVFLLMDVRHPFTEMDEVMIEWCAHRSIALHVALTKSDKLSRGAAMNARLMAKTRLAGYGSPDFSVQLFSSLKKSGTEEAWEVLGRWLDLPREDQEKTPGA

SEQ ID NO: 42320 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCGQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 42321 - protein, 246 aa, Oceanobacillus iheyensis HTE831
MIAKTEADFNGLKEIGKICGAIRDELVRSTKPGMTTKELDEMAGTMFAQAGAQSAPKGEYDFPGYTCISINEEVAHGIPGERVIEEGDIVNIDVSGSKNGYFADTGISFVAGQGEEMSQKVCDVVKEAFEAGLEKAKPGVSTSALGKAAHNVAKKHGLTVIKNLTGHGIGRSIHEAPDHIFSYFSRWDNEILKDGMVIAFEPFISTFEEQVYQGEDGWTFLTVESAVAQYEHTIIVTEDGPIITTL

SEQ ID NO: 42322 - protein, 431 aa, Nicotiana tabacum
MEMEYVTEYPRPYMDRRPKKRPRLDWDPSHTPKAQSGIYYGQEVGNSSSYVHSRLLPDHDSLYVKGLAQKGSPPRRDDDKDGHYMFELGENLTTRYKILKKIGEGTFGQVLECWDREQKGFVAIKIIRSIKKYREAAMVEVDVLQLLGRYDRGGTRCVQLRNWFDYRNHICLVFEKLGPSLFDFLRKNSYRAFPVDLVREIGRQLLECVAFMHDMRLIHTDLKPENILFVSADYIKVPDYKGTPWSHRDRSFSKRLPKSSAIKVIDFGSTAYERPDHNYIVSTRHYRAPEVILGLGWSYPCDLWSVGCILIELCSGEALFQTHENLEHLAMMERVLGPLPSQMLKRVDRHAEKYVRRGRLDWPEGATSRESIKSVMKLPRLQNLVMQHVDHSAGDLIDLLQGLLRFDPSIRMTAHDALRHPFFTKDQYRRL

SEQ ID NO: 42323 - protein, 313 aa, Oryza sativa Indica Group
MGLLGALLGPEAEVAGVRLLPRASGARHRRSVLIGVQKMILASLLRLRCPFFSHSTVISITGIGISHLSWSLVQGLVGIGLSRLFHAAGLEDLAPESLSNSMGLFLQKVNITRDYLEDINEIPKSRMFWPREIWSKYVDKLEDLKYENNSVKAVKCLNEMVTNGLIHTEDCLRYMSALKDITILRFCAIPQSSLLSSTETATYFICKQREFIFQHSCTLIGLTARIINETNSMADVYTAFYEFSSLLAEKIDDNDPNASLTRKRVNAIKETCKSSGLLKIRGYDLDRPKRNPAMIMMLLLLLVAIFLGALYRR

SEQ ID NO: 42324 - protein, 398 aa, Zea mays
MDVPRSNKQPTSTPQNTPANAAPISSRAQQPNVGTIKEEELDRAAAGLFAANPALVSMMQAKLGSLVGRSSGYIESLPGSVRRRVAGLKGVQKEHSKLEAEFQEEVLQLEKKYFAKFTPLYEQRAKIVNGSTEPTEEQVKVGEQQDEDDEDDEEAGEKELNKDEGKGVKGIPEFWLSAMKNQISLAEMITDRDEAALKHLTDVRMEYLDRPGFRLIFEFEENEFFTNKTITKTYFYQEENGYGGDFIYDHAEGDKIDWKTGKDLTVRVESKKQRNKNTKQTRVVKKTVPTESFFNFFDPPSPPQDEDDDASSDIEERLELDYQLGEDIKEKLIPRAIDWFTGEALQYENIEDFDEGEFEDEDDEDEDGLSDDRDEDEESDDENDGTKPKQEAAECKQS

SEQ ID NO: 42325 - protein, 640 aa, Oryza sativa Japonica Group
MESGLVASHRLRVPFAAAHHRHHPAAPPHLLRQRRGSVAATPLRLGLHLPTPTPLRLPAALPLRPSLPPLRAAAASAAAPEPVGSASPKFLGVETKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANVALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQELEKEKMLKAKTVETTAQVVGSGNGSLQETLASENSANGSAIKVSQEPESTTSEKTSEDSGCQPAKNCRSR

SEQ ID NO: 42326 - protein, 342 aa, Zea mays
  misc_feature (219)..(219): Xaa can be any naturally occurring amino acid
  misc_feature (261)..(261): Xaa can be any naturally occurring amino acid
YFVQFLGCEISLCIDDKSEDAWLSGFVVLYVMHMITYFTNIIGVVISALVSIVSILGLICLCCLVYFQLWIRRRGYQWLSYFNEPWLTRITLMLVAFWLGIGEVLRLTFVNGEGRLISDRAWQENVCKFYIISNMGFAEPGLFLLLSFLLSVALQKQELGTLNWKWNQKTIRAVFILYSPSLIWEACVVFVGGLVALDDGQRSKVSKYWYSASAIHNGXITCTYPLLSSTFFGAFYIVLIVYVMFIGHQMLSLVINKGLRXRIYMLIFATRILLSRAILLGLSVLPWPGEVEHEALVFVSFLVLMLATMVGIVILVYFPVADTFSIGDQEHIEMQTSCDMIL

SEQ ID NO: 42327 - protein, 1442 aa, Saccharomyces cerevisiae
  misc_feature (464)..(464): Xaa can be any naturally occurring amino acid
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLXIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 42328 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSSDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 42329 - protein, 484 aa, Burkholderia sp. 383
MTAEYTLQHRIAGEACDAAQGEWFEKFEPCTGHLLARVAAGTGADVDRAVRAARAEFDGGHWSRLPGAARAKLLHRLADLLEHDAERFVELLVREQGRPALEVRMMDLPMSIDTLRYFAGWADKLEGRQIPTGGFMGRPTVNYTVREAVGVAGLIVPWNAPLMIACWKLAPALAAGCTVVIKPSEDAPLAVGALADLAAQAGFPPGVVNLVHGIGASVGAALVNHPGVDKISFTGSTEVGRTIAREAGARFKRLTLELGGKAPQIIFDDANLEQAIAGVAMGLFVNQGQTCAAGTRVLVQRRHYDDVVGALAHAARSVKVGTPFDPDTQMGALISARHADRVKTHIAAALRDGATMVAGDEPVPSQGFFVRPTVFANVDPAMRIARDEVFGPVGTIIPFDTEDEAVALANDTVYALSASLWTRDLTTAHRTAARLRVGAVAVNAWSPLDARLPWGGFKESGVGRDLSQSGLDAYLEEKVVTIAM

SEQ ID NO: 42330 - protein, 327 aa, Staphylococcus aureus subsp. aureus MRSA252
MIKSGKARAHTNIALIKYWGKKDEGLIIPMNNSISVTLEKFYTETKVTFNDQLTQDQFWLNGEKVSGKELEKISKYMDIVRNRAGIDWYAEIESDNFVPTAAGLASSASAYAALAAACNQALDLQLSDKDLSRLARIGSGSASRSIYGGFAEWEKGYNDETSYAVPLESNHFEDDLAMIFVVINQHSKKVPSRYGMSLTRNTSRFYQYWLDHIDEDLAEAKAAIQDKDFKRLGEVIEENGLRMHATNLGSTPPFTYLVQESYDVMALVHECREAGYPCYFTMDAGPNVKILVEKKNKQQIIDKLLTQFDNNQIIDSDIIATGIEIIE

SEQ ID NO: 42331 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTALIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 42332 - protein, 440 aa, Staphylococcus aureus subsp. aureus MRSA252
MKTYDLIVIGFGKAGKTLAKYAASTGQHVAVIEQSSKMYGGTCINVGCIPSKTLVHDGLEGKSFEASYNRKNDVVNALNNKNYHLLADDSNIDVLDFKAQFKSNTEVNLLDQHGDIVDSITAPHIIINTGATSIIPNIKGLDQAKHVFDSTGLLNISYQPKHLVIVGGGYIALEFASMFANLGSKVTVLERGESFMPREDQDVVAHAITDLENKGIALHTNVETTELSSDNYHTTVHTNVGNFEADAVLLAIGRKPNTDLALENTDIELGDRGEIKVNAHLQTTVPHIYAAGDVKGGLQFTYISLDDYRIIKSSLYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTILRDNIYTHPTMAESFNDLFNF

SEQ ID NO: 42333 - protein, 2216 aa, Candida albicans SC5314
MAQLSVPITPPMESTGDVLMTLETQDGIALQGYSFGAAKPAAGEVVFQTGMVGYPESITDPSYEGQILVITYPLVGNYGVPDRELLDEDYEPALPKYFESNKIHIAGLVVAHYTEEYSHWLAKSSLGKWLQEQGIPAIYGVDTRSLTKRLREKGSTLGRLAIQNSDYKSEEIISQSKSNPQNWKKFFNVPEFDDPNVKNLVAKVSTDKPILYTPKKTNENIKLGKNGKPIRILAVDVGMKYNQIRCFVRRGVELLVVPWDYDFTTEEYDGLFISNGPGDPAVMDKTVERLQKILKEGKTPVFGICLGHQLLARATGASTLKLKFGNRGHNIPCTSTISGRCYITSQNHGYAVDTATLSNGWKELFVNANDGSNEGIYHESKPFFSVQFHPESTPGPRDTEFLFDVFIKSVVDFNQSGGVYKQVEFPGGKLAENRAAHPKVDVKKVLVLGSGGLSIGQAGEFDYSGSQAIKALKEEGIYTVLINPNIATIQTSKGLADKVYFLPVTPEFVRKVIKHERPDGIYCTFGGQTALSVGIALKDEFEGLGVKVLGTQIDTVITTEDRELFASAMAEINEKCARSEACNTVKEAVDAANAIGYPLIVRAAYALGGLGSGFADNEEELVALCNKAFATSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEIKNSVTKSTSACFEPSLDYCVVKIPRWDLKKFTRVSALLSSSMKSVGEVMAIGRTFEEAIQKAIRSTDYHNLGFNKTAALMSIDIDQELQTPSDQRLFAIANALSDGYSVDKVWKLTNIDKWFLNKLDGLIKFGNKIASYGAKEDVPMSILRQAKQLGFEDRQIAKFLGSNEVAIRRLRKDAGIIPFVKQIDTVAAEFPAFTNYLYVTYNADSSDVKFDDNGVIVLGSGVYRIGSSVEFDWCAVRAIRTLRENNVKTVMINYNPETVSTDYDEADRLYFEPINLERVLDIYDLEQSSGVIISMGGQTSNNIALPLYRQNVKILGTSPEMIDSAENRYKFSRMLDRIGVDQPAWKELTSIDEAEDFAEKVGYPVLVRPSYVLSGAAMNTVYSKDDLASYLGQAVDVSPDYPVVITKYIENAKEIEMDAVAKDGKMIMHVVSEHVENAGVHSGDATLIVPPQDLDPETVRRIVEATAKIGKALDITGPYNIQFIAKDNDIKVIECNVRASRSFPFVSKVVGVDLIEMATKAMLDLPIVPYPGERLPEDYCAVKVPQFSFSRLAGADPVLGVEMASTGEVATFGKNKYEAYLKSLISTGFKLPKKNILFSIGSFKEKQELLPSIAKLHELGYKIFATAGTADFIKEHGIPVHYLEVLSKDEDQKSEYNLSQHLANNLIDLYVNLPSANRFRRPASYMSKGYESRRMAVDYAVPLVTNVKNAKLLVEAIARNISLEVSNRDAQTSHGTAILPGLINITSFATSFDDFEQTTKESLAAGFTFNAFLPHTQAGASVTDYRSLIDAIDAVGASAYTDYSVSIAASETNSQSVSDAADNAGSLFLPFNDFANSKVSALTAQFSSWPNNKPIITDAKTTDLASVLLLASLYNRSIHITGVSSKEDLDLIKMAKEKTLQVTCDVAVHSLFLSKDELDYPFLPNKQDQEYLWENLKDVDCFSIGVLPYLIAKASGTEIVPGMGIKEAVPLLLTAVKAGKLTIGDIVSKFHDNPAKIFNLPKQDAQVVLDLDRFATVEPVYPEFSKLRLRGAVERVSFHNETVVLDGSVLSQIALGKNEVVPRSRFGSTAGIPESPRLGNKRVSFSSDMRRPSLAPETPEPQPAIFEKLGSELVSQPIAGSLGEIAALSDYIRHNNTFLRNNIISVKDITRSDLHSLFTVAQEMRLAVERQGVLDLLQGRVLATMFYEPSTRTSTSFDAAMQRLGGRVVAVDHGSSSVKKGETLQDTIRTLSCYSDAIVLRHPSEESADIAAKYSPVPIINAGNGTKEHPTQALLDLFTIREELGTVNGITVTFMGDLKYGRPVHSLCHLLRHYQVRVQLVAPKELQIPAEIRQQLIDNNMLIAESEELTKEILARSDVLYCTRVQEERFADKEQYQRLKDTYIVDNKILSNAKQHMCVMHPLPRTNEIREEVDFDQRAAYFRQMRHGLFIRMALLAMVIGVDF

SEQ ID NO: 42334 - protein, 402 aa, Bordetella bronchiseptica RB50
MPATLTDELVAVLRARTPGAQGAFIHFNHAGASLPSAGTLQAIEAHLRLEATQGPMEAGVRAREQAERARLLAARLLNAQPAEVALTTGNSAGWGAAFAALGPWRAGDRILVARHEWGGNLAAMRLAAQRAGATIETIASDESGAVDPGALQAMLDERVRLIALTWLPANGGLVNPAAAVGRIARRHGIAYFVDAAQAVGQLPIDVAEVGCDVLSGAGRKALRGPRGTGLLYVRQAFLERLAPAWVDTWSAPLGEDGCPIVRGDAARFESAENSVALRCGLAHALHEALELDIASIRARIDAVATRLRTRLAALDGITLLDQGRVRSGLIAFDVAGWQADAVQRELARQGIALGCNGVAYTPLDMQARGLRQIARASVSYLTTEAEIDALLDALAALARRTP

SEQ ID NO: 42335 - protein, 363 aa, Zea mays
  misc_feature (67)..(68): Xaa can be any naturally occurring amino acid
KSGWLEEPNASVSELTARRTRSPLLSSSSGSPSPHAIPTHYRLAFGYAYPAYECYKTVELNKPEIAXXIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQESQQPPQQQQPQVQVQQAQPQKQAAPVMRRASSIAARQAAMAQQSQETKPVSSSPKIKRQTSARSGSVASTKPPVAASAPKPGGSPKKGEVKPAAGPVQTPTTGADSPKPEPSAPSLPGAEGVDNIAIDEASGDAPEGAEELDPALEEETPMEETIRVTRAKLRRRMTTEDPAGN

SEQ ID NO: 42336 - protein, 495 aa, Debaryomyces hansenii CBS767
MLRSSSSFRGLNNKAIKIAQFVRHASTQEFDVVVIGGGPGGYVSAIKSAQLNLKTACIEKRGSLGGTCLNVGCIPSKSLLNNSQLFHQIQHDSKHRGIEISGDVSINIDTLQAAKDKAVKGLTGGVEMLLKKNGVTYFKGEGSFIDENNVNVKPIDGSEDIQISAKNIVVATGSEPTPFPGIEIDEERIVSSTGALALKEVPKKMSIIGGGIIGLEMASVWSRLGSEVTVIEFQNAIGAGMDGEVAKQIQKLLGKQGLKFKLGTKVTKGVRDGETVKIEVEDVKSGKKEDLDADVLLVAIGRRPFTNGLNFDKIGLEADDKGRLVIDNQFRTKHEHIRVIGDVTYGPMLAHKAEEEGIAAAEYIKNGHGHVNYANIPSVMYSHPEVAWVGANEEQLKEQGIKYKIGKFPFIANSRAKTNLDTDGFVKFIADAETQRVLGVHIIGSNAGEMIAEAGLALEYGASTEDIARTCHAHPTLSEAFKEAALATFDKPINF

SEQ ID NO: 42337 - protein, 262 aa, Methylococcus capsulatus str. Bath
MAAATERVICARAWFLGSRIDYREIERGGAVALGPLTLAVGREGYRITFRFGVVVLVGLSAEQEAEVLQGLRPVVHNPLAEPELEEVDLLIHPELPERLDSAGRLVLREASVARLQVVAHVLAKSCVLSYYERNVAEEFDRIEQIAQRLTRAAGPPRGKREILNEIGKALSIMGRMVGRVEVAEKPEIVWDDPQLDQLYERLATEYELRDRDRALSRKLELISRTAETYLDLVNHRQALRVEWYIVLLIVVEIVLSLYDKLS

SEQ ID NO: 42338 - protein, 471 aa, Nocardia farcinica IFM 10152
MPLSHPSFPQDPGPSEVAVNPVFTREPVSVPRDRLPAGELDADIAYQVVHDELMLDGNARLNLATFVTTWMEPSARVLMAECFDKNMIDKDEYPRTADLEQRCVRMLADLWHAADPAHATGCSTTGSSEACMLAGLALKRRWQHRRRAAGLSTERPNLVMGANVQVCWEKFADYWDVEARLVPMAGDRFHLTAEAALPHCDENTIGVVAVLGSTFDGSYEPVAEICAALDELERQRGWDIPVHVDGASGAMVAPFCDPDLVWDFRLPRVASVNTSGHKYGLVYPGVGWVVWRDAAALPEDLIFRVNYLGGQMPTFALNFSRPGAQVVAQYYTFLRLGRSGYTRVQQYCRDVATRLADRIAALGAFRLLTDGRQLPVFAFTLAEGETGYSVFDVSAALREQGWLVPAYTFPADREDLAVLRIVVRNGFSHDLADMLLDALAAVLPRLRAQDRPQHGPDTATFAHGAQAPSGH

SEQ ID NO: 42339 - protein, 1893 aa, Staphylococcus saprophyticus
MNFKGVKLLKNSKKRLDFLPNTLNKYSIRKFTVGTASILVGATLFLGVSNEAEAAEKIDSPTKEKVATTEEAATKEEAATTEEPATKEEAATTEEPATKEEAAIAEEPATKEEAATTEEPATKEEAAIAEEPATKEEAATTEEPATKEEAATTEEPATKEEAAIAEEPATKEEAATTEEPATKEEAAIAEEPATKEEAVTSEEAATKEKAAIAEEPATKEEAAIAEEPETKEEAATTEEPATKEEAAIAEEAATKEKAVTSEEAATKEKAAIAEEAATKEKAAIAEEPETKEEAATTEEPETKEEAAIAEEPATKEKAVTSEEAHGINNKNKQLLDMDKNSTIDEKFDYAKQAINELNINQKDISNIEASIKNNSDLKNLSKEELNNEILRAALVNESNNNDYGLQTLSAIEPLTTNVRNKNNSLSPVSRLKMLATATSGQNVNDKINITNASLTLNQKNNQHDDNTVWPTSNEQLRLSADYELDNSIKEGDTFTIKYGDYIRPGALELPAKNTQLRSKEGSIVANGVYDENTTTTTYTFTNYVDQYQNITGSFNLLATPKRETVTTDKQTYPMNVTIANQEVSENFVVDYGNHEDHLTNAAVVNVDNVNNQHNEVVYLNQSGDRIYDAKYFSIVQNGTFIPNEVKVYEVLDDNVLVDSFNPDLNGPAVKDVTSEFTPQYSLNNTRVDIDLNRSNMNKGSRYIITQAVKPSGTGNVNTTYELTRYGNEASRYPTGTKSTTVSYINGSSTAQGDNPTYNLGDYVWLDKNKDGIQNDDEKGISGVYVILKDSNNKELQRATTDDTGRYQFNNLQNGTYNVEFVIPNNYTPSPSNTIDNDTIDSDGQKDGDSNVVVAKGTINNADNMTVDTGFYETPKYSLGDYVWKDTNKDGVQDSDEKGIQGVTVTLKDKNGNVLKTTTTDENGSYRFDNLDSGDYIVHFEKPEGLTQTTTNSDSDENKDADGEEVHVTITDHDDFSIDNGYFDEDSDADADSDADADSDADADADADSDADADADADSDADSDADADADSDADADADADADSDSDADADADADADSDADADADSDADADADADSDADADADSDADSDADADADSDADADADADADSDADADSDADADADADADSDADADADADSDADADSDSDADADADADSDADADADADSDADADADSDADADADSDADADADSDADSDADADADSDADADADADADSDADADADSDADADADADADSDADSDADSDADSDADADADSDADADADADADSDADADSDADADSDADADADADADSDADADSDADADSDADADSDADADADADSDADADADADSDADADADSDSDADADADADSDADADADADSDADADSDADADSDADADADADSDADADSDADADADADSDADADADSDADADADADSDADADSDADADADADADSDADADADADSDADADADADADADSDADADADSDADADADSDADSDADADADSDADADADADSDADADSDADADSDADADSDADADADADSDADADSDADADSDADADADADSDADADSDADADADSDADADADSDADADSDADADADADADSDADADSDADSDADADADSDSDADADADADSDADADADADSDADADSDADADADSDSDADADADADSDADADSDADADADADSDADADADSDADADADSDADADADSDADSDADADADSDADADADADSDADADSDADADADADSDADADSDADADADADSDADADSDADADSDADADSDADADSDADADSDADADADADSDADADSDADADADADSDADADADSDADADADSDADADADSDADADADSDADADADSDADKYHNDTADKSNDNELPDTGNNTQNNGTLFGSLFAALGGLFLVGSRRKNKNNEEK

SEQ ID NO: 42340 - protein, 426 aa, Klebsiella pneumoniae subsp. pneumoniae MGH 78578
MKLYNLKDHNEQVSFAQAVTQGLGKHQGLFFPHDLPEFSLTEIDDMLAQDFVTRSAKILCAFIGDEIPQDVLQQRVRAAFAFPAPVSKVQEDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKATLGLNSANSINISRLLAQICYYFEAAAQLPQEARNQLVISVPSGNFGDLTAGLLAKSLGLPIKRFIAATNANDTVPRYLQGGEWAPKATQATLSNAMDVSQPNNWPRVEELFRRKIWRLSELGYAAVDDETTKAAMRELKAIGYISEPHAAIAWRALRDQLQPGEYGLFLGTAHPAKFKESVEEILQETLPLPKELADRADLPLLSHNLPADFAALRKLMMG

SEQ ID NO: 42341 - protein, 315 aa, Clostridium perfringens ATCC 13124
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDENGERDFEFHRGSDGEYSFNNIDLSKIEKDDIIHFGSATGFLKGELKNTYFKLLEIGRKNGNFISFDPNYRDMLIKEEGIEEFKEDCKKFISSCDFLKLSDEEIKLLTEEEDLERGVEKLHSLGAKIIAVTLGGKGTLLSNGIHSEIVPSIKINQVDSTGAGDAFVGAVLKKVSELENKKNLDLNLWREIISYGNKVGALTCTNYGAIDAIPNEEDLMKYI

SEQ ID NO: 42342 - protein, 116 aa, Helicobacter pylori
DPLIAVLFIVALFYLSHYFFASITAHVSALFALFVGIGSHIQGVNLQELSLFLMFSLGIMGILTPYGTGPSTIYYGSGYIQSKDFWKWGFIFGFLYLIVFLSVCVPWVKFIAFRWL

SEQ ID NO: 42343 - protein, 467 aa, Bdellovibrio bacteriovorus HD100
MLERIFLHQKQFALKLRGESLDVRIEALEALEKSIELHKQDIIDALKKDFQKPEAETLLSEIYPVLKEITYAKKNLSRWAKGRRVPTPLTLFGSKSYIVPEARGVCLLIAPWNYPFQLAFSPLVSAIASGNCAIMKPSEQTRHTSSIIKKITTEAFHPDHVFVAEGGPETTQELLSFAFDHIFFTGSTRVGKIVMTAAAKNLASVTLELGGKSPTIVDATANLAEAAEKIAWAKFINAGQTCVAPDYLFVHESVQHNFKKHLIAALEKFYGKSAEQRKQSPDFARMISFNHSQRLKDLIDEAVSKNAKVFFGGESQPEEHYCGPTLIEGVDPHSLIMQEEIFGPILPVMTFKEISEVIHFINERPKPLALYCYTHSQMNMEKIEKETSSGGLVYNDSVIHFANPHLPFGGVNHSGMGSYHGKHGFLEFSHQKAVLKQSFLGKLLRVMYPPYTEFKMTALKNLIRFSL

SEQ ID NO: 42344 - protein, 1442 aa, Saccharomyces cerevisiae
  misc_feature (1227)..(1227): Xaa can be any naturally occurring amino acid
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGXVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 42345 - protein, 254 aa, Glycine max
MAGAAKTLTNLCPSFPFTTKPQNPLTTHHSFPSTRLRHRAISAVANPVQPPLTTTEGQYRVDVLSESLPFIQKFRGKTIVVKYGGAAMKSPELQASVINDLVLLSCVGLRPVLVHGGGPEINSWLGRLNIPAVFRDGLRVTDADTMEIVSMVLVGKVNKTLVSLINKAGATAVGLSGMDGRLLTARPAPKAAALGFVGEVARVDPTVLRSLIDTNHIPVVTSVAADESGQPYSINADTVAGELAAALGAEKLIL

SEQ ID NO: 42346 - protein, 556 aa, Legionella pneumophila str. Paris
MSYLALARKWRPRTFSQLVGQEHINKALINALNQQRLHHAYLFTGTRGVGKTSVARILAKALNCEKGITSEPCLHCDTCVAIEQGRYIDLIEIDGASKTRVEDTRDLLDNIQYAPTNGRFKIYLIDEVHMLSQHSFNALLKTLEEPPSHVKFILATTDPQKLPVTVLSRCLQFNLKHLPAELINQQLQLILQEERLDFEIQALDILAQAARGSMRDALSLLDQAITSCETKLLASDVKILLGHTQQDYALLLLQALAKQEAPTMLVLSQQIIAEGGNFQYVLDEMLNYLHQITIYQCLGDNNPLISPKAEIKELAKQFSAEDTQLFYQIGIKGREEMHLAPTLAIGFNMTMLRMYTFKPASHVTTPPLAFEQNNKTCSLIIDDNTPAQNPIGIEPIPVTKATGNIVAYHQTQSLSTDDKKSANSGESMNCDWNDIIPQLKLSGLALNAIENAEFLGKKEREITLGVQKGHQSLFTPTTINRIETALAGYYKSPVKITLNSQDAVHASPAQQKEKATQEKQEQAEAALHADPVFQQLKQEFSAELVKNSIVLLKDDL

SEQ ID NO: 42347 - protein, 551 aa, Oryza sativa Japonica Group
MAGGDRIYGVFDHQLPAALKKLPFDKHLSLQNVRKVISEADGYQPHLIAPEQGYRRLIDSSLHYFRGPAEASVDAVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVGMECSVYFTAALLQVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQGETGANVLVGIQVPPEEFDEFKSRADNLGYEYMSEQNNEIYRLLLRDPKI

SEQ ID NO: 42348 - protein, 245 aa, Novosphingobium aromaticivorans DSM 12444
MTSPETASFGYEDIPAEEKEARVGAIFSNVARKYDVMNDAMSVGMHRLWKDKFVRRVRPRAGEAILDMAGGTGDIAFRMAPSGAAITVSDINQDMLNVGMERAEKRGLTGLEWSRQNAEELTFPDRAFDAYTIAFGIRNVTHVDRALAEAYRVLKFGGRFFCLEFSTTEWPGFAEVYDAYSHKLVPRIGQMIAGDADSYRYLIESIRRFPPMPEFERMIRAAGFTRTKVEPILGGLVAIHSGWKA

SEQ ID NO: 42349 - protein, 396 aa, Triticum aestivum
GTSSSQRFTSPPPKRVGSDKSVYGHASGREGCDMGPSPDWCSTPVVSDKHNSQKDSSWTRRYFDNGGRRRVSAVETVRSRTVSMAQAVQSTVDWELDPTKLLVGHRFASGAHSRLYRGLYDDKPVALKFIRRPKNDAGGIIAAKLDKQYNTEVNALSHLHHKHVIKLVAAHRVGPVYYIITELLPGGSLRSYLHNPEHCPLPLERTISIALEIARGLEYIHSQGVVHRDIKPENILFDEKFEVKIADFGIACEETLCDLLVDDEGTYRWMAPEMLKRKPYNRKVDVYSFGLLLWEMVTGRIPFENLSPVQVAYAVANNNKKAMEPEDYCPAVVRPLIEQCCALQPEKRPDFWQIVKTLEKIQSVMSQGGRLDALRSSDHKKGLKHWIQKLKPSHGA

SEQ ID NO: 42350 - protein, 218 aa, Mycobacterium smegmatis str. MC2 155
MTATLDYDGDIAVLDLGDDENRFTPQFLDEVDALLDAVLEKGAHGLVTTADSKFYSNGLDLEWLGAHSDQGAWYVGRVQGLLARVLTFPLPTAAAVVGHAFGAGAMLAMAHDYRVMREDRGFFCFPEVDIHIPFTPGMAALIQAKLTPQAAIASMTTGRRFGGSEAHEHGIVDATAHEGAVTLAATSLLRPLGSKDQGTLGAIKQVMFGAAAAALRNP

SEQ ID NO: 42351 - protein, 137 aa, Aspergillus nidulans FGSC A4
MFRSAVVRSLRASVPRAVKPQAALQIRSSPVARPAQLAPRFALPAVRFYSAPAGLKKEEVEGRIVNLLKNFDKVNDASKINGSSHFSNDLGLDSLDTVEVVMAIEEEFSIEIPDKEADAIHSVDKAVEYILAQPDAH

SEQ ID NO: 42352 - protein, 361 aa, Burkholderia sp. 383
MTDRTYKIAVIPGDGIGREVMPEGLRALDAVTARFGVRFDFVRIDWASCDYYAQHGKMMPDDWKAQLSGMDAILFGAVGWPATVPDHISLWGSLLKFRREFDQYINLRPARLFDGVPSPLAGRRAGDIDFMIVRENTEGEYSSVGGTMFEGTEREIVMQQSIFTRHGTERVLKFAFDLAQRRAKRLTVATKSNGIAISMPWWDARTAEMAERYPDIAVDKQHIDILCARFVLQPDRFDVVVASNLFGDILSDLGPACTGTIGIAPSANLNPDRKFPSLFEPVHGSAPDIAGQFIANPVAMIWSAALMLDFLGNGAGREREAHDAIVAAIEDVLRTGPHTRDLGGNAGTQEVGEAIAARIAG

SEQ ID NO: 42353 - protein, 664 aa, Zea mays
MSPSNPLPPPGETRVGCSLPSPVTPQAMGGGPARHVAMRALRARFLSRQREGGPAAASTWWWCASGSAKGDMESTLKGIRGSDAPCVLDLDDAATVAGGVEDTYGEDRATEEQLVTPWTVSVASGYNLLRDPRYNKGLAFTERERETHYLRGLLPPAIVSQELQERKIMNNIRQYQLPLQRYMALMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRATGQEYTDFLQEFMSAVKQNYGEKVLIQFEDFANHNAFDLLARYGTTHLVFNDDIQGTASVVLAGLIAAQTLLGGSLADHTYLFLGAGEAGTGIAELIALEISRQTKAPIEECRKKIWLVDSKGLIVSTRKESLQHFKKPWAHEHKPLSNLLDAVNAIKPTVLIGTSGKGQTFTKDVVEAISSFNERPIILALSNPTSQSECTAEQAYTWSKGQAVFATGSPFDPVEYNGKIHVPGQANNAYIFPGFGLGVVMSGAIRVHDDMLLAASEALAQQVTEENFEKGLIYPPFSNIRKISAHIAASVAAKAYELGLASRRPRPKDLVKYAESCMYSPIYRNYR

SEQ ID NO: 42354 - protein, 290 aa, Physcomitrella patens subsp. patens
NPGAMTYSEVRMLTKNFSPSERISSGAFGDVYKGTLPSGKILAVKRIKEGNEQGEESFLAEATSLRQIRHRNLLQLRAWSESKEGLVLVYDYMSNGSLDMWLYPSPKWTDFEPLSWPIRRSILAGVAAGLQYLHEGWVQCVLHRDIKASNIMLDENFEARLGDFGLARLVDHQKVEKTTLLAGTLGYMAPEMQHTGRATKETDLFAFGILVLEVVCGRKPLNTNPDCNLGDYVLLDSVWRAHEAGNILSVADPWILKSKPDYQSLIASILKIGLLCCLPDPSERPPMRQV

SEQ ID NO: 42355 - protein, 78 aa, Brassica napus
MSAPSPSPSLTNNGLSAAVTPPTNLRGRNKPKCIQCGNVARSRCPFQSCKGCCSRAENPCPIHVLKGVATSAEKTAPN

SEQ ID NO: 42356 - protein, 362 aa, Bradyrhizobium sp. ORS278
MRIRSMSKKPYRIAVIPGDGIGKEVMPEGLRVIEAAAKKHGVAVQFDHFDFSSYDYYEKHGQMMPDDWKSQIGGHDAIYFGAVGWPAKIADHVSLWGSLIKFRREFDQYVNLRPVRLMPGVPCPLANRKPGDIDFWVVRENTEGEYSSVGGRMFPDTDREFVTQQTVMTRTGVDRILKFAFELAQSRPKKHLTSATKSNGISITMPYWDERVEAMAKNYPGVKWDKYHIDILTANFVLHPDWFDVVVGSNLFGDILSDLGPACTGTIGIAPSGNINPERNFPSVFEPVHGSAPDIAGQGIANPIGMIWSGAMMLEHLGEKTAAQSIVGAIERTLAERTLRTRDLGGNADTVACGKAVAEMVD

SEQ ID NO: 42357 - protein, 158 aa, Methylococcus capsulatus str. Bath
MFRIGQGYDAHRFKEGDHIVLCGVKIPFGRGFAAHSDGDVALHALCDALLGAAALGDIGRHFPDTDARYKGIDSRVLLREVRQRIASLGYTVGNVDVTVVAQAPRLAAHIQAMRENLAQDLEIPPDCVNVKATTTEGMGFEGRGEGISAHAVALLARR

SEQ ID NO: 42358 - protein, 551 aa, Prochlorococcus marinus str. MIT 9313
MSRHFDRGSFRAVSDVHQLMSFPDFSASDAHVQWQRFNNLLWHHNDLGIWLDISRMHINAEDFERLGPRFDQAFKAMQALEQGAIANTDEQRMVGHYWLRQPQLAPDQEVCDHIAKEIDLIETFGSNVINGLIKAPNGKKFTDVLWIGIGGSGLGPLLMIRALQNAEQGLRFHFFDNVDPDGMSRVLGNLGDALSTTLVVTVSKSGATPEPHLGMEQARQRLEAMGGHWAGQAVAVTMLNSQLDQLAQKESWLKRFDMFDWVGGRTSITSAVGLLPAALIGCDIRAFLAGAAQMDEATRVSDLHSNPASLMAAAWFVAGDGLGRRDMVVLPYRDRLEVFSRYLQQLVMESLGKRLDRDGNVVHQGLAVYGNKGSTDQHAYVQQLRDGVDNFFATFIEVLEDVENIPAINNEHPGDFLDGFLQGTRAALSQGGRQSLTISMRRFDPRRLGALVALFERAVGLYGELVNINAYHQPGVESGKKAAAAILNLQSRVEDLLADGVERSAGEIHQVIGDGSEEAIFWIMRHLTANKRGYVAEGDWGIPTSLRFSKG

SEQ ID NO: 42359 - protein, 523 aa, Glycine max
  misc_feature (497)..(497): Xaa can be any naturally occurring amino acid
  misc_feature (509)..(509): Xaa can be any naturally occurring amino acid
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGGNTVVKGKHIIIATGSDVKSLPGITIDEKKVVSSTGALALTEIPKRLIVIGAGYIGLEMGSVWGRLGSEITVVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFLANSRAKAIDNAEGLVKILAEKETDKILGVHIMAPNAGELIHEAAIALQYDASSEDIARVCHAHPTMSEAVKEAAMATYDKXHSHLKRRLLLSXLLSFLSKNFTMTWR

SEQ ID NO: 42360 - protein, 463 aa, Neptuniibacter caesariensis
MSKLFERLSRHRSIAFASVKPQVIGRITRMIGLTIEAVGIKCAVGECCSIVLSPEQHIEAEVVGFSGDRIYLMPLYPIEGLQAGTPVIARADTGMVPVGMNLLGRVLNGVGKPIDGKGPLRPEAETGLAGEIINPLLRAPINQTLDVGIRTINSLLTVGRGQRMGLFAGSGVGKSVLLGMMTRFTEAEIIVVGLIGERGREVKEFIEHSLGEEGLKRSVVVASPADDSPLMRLRASQLSTRIAEYFRDQGKNVLLLMDSLTRYAQAQREIALAVGEPPATKGYPPSVFAKIPKLVERAGNAQEGGGAITAFYTVLTEGDDQQDPVADSARAILDGHVVLARRLAEQGHYPAIDVEASISRAMPQIIEPDHLKMAMRFKQLYSKYRQNEDLINVGAYVKGSDPDTDFVIENLPSMNAFLRQDIGEPVPLQLSMQQMVMILSTPPPQPAAAQGQVHRPVTNGLQK

SEQ ID NO: 42361 - protein, 262 aa, Magnaporthe grisea 70-15
MNIDTSPPAAEAAHSHLPRRAFVTIGATAGFRSLLEQVLRPEFLRWMRGYGFVRMTVQCGSDLEWFRSSLAAVADTCGVEVDCFQYTTSMRDYIMPCRPVEGVCNAGIVICHAVSANLPHHHELPGAGTVVDVSRCGVPFVVVPNEGLMDNHQAELATHLDKERWAVAAKPEALPQAIRRAHEQAYAGGLAPQPEVSAGVSEDAGFPAPEHERITLLDWMTLSCYDDASSSTLATLGQPSASDMSSENKSRSARHPHARPVS

SEQ ID NO: 42362 - protein, 230 aa, Methylococcus capsulatus str. Bath
MNEFWIAPSILSADFARLGEEVDDVLKSGADIVHFDVMDNHYVPNLTIGPLVCEALRKHGVTAPIDVHLMVKPVDRIIPDFAKAGASYITFHPEASEHIDRSLQLVKDSGCKTGLVFNPATPLNYLDHVMDKLDMILLMSVNPGFGGQSFIPYVLDKVRECRRRIDASGRNIRLEIDGGVNARNIREIAAAGCDTFVAGSAVFGAGKAEDPNRYDSIIRALRDELAQTRA

SEQ ID NO: 42363 - protein, 125 aa, Glycine max
LNGGANFVAPGYTKGDGLGAEIVGTFVLVYTVFSATDAKRNARDSHVPILAPLPIGFAVFLVHLATIPITGTGINPARSLGAAIIFNKDLGWDDHWIFWVGPFIGAALAALYHQVVIRAIPFKSK

SEQ ID NO: 42364 - protein, 376 aa, Solanum dulcamara
MAIDCMITNGKSPMLDEKKTLIFDASHMKRESNIPTQFIWPDHEKPCAVAQQLAVPLIDLRGFLSGDSDAAQQASKLVGEACRSHGFFLVVNHGVEANLISNAHRYMDTFFDLPLSEKQKAQRKIGEHCGYASSFTGRFSSKLPWKETLSFRYSAEENSSHIVEEYFQRTLGESFNHLGNVYQEYCNSMNTLSLGIMELLGMSLGVEKSHFKEFFEENDSIMRLNYYPPCQKPELTLGTGPHCDPTSLTILHQDCVGGLQVFVDDEWRSITPTFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLQHNTTAQL

SEQ ID NO: 42365 - protein, 269 aa, Physcomitrella patens subsp. patens
MQSEGKGHRGVVTMTGAGKFFVGGNWKCNGTTESIKKLVEDLNSAQIEDDVDVVVAPPFLYISQVVGSLTDRIEVSAQNSWVGKGGAFTGEISADQLVDVGVKWVIQGHSERRHVIGESNSTVGKKSAYALSKGLGLIACVGELLEEREAGRTTDVVFEQLQAYADEISDWSKVVIAYEPVWAIGTGKVASPQQAQEVHSAIRSWLSDKISPEVSSATRIIYGGSVNGANSAELAKQEDIDGFLVGGASLKGPEFATICNAVTAKKVSA

SEQ ID NO: 42366 - protein, 116 aa, Helicobacter pylori
DPLIAVLFIVALFYLSHYFFASITAHVSALFALFVGIGSHIQGVNLQELSLFLMFSLGIMGILTPYGTGPSTIYYGSGYIPSKDFWKLGFIFGFVYLIVFLSVCVPWVKFIAYRWL

SEQ ID NO: 42367 - protein, 420 aa, Nocardia farcinica IFM 10152
MTAAPVTGRTLDVARIRADFPILSRTVRDGKPLVYLDSGATSQRPLAVLDAEREFLTERNSAVHRGAHQLAEEATDAYEGARADIARFVGVDAGEIVFTKNATESLNLVTYSFADNRFPYHVGPGDEIVVTELEHHANLVPWQELARRTGATLKWYGITDDGRIDLDSLELSPATKVVAFTHQSNVTGAVSPVEELVRRATAVGALTVLDACQSVPHMPVDFRALGVDFAAFSGHKMLGPSGVGVLYGRRALLEETPPFITGGSMIETVTMEGSTFAPPPQRFEAGVPMTSQVVGLGAAVRYLEGIGMAAVAEHEHALTGAALAGLGAIDGVRIVGPTENVDRGGAVSFVVDGIHAHDVGQILDDEGVAIRVGHHCAWPLMRRLGVPATARASFAVYNTLDEVEQLVAAVRKAQRFFGVA

SEQ ID NO: 42368 - protein, 477 aa, Mycobacterium smegmatis str. MC2 155
MGSSFIAANGLWTQHQEEAAAKLVAQLDDLNLRQVRISWGDQHGILRGETLEVDAFRSALKEGKDFQTATLIFDSTNNPVVPPFEADGFGDKRLTGLPDAVLVPDPTTFRVLPWADRTGWVLSEMYYRSGERVPFDTRGVLKTQLAKLEAEGFSFTTGAELEFYITRLVDPKLSFVDSGWPPAAPEVTALSHGYQYLTENRGDEIDHILSILRDHIVALGMPLATVEDEWGPGQVEMSFDPLVGVETADNVLLIRSAIKQICRRHGYHATFMSRPAFPNIVSSGWHLHQSLGAAGQANIFPGEDGKLLSDTAMHYMAGLLEHAKASSVLTTPTINGYKRYIANSFAPDRIAWAEENRGAMIRISGARGDNSTHLENRIGEPAANPYLYMASQLIGGRDGIARKLEPGPSADEAYTADVPLLPATLEEAVGHFESSAVMRRELGDMFVDYLTTVKKNEISRFNAYVTDWEQREYFEVF

SEQ ID NO: 42369 - protein, 116 aa, Helicobacter pylori
DPLIAVLFIVALFYLSHYFFASITAHVSALFALFVGIGSHIQGVNLQELSLFLMLSLGIMGILTPYGTGPSTIYYGSGYIPSKDFWKLGFIFGFVYLIVFLSVCVPWVKFIAYRWL

SEQ ID NO: 42370 - protein, 252 aa, Cryptococcus neoformans var. neoformans JEC21
MAKQLVQRLSPLIEELLQASDLSTVSAKAIRKELIARGADKYEIKNFRAEIDDKITEIYNSLGSKEAPAPKIEGSVSPSAKAPSSPHSLIEPKTVTRKRKAPTSENEETDEQMARRLQGEYGGSRTRKQRSSRSARPAKKTRPKSHAHIDNETEKNGDKKDDTKTKRGGAFNKELLLSDSLAELVGSHSLSRPQVVKHIWAYVKERNLQDSNDRRYILCDDKLREVFHTDRLHMFTMNKILVNHLRDPDDIA

SEQ ID NO: 42371 - protein, 116 aa, Helicobacter pylori
DPLIAVLFIVALFYLSHYFFASITAHVSALFALFVGIGSHIQGVNLQELSLFLMFSLGIMGILTPYGTGPSTIYYGSGYISSKDFWKWGFIFGMVYLIVFLSVCVPWVKFIAYRWL

SEQ ID NO: 42372 - protein, 789 aa, Gibberella zeae PH-1
MANRPSHSRTNSSTDHRPAQPSTLRQTVNRNQNDASATGNPAPPESPGHPQGATIDEIFANESTPLIDGNNQRPSQRRGSVHPAHPGVCSHGTFSPRPMSPTLTMRSTDEDGSETAGSGTHIPVLDNAITTIVGHEDWKKWLKKRMRTKTMGHSSVLAEQAGIEDTAFMYMAYYIPCLNWMRQYKVSYLRGDLIAAVTMASFYLPMALSLAANLAHVPPIHGLYAFVFNPFIYALLGSCPQMVVGPEAAGSLLVGTVVKQNVGSGDDEDNDMLHAQICGIVAGMAGAMVVIAGLARLGFMDSVLSKPFLRGFISAIGFVIAVDQLIPELGLAELADKAGVSHGSPVEKIRFIIGNVDKAHGLTFAIAGISFLVIMICRELKNRLQPRYPGVAYIPDRFIVVVISAILCWQLDWENQGVEILGIVKAANGQLLAFQWPFKLQHMPHIRSAMSTSFLIALLGFFESSVAAKSLGSSETIQGIQLSANREMIALGIANMVGGCFMSLPAFGGYGRSKVNKSTGGKSPASSMFLSIISLLSIFFLLPYFYYLPKPVLSSMISVVAYSLIEEAPHDISFFLKIRGWTELGLMAVIFLATMFYSLTLGMAFGVGISMLMVIKHSTRPRIQILGRIPGTNRFENAEGDKASLEFVEGCLIVKIPEPLTFANTGELKSRLRRLELYGTSKAHPALPRLRHADMNRNVIFDIHGVTSMDGSGTQVLAEIVRNYTERGVRVYFSRCPARKDHPVWRLMSSSGIVEMAGDRHFVNDVEEALRLTEYEESITGESSRHREL

SEQ ID NO: 42373 - protein, 342 aa, Burkholderia sp. 383
MKALAKLERGPGLTLTRVKRPEVGHNDVLIKIRRTAICGTDIHIWKWDDWAQKTIPVPMHVGHEYVGEIVEMGQEVRGFAIGDRVSGEGHITCGFCRNCRAGRRHLCRNTVGVGVNREGAFAEYLAIPAFNAFKIPPEISDDLASIFDPFGNATHTALSFNLVGEDVLITGAGPIGIMAVAIAKHVGARNVVITDINDYRLELARKMGATRAVNVARESLRDVMSDLHMTEGFDVGLEMSGVPSAFTSMLEAMNHGGKVALLGIPPAQTAIDWNQVIFKGLEIKGIYGREMFETWYKMVAMLQSGLDLSPIITHRFAADDYEKGFAAMLSGESGKVILDWTA

SEQ ID NO: 42374 - protein, 418 aa, Geobacter metallireducens GS-15
MVSKTILDNGVRVISEYMPHAHSVSIGIWVANGSRHERREHNGVAHFIEHLLFKGTVRRSALDIAREIDSVGGVLNAFTSREYVCYYAKVLDKNLPQAVDLLTDIFLNSTFDPEEIEKERKVVLQEISMLEDSPDDYVHDLFHRSFWRGHPLGMSILGSAESVSNLSRDAIVAHRDAMYRSEDIIVAVAGNVRHDELLKLISGSFDSVPEGTGRNCCHLPVYDQKLEIVEKDLEQLHICLGTKSLPHNHPRRFEAYLMNTILGGSMSSRLFQEIREHLGLAYTVYSYVVSHTDAGSLVVYAGTSPEKLSDVLEITCSELRRLKFEPVPATELEAAREQLKGNILLSLESSDNRMTKLAKNEIYFGRYLSLAELTGGFDSATADGIAELANDFFSGDYVTLALTGKISGQIPDLSHLVL

SEQ ID NO: 42375 - protein, 250 aa, Burkholderia thailandensis E264
MYKLVLIRHGESTWNKENRFTGWVDVDLTEQGNSEARQAGLLLKEAGYTFDIAYTSVLKRAIRTLWHVQDQMDLMYVPVVHSWRLNERHYGALSGLNKAETAAKYGDEQVLVWRRSYDTPPPALEPTDERAPYGDPRYAKVPREQLPLTECLKDTVARVLPLWNESIAPAVKAGKQVLIAAHGNSIRALVKYLDGISDADIVGLNIPNGVPLVYELDANLTPIRHYYLGDPEAIAKAQAAVAQQGKASAA

SEQ ID NO: 42376 - protein, 365 aa, Campylobacter upsaliensis RM3195
MIEKIKERLARVKYPNFEKDIMSYGFVKEIRVDDEKAYIKLEIVAANPNIADTLRKDIDEVLKDLNLKDIKLEILQPQIEEEKSNSKSGKNVAPQVKNFVMVSSGKGGVGKSTTALNLAISMAKMGLKVGIVDADIYGPNIPRMLGEVGTQPEVVGAKLRPILTHGIYMMSMGVLIEEGQGLMWRGAMIMKAVEQLLSDVLWPELDVLFLDMPPGTGDAQITSAQSIPINAGVCVSTPQIVSLDDSKRALDMFKKLHIPIAGVIENMSGFLCPDNGKEYEIFGKGNAKAMAELYHCELLAQIPLEMSVREGGDEGKPVSFYQSESVSAKRYAEAAQKLWDFIQKNGSSDNAAIQPVMNGKSACSS

SEQ ID NO: 42377 - protein, 364 aa, Campylobacter upsaliensis RM3195
MLAAGDSTRFNMGVKKQFIRLGDDPLWLFATKNLSSFYSFKKIIVTSSNISYMKKFAKNYEFVQGGASRMQSLKNALDLVKSEFVMVSDVARVLISKNLFNRLLENIHNADCITPALKVCDTALYENEQSLQREKIKLIQTPQLSRTALLKKALQTGQEFTDDSTAVAAVGGKIWFVSGEENARKITFKEDLKKLKLPTPSKDIFTGNGFDVHEFGEKRALLLGGVEIHPTMGLKAHSDGDVLAHALSDALLGASSLGDIGEFFPDTDLKYKNADSMKLLAQIYTQIRQYGFICVNIDITILAQKPKIGDFKKEIAKNIAQILDLDEFRVNVKATTTEKLGFIGRSEGIAVQASVNLKYFDWTK

SEQ ID NO: 42378 - protein, 718 aa, Saccharomyces cerevisiae
MGSDRSCVLSVFQTILKLVIFVAIFGAAISSRLFAVIKFESIIHEFDPWFNYRATKYLVNNSFYKFLNWFDDRTWYPLGRVTGGTLYPGLMTTSAFIWHALRNWLGLPIDIRNVCVLFAPLFSGVTAWATYEFTKEIKDASAGLLAAGFIAIVPGYISRSVAGSYDNEAIAITLLMVTFMFWIKAQKTGSIMHATCAALFYFYMVSAWGGYVFITNLIPLHVFLLILMGRYSSKLYSAYTTWYAIGTVASMQIPFVGFLPIRSNDHMAALGVFGLIQIVAFGDFVKGQISTAKFKVIMMVSLFLILVLGVVGLSALTYMGLIAPWTGRFYSLWDTNYAKIHIPIIASVSEHQPVSWPAFFFDTHFLIWLFPAGVFLLFLDLKDEHVFVIAYSVLCSYFAGVMVRLMLTLTPVICVSAAVALSKIFDIYLDFKTSDRKYAIKPAALLAKLIVSGSFIFYLYLFVFHSTWVTRTAYSSPSVVLPSQTPDGKLALIDDFREAYYWLRMNSDEDSKVAAWWDYGYQIGGMADRTTLVDNNTWNNTHIAIVGKAMASPEEKSYEILKEHDVDYVLVIFGGLIGFGGDDINKFLWMIRISEGIWPEEIKERDFYTAEGEYRVDARASETMRNSLLYKMSYKDFPQLFNGGQATDRVRQQMITPLDVPPLDYFDEVFTSENWMVRIYQLKKDDAQGRTLRDVGELTRSSTKTRRSIKRPELGLRV

SEQ ID NO: 42379 - protein, 348 aa, Bordetella bronchiseptica RB50
MSFQVTIEPSKHQFQAEAGQTVLDAALAAGIVLPYSCRTGACSTCKGKVVAGEVDAGPYPAQILSPEDLAQGYTLFCQAKPQSDLVVESTEVRLASDIQIRKLPSRVQTIERVAPDVAVLKLQLPASEQFRYYAGQYIEVILKDGKRRSYSMAGAPHTGSPLELHIRHMPGGLFTDHVFGAGDTQMKEREILRLEGPFGSFFLREDSDKPIVLLASGTGFAPVKAIVEHMIHNQIQRPAVLYWGGRRPRDLYHDALAQSWAGSLPGFRYVPVVSDALDEDGWSGRTGYVHEAVMQDLSDLSGYEVYACGTPLMVDAARREFSAQCGLPAEAFYADAFTSEADLAKATP

SEQ ID NO: 42380 - protein, 427 aa, Methylococcus capsulatus str. Bath
MSKIVDILAREILDSRGNPTVQAEVILDSGAEGSAMVPSGASTGAREAIELRDGDASRYGGKGVLKAVENVRGPIKAALTGMDAADQAAIDRRLIELDGSDNKGVLGANAILAVSLATAHAAAADAKKPLYAYLNRSGEFLLPVPMMNIINGGAHADNSIDMQEFMILPVGAPSFREALRYGAEVFHALKKVLSDRGLATGVGDEGGFAPNLPSNEAAIGIILEAIEKAGYRPGEDICLGLDVASSEFYSDGIYTLASEGRRFTSEEFSDHLAAWVDKYPIVSIEDGMAENDWHGWGIHTDRLGRRIQLVGDDLFVTNPAILKQGIEARIANSILIKVNQIGTLTETLEAIHIARKAGYTSVVSHRSGETEGTTIADIAVATCTGQIKTGSLSRSDRIAKYNRLLKIEEELGDKARYGGRGAVKNLA

SEQ ID NO: 42381 - protein, 290 aa, Bordetella bronchiseptica RB50
MSTRIRSLHIYPVKSCAGIDLAESIVDRAGLAHDRRWMVTTAAGQFMTQRQYPQMARIRTALEDGMLVLRAPGMEDLRIPADGSELAERTQPVGVWRDTVIARAEHPRSAEWLSRFLGLPCRLLKIDLRADRSANPEWVDTWLERHPEWAEDFAGDHFFGFADGFPLLVANQSSLDELNERLAARGQAPVPMNRFRANIVVEGDWPAFEEDQTACIVAGGVRMAFVKPCTRCPMPNVDQVTAEVYDEPGLTLTTFRSLEIGVVFGQNAIVDRTAPAPLRVGDAVEIELDF

SEQ ID NO: 42382 - protein, 389 aa, Arabidopsis thaliana
MEKTSMFSIHEGKPIRCKAAVSRKPGEALVIEEIHVDPPQAYEVRIKIICTSLCHTDVSFSKIDSGPLARFPRILGHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 42383 - protein, 184 aa, Glycine max
DAFVEKHGVKLGLMSGFVKAAVNALQHQPIVNAVIDGDDIIYRDYIDISIAVGTPKGLVVPVIRNADTMNFADIEKQINTFAKKANDGSLSIDEMAGGTLTISNGGVYGSLLSTPIINPPQSAILGMHSIVSRPTVVGGNIVPRPMMYVALTYDHRIIDGREAVFFLRRIKDIVEDPRRLLLDI

SEQ ID NO: 42384 - protein, 227 aa, Glycine max
MEAVCGSGSSVWVTSSLTRSPKITLPLFRASYQHLTAFPSQSLLFSYHPSRYANARTLRARTSSKPIFLPHLIASLEQVDQTYIMVKPDGVQRGLVGEIISRFEKKGFKLTGLKLFQCSKELAEEHYKDLKQKSFFPKLIDYITSGPVVCMAWEGVGVVASARKLIGATDPLQAEPGTIRGDLAVQTGRNVVHGSDSPENGKREIALWFKEGEVCDWTPVQSPWLRE

SEQ ID NO: 42385 - protein, 266 aa, Neptuniibacter caesariensis
MELSSLYVTVIEPSKVQRHIIIGHLNSFGIENIEEFEEAKPALEHMLVTPPDVVLSSMHLPDMTGTDLVTQMRGLEALEKITFLLVSSETHYRYLEPIRQAGAIAILPKPFSREEMAMALKSTLDYVSDFESDSDSDEYDALRVLVVDDSTMSRNYIKQMLDSLSIHSIDTAADGSDALQMIDDGARYDLIITDYNMPNVDGKELIEHIRSHSEQPTVPILMVTSEQNESRLAAVQSAGVSAICSKPLSYDTVKQLIEQLVTDYDM

SEQ ID NO: 42386 - protein, 116 aa, Helicobacter pylori
DPLIAVLFIVALFYLSHYFFASITAHVSALFALFVGIGSHIQGVNLQELSLFLMLSLGIMGILTPYGTGPSTIYYGSGYIQSKDFWKWGFIFGFVYLIVFLSVCAPWVKFIAFRWL

SEQ ID NO: 42387 - protein, 542 aa, Ostreococcus tauri
MSALNVRDSYDVNALEIPPMEQRTKVQGVGAHVSASIGSPEVGSPTKYFTKMLENNCSAGKARRGMNGEFVSTYDERIARCGGNREPFLIGVAGGTASGKTTVCDLIMQNLQEQRVVLIAQDSFYRPLTAHERENVGSYNFDHPDAIDTACLKDVLHKLMLRLPVDVPVYDFVTHSRSEETIRIESGDVIIIEGILVLAMEEIRNMCHMKVFVDTDDDLRLARRLKRDTVDRGRSVDGVITQYTMFVKPMFDAYVSPSKRHADVIIPWAQGENSVAIDLIVQHIRTKLGQNDLRRIYRNLVVLPPQFQIRGMHTIIRDRSVNRSDFVFYSDRIIRLVVEHGLGHLPFNEHVVFTPTGDQYKGVTFCSKLCGVSIIRSGEAMENALRACCKGIKIGKLLIERRDRDGLRRAESDPKVGSPQSETCPRILYEKLPHDIADRFVLVLDPILATGVSAQAAVDLLLDRGVKEEKILFLSVIASTQGVHHLCTRYPRMKVITSEVDAGLSDDNKVLPGVGEFGDRYFGTEIPSMASLQTDQDGTLFD

SEQ ID NO: 42388 - protein, 77 aa, Geobacter metallireducens GS-15
MSAIDKRVKEIVAEQLGVDEAQVTNEASFMDDLGADSLDTVELVMALEEEFDIEISDEDAEKIQSVQDAIDYITEHT

SEQ ID NO: 42389 - protein, 400 aa, Desulfovibrio desulfuricans G20
MTTFDELKQREESLLCRTYGRYPLAVASARGSVLTDFSGREYIDLLSGIAVTNLGHCHPALAEVMHAQAGRLVHLSNLFYQQEQLELAEKLLGTTHLGKAFFCNSGAEANEAAIKLARRYAQRVKERDAGTVITLTGAFHGRTLATVAATGQAKFQDGFAPIPQGFRQVEWGSLDALEAAMDDDVVAVLAEIVQGEGGIRPMTPEYAQGVQDICRRHGVLFMVDEVQSGMCRTGRFWAFQHYGLTPDVVTSAKALANGLPMGAMLATDEAAKGFEPGSHATTFGAGALVSAVAARVVDIMQQEKLAERADRVGGAFMADVRSLAARLPGTIQEVRGLGLMIGIVLTFPGREVWEELLRRGFVLNLTQERVLRLLPALTVPETYLQDFLTALEEILSERTV

SEQ ID NO: 42390 - protein, 499 aa, Arabidopsis thaliana
MYRTAASRAKALKGILNHNFRASRYASSSAVATSSSSSSWLSGGYSSSLPSMNIPLAGVSLPPPLSDHVEPSKLKTTTLPNGLTIATEMSPNPAASIGLYVDCGSIYETPQFRGATHLLERMAFKSTLNRSHFRLVREIEAIGGNTSASASREQMGYTIDALKTYVPEMVEVLIDSVRNPAFLDWEVNEELRKVKVEIGEFATNPMGFLLEAVHSAGYSGALANPLYAPESAITGLTGEVLENFVFENYTASRMVLAASGVDHEELLKVVEPLLSDLPNVPRPAEPKSQYVGGDFRQHTGGEAKHFALAFEVPGWNNEKEAIIATVLQMLMGGGGSFSAGGPGKGMHSWLYLRLLNQHQQFQSCTAFTSVFNNTGLFGIYGCTSPEFASQGIELVASEMNAVADGKVNQKHLDRAKAATKSAILMNLESRMIAAEDIGRQILTYGERKPVDQFLKTVDQLTLKDIADFTSKVITKPLTMATFGDVLNVPSYDSVSKRFR

SEQ ID NO: 42391 - protein, 559 aa, Penicillium chrysogenum
MGHPDEINALEAQPGYVDNLGDFKESEQDEPVQLHRELKARHISMIAIGGAIGTGLVVGTGSALTAGPGSLFIAYCFMGFVVWTVMCGLGEMAAWLPLSSGFTGYAGRFCDPALGFTLGWCYYLKYIILPPTQLTAAALVITYWPRTSAENVNPGVWIAIFMVAIIVINYFGVKIFGELEFWLSSFKVIVILGLILCSLLFALGGGPDHDRRGFRYWNKPGAFATKYTDGALGKFLAFWSTMVQATFAFLGTELIGVTVGEAQNPRKTIPKAIKLTFWRIIVFYILSVLFLGMLVPYDSKELAFATEAESSAAASPFVVAMGQVAALPHIINGCILVFVFSAANSDLYIATRTLYGLAREKKAPKIFARTNRAGVPIYSLALSASFCLLAFMSVSSTSKEVFGYFTDMVSIFGLLTWVSLLITHIFFIRARRAQGVDQATLAYKAPLGIIGSCIALFFCVLVLFTRSFGVFIHDPETYGNFDYKTFITSYIGIPLYVAAFAGWKIWNKTEIIKPHNADIWTGKAEIDREEAEYVAMVAIQDQNLSGWNKVYRKSLAWLF

SEQ ID NO: 42392 - protein, 347 aa, Brassica napus
  misc_feature (200)..(200): Xaa can be any naturally occurring amino acid
MATFGATANTNPNKSFEVTPSPADSISSLSFSPRADILVATSWDNQVRCWEISRSGASLASAPKASISHDQPVLCSAWKDDGTTVFSGGCDKQAKMWPLLSGGQPVTVAMHDAPIVDMAWIPGMNLLVTGSWDKTLRYWDTRQQTPVHTQQLPDKCYALSVKHPLMVVGTADRNLIVFNLQNPQTEFKRIVSPLKYQTRXCVTAFPDQQGFLVGSIEGRVGVHHLDDSQQNKNFTFKCHRDGNEIYSVNALNFHPVHGTFATAGSDGAFNFWDKDSKQRLKAMSRCSQPIPCSSFNHDGSIYAYASCYDWNKGAENHNPATAKSSIFLHMPQESEVKAKPRVASGRK

SEQ ID NO: 42393 - protein, 317 aa, uncultured Flavobacteriaceae bacterium
MKTYTYTEKKDTRSGFGAGLAELGKTNKNVVALCADLIGSLKMDKFIEENPERFFQVGIAEANMMGLAAGLTIGGKIPFTGTFANFSTGRVYDQIRQSIAYSGKNVKICASHAGLTLGEDGATHQILEDMGLMKMLPGMTVINTCDYNQTKAATIAIAGHEGPVYLRFGRPAVPVFTPADQKFEIGKAVKLTEGKDVTIVATGHLVWEALEASKVLFERGISAEVINIHTIKPLDEKAILESVSKTGCIVTAEEHNIIGGLGESVARVLSLHKPTPQEFVGTNDTFGESGTPAQLMEKYGLNSVSIVSKAETVVKRK

SEQ ID NO: 42394 - protein, 308 aa, Bacillus caldolyticus
MTHLFALSELPLDEIHRLLDEAERFRSGRIWRPAAPMYVANLFFEPSTRTKCSFEMAERKLGLHVIPFDPERSSVQKGETLYDTVRTLEAIGVDAVVIRHHEDAYFEALRHAVGIPIINAGDGCGHHPTQSLLDLLTIRQEFGAFTGLTVAIIGDIRHSRVARSNAEVLTRLGANVLFSGPEEWKDETNPYGTYVEVDEAIARADVVMLLRIQHERHAETMGLTKEEYHARYGLTLERARRMKSGAIILHPAPVNRGVEIASELVEAKASRIFKQMENGVYVRMAVLKRAMEGRMEHGRMAEKWHVVQ

SEQ ID NO: 42395 - protein, 679 aa, Arabidopsis thaliana
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRGKMLQKISQSISLCNGDQFKPLIYLAGAPTNFISSPLSVSGKKKSSSLRIKRIQQLQSTLEDRINPPLVCGTVSPRLSVPDHILKPLYVESSKVPEISSELQIPDSIGIVKMKKACELAARVLDYAGTLVRPFVTTDEIDKAVHQMVIEFGAYPSPLGYGGFPKSVCTSVNECMFHGIPDSRPLQNGDIINIDVAVYLDGYHGDTSKTFLCGDVNGSLKQLVKVTEECLEKGISVCKDGASFKQIGKIISEHAAKYGYNMERFIGHGVGTVLHSEPLIYLHSNYDYELEYMIEGQTFTLEPILTIGTTEFVTWPDKWTIVTADGGPAAQFEHTILITTTGAEILTISS

SEQ ID NO: 42396 - protein, 174 aa, Burkholderia thailandensis E264
MTIYKLGDNAPSIHESVFVADSATIIGQVVLEENASVWFGATIRGDNEPITVGAGSNVQEGAVLHTDPGCPLTIAPNVTVGHQAMLHGCTIGEGSLIGIQAVILNRAVIGRNCLVGAGAVITEGKTFPDNSLILGAPAKVVRTLSDEDIARMHMNTKSYAMRRAYFKEQLVRIG

SEQ ID NO: 42397 - protein, 348 aa, Triticum aestivum
NKFVQKSRLVPVRNSRDIVDPRVRLNRHAVATREDVGTPKAYCLKKHFSLIYPECQIEARVQLYDSSAEDEILSGQPDFVLDCIDNIDTKVSLLAACVRRGLRVLSAMGAGARADPTRIRVADLRESSNDPLSRAVRYRLKKDHGIEGGIPVVFSMEKPKAKLLPFQGSKEEETPSDYQIVPGFRVRIIPVLGTIPAIFGQVMASYVVTQLAQLDFQTEPIVNLDLDHYRVLHHRLLEHEELIYGSAEQVLVDAEEVMSCVEGACRGRRARHQNMKDTGRKMWRSVNELMLVRWDKSKSAGVSNLILLKFSEADAHESTTLDQIKDEEPEFHAMVSRVLKRAETEFAL

SEQ ID NO: 42398 - protein, 398 aa, Mycobacterium tuberculosis H37Rv
MAYDVARVRGLHPSLGDGWVHFDAPAGMLIPDSVATTVSTAFRRSGASTVGAHPSARRSAAVLDAAREAVADLVNADPGGVVLGADRAVLLSLLAEASSSRAGLGYEVIVSRLDDEANIAPWLRAAHRYGAKVKWAEVDIETGELPTWQWESLISKSTRLVAVNSASGTLGGVTDLRAMTKLVHDVGALVVVDHSAAAPYRLLDIRETDADVVTVNAHAWGGPPIGAMVFRDPSVMNSFGSVSTNPYATGPARLEIGVHQFGLLAGVVASIEYLAALDESARGSRRERLAVSMQSADAYLNRVFDYLMVSLRSLPLVMLIGRPEAQIPVVSFAVHKVPADRVVQRLADNGILAIANTGSRVLDVLGVNDVGGAVTVGLAHYSTMAEVDQLVRALASLG

SEQ ID NO: 42399 - protein, 446 aa, Bordetella bronchiseptica RB50
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQRRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMGKGSGFFQHGHTYLGHATACAASLAVQEVIRRDGLLARVRQQGDGLRQRLMQALGAHPHVGDIRGRGLFLGVELVRDRATKATFDPELALHARVKREAMARGLMVYPMGGTIDGRHGDHVLVAPPFIIADDELDQLVERLAGAIDAAIAQTRA

SEQ ID NO: 42400 - protein, 321 aa, Nocardia farcinica IFM 10152
MRAIQVSEHGGPEVLTYTELPEPSIGAGGLLVETEAIGINFIDTYIRTGTYPQDVPYVPGAEGTGVVTAVGDGVTEFAVGDRVAWAAAPGSYAEQVAVPADVAIPVPDGVSAPIAASVLLQGMTAHYLIESVYRPEPGETVLVHAGAGGVGLILTQLAVARGVRVITTVSSDEKEALSREAGAAEVLRYGDDLAERVRALTDGVGVAAVYDGVGKDTFDASLAALRIRGTLALFGAASGPVPPVDPQRLNSGGSLFLTRPTLAHYTRDRAELLWRAGDVFRAVADGTLRIRVGAQYPLAEAERAHRDLEGRKTTGSIVLIP

SEQ ID NO: 42401 - protein, 522 aa, Nocardia farcinica IFM 10152
MAGTASVPSAGWRNPLRDERDKRVPRIAGPCSLVIFGVTGDLSRRKLMPAIYDLANRGLLPPGFALVGFARRDYANEDFAQVVLEAVKAHARTPFRQEVWDHLAEGIRFVQGTFEDDAAFATLAQTLGQLDKERGTGGNHAFYLSIPPDMFPVVLDQLSQHKLAGPVDPDASGRTPWRRVVIEKPFGHDLDSAVELNTLVNRVFPEETVFRIDHYLGKETVQNILALRFANQLFDPIWNANYVDHVQITMAEDIGLGGRAGYYDGIGAARDVIQNHLLQLLALTAMEEPISFEPKQLQAEKIKVLSATKLVEPLDETTARGQYSAGWQGGERVVGLLDEEGFDPQSTTETYAAITLEVDTRRWAGVPFYLRTGKRLGRRVTEIAVVFKRAPHLPFDQTMTEELGQNALVIRVQPDEGITMRFGSKVPGSSMEVRDVNMDFSYGEAFTESSPEAYERLILDVLLGVPSLFPVNAEVELSWRILDPVLEHWAAGGKPEPYEAGTWGPASADEMLARTGREWRRP

SEQ ID NO: 42402 - protein, 195 aa, Glycine max
MECYTRPNRSDIHLSAEEEATIEAKTREYFDGVAPQRHTKPQRSDYSAQYVDAFSNAHHSSLTIPELTQFQLLQNDPQEKKLVYNGSQVPEEFVETEYYQDLNSVDKHHHTTGTGFIKVEKNGNDFHIEPDNDTGCHHSCKGNPATNDWVPAPSTEVGFNSGKPNRSDNLEMEEWLHEDINISASFQIVWIPCVV

SEQ ID NO: 42403 - protein, 467 aa, Mycobacterium tuberculosis CDC1551
MQTHPAKDVSVPIATINPATGETVKTFTAATDDEVDAAIARAHRRFADYRQTSFAQRARWANATADLLEAEADQAAAMMTLEMGKTLAAAKAEALKCAKGFRYYAENAEALLADEPADAAKVGASAAYGRYQPLGVILAVMPWNFPLWQAVRFAAPALMAGNVGLLKHASNVPQCALYLADVIARGGFPDGCFQTLLVSSGAVEAILRDPRVAAATLTGSEPAGQSVGAIAGNEIKPTVLELGGSDPFIVMPSADLDAAVSTAVTGRVQNNGQSCIAAKRFIVHADIYDDFVDKFVARMAALRVGDPTDPDTDVGPLATEQGRNEVAKQVEDAAAAGAVIRCGGKRLDRPGWFYPPTVITDISKDMALYTEEVFGPVASVFRAANIDEAVEIANATTFGLGSNAWTRDETEQRRFIDDIVAGQVFINGMTVSYPELPFGGVKRSGYGRELSAHGIREFCNIKTVWIA

SEQ ID NO: 42404 - protein, 200 aa, Xanthobacter autotrophicus Py2
MTNVTLIDNYDSFTYNLVHYLGELGANVTVHRNDKVTIEEVLAEKPDAIVLSPGPCTPNEAGICLDLIAKAGESVPIFGVCLGHQAIGQVFGGDVVRAPTPMHGKLSEILHEGKSVFRGLNHSFQATRYHSLVVERDTLPDALEVTAHTADGLIMGLAHKSLPIHGVQFHPESIASENGHALIRNFLEIAAAFNAQKAKG

SEQ ID NO: 42405 - protein, 152 aa, Glycine max
  misc_feature (44)..(44): Xaa can be any naturally occurring amino acid
  misc_feature (52)..(60): Xaa can be any naturally occurring amino acid
  misc_feature (78)..(78): Xaa can be any naturally occurring amino acid
  misc_feature (122)..(122): Xaa can be any naturally occurring amino acid
KYTLQHIVSPLEGNSNLFCAERFGIQFVGMNSLWVKQSGFTPAXSFKDLGMXXXXXXXXXALRKMIRPVVGVRCAHSXAHDTYSRSISAIVAHSSGNHSSIVFLHGNKMSPAQVIQPVSIGXLVVSINSAFSVCIRLIRAITSESTIYRRIR

SEQ ID NO: 42406 - protein, 188 aa, Burkholderia thailandensis E264
MMSTSSDAQLDPVEFIHSRIRTVPNWPQPGVMFRDITPLLQSAKAMRVLVDLFVERYVDAKLDYIAGLDARGFIIAPIVAYELSVGFVPIRKVGKLPYKTQRESYALEYGTATVEIHEDACKPGDRVVIVDDLIATGGTMMAGKNLLDRLGAVVVEGAAIVDLPDLGGSALLRGAGLSLYTVTEFAGH

SEQ ID NO: 42407 - protein, 123 aa, Glycine max
MRLQAWQKLGAMPPEDAMQKYIDIVTEIYPTWLDGSSLRNKSGDSGGHGSEAKGPMGPVFSTFVYEEEYGSDSQMEAIHGFAREGDMANLLKCIENGVSMNLRDSEGRTPLHWAVDRGHLNVT

SEQ ID NO: 42408 - protein, 299 aa, Campylobacter upsaliensis RM3195
MKHFLSLKNFSKEEILALVNHAKVLKQKPEKLLIDKTLAMIFEKNSTRTRMAFELAITELGGKALFLNANDLQLSRAEPLKDTARVIGSMVDFVMLRVNRHASLEEFAKYSKAPVINALSDLYHPTQILGDLLTMQEYQKEGQIAFVGDSNNMCNSWLIAASILGYELSIALPKNYHIRPEILEFAKENAKKSGAKITLTNDKFEAIKDKEVVITDTWISMGEEEQKEQKIKDFKGFIIDKEAMSVAKKDAILLHCLPAYRGYEVSEELFEAHNEVIFEEARNRLFVVKALLCFLEREK

SEQ ID NO: 42409 - protein, 186 aa, Campylobacter upsaliensis RM3195
MEIKISKIANLPSKWGQFQIQSFKEGEKEHLCIFKGKPSDILNLRIHSECLTGDGLGSLKCDCGEQLEFALKYIEQNGGMVIYLRQEGRNIGLFNKVNAYALQDEGLNTIEANEHLGFKPDERTYEVVDFILNYYQISQINLITNNPNKLDFLKTKLIKRIPILIKSNEFNDAYLKIKQDSMGHLK

SEQ ID NO: 42410 - protein, 158 aa, Marinobacter sp. ELB17
MAEVQVIEGDFIHCSGRYALVVGRFNGFVVESLVDGALDTLTRHGIADEDIVVIRVPGAYEMPLAVKRVAETGNYDAIIALGAVIRGGTPHFEYVAGEAASGLGAVSLETDIPVAFGVLTVDSIEQAIERSGTKAGNKGAEAAITALEMVSLFKKLGE

SEQ ID NO: 42411 - protein, 371 aa, Marinobacter sp. ELB17
MALNTIEDIVEDIRQGKMVILMDDEDRENEGDLVMAAEHCEAEHINFMARFGRGLICMPMTRDRCRQLGLSLMVNQNASGFGTKFTASIEAAEGVTTGISAADRARTVQAAVGRDAQASDLVQPGHIFPLMSDAGGVLSRAGHTEACCDLAALAGCEPAGVICEIMKDDGSMARREDLEAFAAEHNLKIGTIADLIHYRTTNERTVECIEQNELDTEYGLFKLHTYRDSIHGTIHLALTMGDISPEQSVHVRVHITDTLRDLLGARRRDSRSWPLHRALQKVAAEKLGVVVLLNGAEDSYNLEDRIQEFYEHGRSGAGKDSSGVYFTVGTGSQILRDIGVGKMRLLSPPMKFSAISGFDLEVVEYVPYIPE

SEQ ID NO: 42412 - protein, 139 aa, Desulfovibrio desulfuricans G20
MAERTFAIIKPDATRRNLEGPILSVIQQNGLRVVAMKKMRLTREQAEGFYHVHKERPFFASLTDFMTSGPIVAMVLEGDNAVARWRELMGATNPENAAEGTIRRQFAEGLEANSVHGSDAAETAAFEMGYFFNAMEITG

SEQ ID NO: 42413 - protein, 267 aa, Desulfovibrio desulfuricans G20
MKNTVLGCIGCGNMGGAIMRGLAGVEGLQLAGFNRSAPKVEALRDEIGLEPAPDAVALARRADIILLGVKPDQICDVIGQVRPVLDAGKVLVSIAAGVSLEAMRSAAQGAAPVVRVMPNTPAMVGRGIYGMCLDDPALSAEAATAVRNLFAAIGKVIVLPEQKFEAFTAVAGCGPAYVFHMMEAVIEAAVTVGFTRQQATEMVTELFSGSCALAEQTGIHPSLLREMVTSPAGTTIAGTNHLDRTAVRGHIIDAVLAAYEKGLAMRR

SEQ ID NO: 42414 - protein, 260 aa, Burkholderia thailandensis E264
MFTRLREDVATIRARDPAARSAWEVLTCYPGLHALVFHRIAHACWRSDWRWLGRFVSQVGRFLTGIEIHPGATLGRRVFIDHGMGVVIGETAVVGDDCTIYQGVTLGGTSLTRGAKRHPTLECGVIVGAGAKVLGGFTVGAGAKIGSNAVVVKPVPAGGTAVGNPARVVMAADAKRTPERAAFCAYGITPNADDPMSLAIHGLIDHAAKEAQRVDEIVVALERLGAHLDALQGSDGARLDLRRLSAAFEGRALDGKSAER

SEQ ID NO: 42415 - protein, 364 aa, Clostridium perfringens ATCC 13124
MNEQNHGLGIIALESCTELGNAIDKLIQEKRNCEESFLIKTDEIRFSNGEGKVKIPQSVRGRDIYILCDIGNYSCTYKMFGFENHKGPDEHFQDIKRTVSAIRGKARRITVIMPLLYESRQHRRKGRESLDCALALQELERLGVDEVLTFDVHDPNVQNAIPLMSFENFYPTYDIVKSLIHNEKDLELDKEKLLVISPDTGAMDRAIYYSSVLGVDVGLFYKRRDHSRIVNGKNPIVKHEYMGRDVDGKDVLIVDDMIASGESVLDIAKELKGRNARNVYVATTFSFFTEGLEKFNKFFNDGIIKSVYSTNLTYIPEELKAAPWFKAVDLSDFIARIINRLNYDKSVASYMDATHIIQRLLDEK

SEQ ID NO: 42416 - protein, 326 aa, Capsicum annuum
MGPFALALDTKNSFVASSSASDASGRKMDSLQMLPKKFFASINNEEEKPFDFLRILFEGVIAGGTAGVVVETALYPIDTIKTRLQAARGGGQIVLKGLYSGLAGNLAGVLPASAIFVGVYEPAKQKLLKMFPENLSAVAHLSAGALGGIAASFVRVPTEVIKQRMQTRQFASPPDAVRLIVSKEGFKGLYAGYRSFLLRDLPFDAIQFCIYEQLRIGYKLAAKRELNDPENAVIGAFAGALTGAITTPLDVIKTRLMIQGSANQYKGIVDCVKTIVAEEGPPALLKGIGPRVLWIGIGGSIFFGVLERTKRFLAQNLPDNAASKQV

SEQ ID NO: 42417 - protein, 350 aa, Triticum aestivum
MERRGLLKAALLASCLLVVCSGRVPTVIQQPSTTIYNSTLAKTLVEYAAAIYTADLTQLFTWTCDRCGDLIEGFEMMDIIVDVENCLEAYVGFASDINAVVVVFRGTQENSIQNWIEDLLWKQLDLDYPGMPEAMVHRGFYSAYHNTTIRDGIVSGIQKTQKLHGDVPIMVTGHSMGAAMASFCALDLVVNYGLDDVKLMTFGQPRVGNAAFASYFKRYLPHAIRVTNANDIVPHLPPYFSFFPQKTYHHFPREVWVHDVGLGSLVYTVEQICDDSGEDPACSRSVSGNSIQDHITYLGVSMHAEAWSSCRIVMDYAELRYKMDLHGNVVLSKQQQQSGLSNERRRHSAQ

SEQ ID NO: 42418 - protein, 563 aa, Physcomitrella patens
  misc_feature (265)..(265): Xaa can be any naturally occurring amino acid
MMAVALPGQLNLDETPTWGSRSVDVYEKIEHIGEGTYGQVYMAKDKSTGEVVALKKVRMDNEKEGFPITAIREIKILKKLQHANVIKLKEIVTSKGPEKEDNIKPGDASKFKGSIYMVFEYMDHDLTGLADRPGMRFSIPQIKCYMKQLLTGLHYCHVNQVLHRDIKGSNLLIDNNGILKLADFGLARSFSNDQNGQPLTNRVITLWYRPPELLLGSTKYTPAVDMWSVGCIFAELLNGKPILPGRNESEQFQKICELCGSPDEXNWPRVSQLPYYNQFKPERLMKRRVKDVFKHFDRHALELLERMLTLDPDHRISAKDALDAEYFWVEPFPCQPSSLPKYEASHEYQTKKKRQQQRQQQEEQAKRMKVLHHPAPHTRLPPIQQQPLRPGPHQPGHNLGPPIHANGMANQHNNYNRGQGASNQGRAPGGGRPPHGGPNQNGGYGGPNRGGPGGAYGGPAQPGGFAAPNMGHQGGRGGAYGGPAGGVYPAGPYGGGRGPPVGGRGQQFGGMPGGPQPPAYGGQHYMQQPTAQYVDIDGAYARASHSGFQPPSPHRPDYRQQQR

SEQ ID NO: 42419 - protein, 335 aa, Ehrlichia chaffeensis str. Arkansas
MKIGINGLGRIGRCLIRAIYENELLYKHKIELSALNGSTSPETHAHLIQYDSVHGKFPHNVTSEEGYIIINDKKIPLSTEKEPKSIPWEKHNVDIVLECTGKFNKKSLAEQHINSTVKKVLVSAPMQDSDATIVYGVNNEMLKKEHNIISAGSCTTNCIAPILKIMNDTIGINNGFMTTIHSYTNDQNLVDNNHKDVRRARACMMSIIPTTTGATKTIDLIIPELKGKLNGTAVRVPTANVSMVDLVFNSIKSTTANEINDIIKNSSQNSKVINITDKKLVSIDFCHSTYSSIVDADETYVTNNNLCRIAAWYDNEWAFAMRMLDIVLLLSENHI

SEQ ID NO: 42420 - protein, 326 aa, Nicotiana benthamiana
MGPFALALDTKNSFAASSSASDASGRKMDNLQMVPKKFFASVNSGEEKPFDFLRILFEGVIAGGTAGVVVETALYPIDTIKTRLQAARGGGQIALKGLYSGLAGNLAGVLPASAIFVGVYEPAKQKLLKMLPENLSAVAHLTAGALGGLAASFVRVPTEVIKQRMQTRQFASAPDAVRLIVSKEGFKGLYAGYGSFLLRDLPFDAIQFCIYEQLRIGYKLAAKRDLNDPENAVIGAFAGALTGAITTPLDVIKTRLMVQGSANQYKGIIDCVRTIVTEEGAPALLKGIGPRVLWIGIGGSIFFGVLERTKRYLAQNRPDNAASKQD

SEQ ID NO: 42421 - protein, 261 aa, Nocardia farcinica IFM 10152
MARKPLIAGNWKMNLNHLEAIALVQKIAFALPEKYFEKVDVAVIPPFVDIRSVQTLVEGDKLLLTYGAQDVSVHESGAYTGEISASMLAKLGCTFVVVGHSERRQYHHEDDATVLGKAKKALEHGLTPIVCIGEGLNVREAGTHVEYNLEQLRGSLKGLSAEQIAKVVIAYEPVWAIGTGKVASAADAQEVCGAIRAELAELAGPEVAAQVRVLYGGSVNAKNVGELVAQPDVDGALVGGASLKGDEFATLSAIAAGGPLP

SEQ ID NO: 42422 - protein, 410 aa, Nocardia farcinica IFM 10152
MAVKTLQDLLNEGVEGRGVLVRSDLNVPLDDNGQITDPGRIIASIPTLKALVEAGAKVVVTAHLGRPKGEPDPKFSLAPVAAKLAELLGRNVQLAGDVVGYDALSRSEGLTDGDVLLLENVRFDPRETSKDEAERGKLAAALVELVGEDGAFVSDGFGVVHRKQASVYDVAKLLPHYAGTLVAAEVDVLAKLTDNTERPYAVVLGGSKVSDKLAVIEALAPKVDTLVIGGGMCFTFLAAQGLSVGSSLLQEEMIDTCKGLLERYADVIHLPRDVVVADSFSADAESKCVPANEIPDGWMGLDIGAESVDRFAALLTEAKTVFWNGPMGVFEFEKFAAGTRGVAEAIVAATGKGAFTVVGGGDSAAAVRALGLPEDGFSHISTGGGASLEYLEGKELPGISVLEDTAPEGS

SEQ ID NO: 42423 - protein, 127 aa, Zea mays
  misc_feature (20)..(20): Xaa can be any naturally occurring amino acid
  misc_feature (47)..(47): Xaa can be any naturally occurring amino acid
  misc_feature (80)..(80): Xaa can be any naturally occurring amino acid
MEPASNPKADPLIDAEMTMXILDIIQEGANYNEIKKGASEPTNTLNXGRISEIVEMVADTEPLEILLHLPLLSEDKNVPXVFGPSKQALGRASGVTRPDIACSKTSNEGKQLKQQIQGLKDSIDKLL

SEQ ID NO: 42424 - protein, 268 aa, Glycine max
  misc_feature (93)..(93): Xaa can be any naturally occurring amino acid
  misc_feature (100)..(100): Xaa can be any naturally occurring amino acid
  misc_feature (121)..(121): Xaa can be any naturally occurring amino acid
  misc_feature (134)..(134): Xaa can be any naturally occurring amino acid
  misc_feature (147)..(147): Xaa can be any naturally occurring amino acid
MEVELKELYADLQSLSQSLPDPSHHDLLRKIQLRVGDLAKLAEAAPVRRSKVEDMSAEVVDSNPYSRLMALQRMGIVDNYERIRDFSVAIVVXLISFTTXCCCSIIFETCMLFSFSYLNIXIIIYLYYQWHKLXISKTARHVELHVXAVTGFETFMSSLKNKSFRPNKQGSGVDLVLSCVDNYEARMAVNQACNELSQTWMESGVSEDAVSGHIQLLIPGETACFACAPPLVVASGVDERTLKREGVCAASLPTTMGVVAGLLVQNTL

SEQ ID NO: 42425 - protein, 339 aa, Nocardia farcinica IFM 10152
MTVRVGINGFGRIGRNFFRAVEAQKALGTTDIEIVAVNDLTDNATLATLLKYDSILGRLPKDVSLDGDDTIVVGDQRIKALAIKEGPAALPWGDLGVDVVVESTGIFTDATKAKGHLAAGAKKVIISAPAKGEDITIVMGVNDDKYDGSQNIISNASCTTNCLGPLAKVLNDEFGIVKGLMTTIHAYTQDQNLQDGPHKDLRRARAAAVNIVPTSTGAAKAIGLVLPELNGKLDGYSLRVPIPTGSITDLTADLAKKATVEEINAAFKAAAEGPLKGILKYSVDPIVSSDIVTDPHSSIFDAPLTKVIDDQVKVYSWYDNEWGYSNRLADLIGLVGKSL

SEQ ID NO: 42426 - protein, 495 aa, Mycobacterium tuberculosis CDC1551
MVAHLINVYRRHQFYWGSRGSWPGGAAVSVLLFGVSHRSAPVVVLEQLSIDESDQVKIIDRVLASPLVTEAMVLSTCNRVEVYAVVDAFHGGLSVIGQVLAEHSGMSMGELTKYAYVRYSEAAVEHLFAVASGLDSAVIGEQQVLGQVRRAYAVAESNRTVGRVLHELAQRALSVGKRVHSETAIDAAGASVVSVALGMAERKLGSLAGTTAVVIGAGAMGALSAVHLTRAGVGHIQVLNRSLSRAQRLARRIRESGVPAEALALDRLANVLADADVVVSCTGAVRPVVSLADVHHALAAARRDEATRPLVICDLGMPRDVDPAVARLPCVWVVDVDSVQHEPSAHAAAADVEAARHIVAAEVASYLVGQRMAEVTPTVTALRQRAAEVVEAELLRLDNRLPGLQSVQREEVARTVRRVVDKLLHAPTVRIKQLASAPGGDSYAEALRELFELDQTAVDAVATAGELPVVPSGFDAESRRGGGDMQSSPKRSPSN

SEQ ID NO: 42427 - protein, 249 aa, Legionella pneumophila str. Paris
MRQKIVAGNWKMNGQIQQVTELVSQIEELIGFDCAAQVAVMPPSIYIPKVRDCLKTGKVVVGAQNVYPKDYGAYTGELSAPMLKDFDCRYVLVGHSERRQFFHEDENFVAQKFHHVKDHGMIPILCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 42428 - protein, 256 aa, Pseudomonas fluorescens Pf-5
MHPYFSLQGRTALVTGGTRGIGKMIAKAFVEAGARVYICARDPDACQQVAEELAAFGECRGLAANLANEEGVQQLAATLGQQLDSLDLLVNNAGTTWGAPLESYPAKGWEKVMQLNVTSVFSCIQQLLPLLRRAGSAAHPARIINIGSVAGISSFGEQAYAYGPSKAALHQMSRILARELVSQHINVNVIAPGRFPSKMTQHIGNDEQALAEDVALIPMKRWGREEEMAALAISLASTAGAYMTGNIIPLDGGFSL

SEQ ID NO: 42429 - protein, 250 aa, Arabidopsis thaliana
MVKIEVGSVGDSFSVSSLKAYLSEFIATLLFVFAGVGSAVAFAKLTSDGALDPAGLVAIAIAHAFALFVGVSIAANISGGHLNPAVTLGLAIGGNITLITGFFYWIAQCLGSIVACLLLVFVTNGKSVPTHGVSAGLGAVEGVVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYEAVETREIRV

SEQ ID NO: 42430 - protein, 324 aa, Schizosaccharomyces pombe 972h-
MPPAVSSETSTIVPQQVIVHPLVLLSAVDSYNRSAKGTKRRVVGILLGQNNGDVVNVANSYAIPFEEDEKNASVWFLDHNFMESMNEMFKKINANEKLVGWYHTGPQLRPSDLEINNLLKKYIPNPVLVIIDVKPKSVGLPTNAYFAIDEIEDDGSKSSRTFVHLPSSIEAEEAEEIGVEHLLRDTRDASVGTLATRVTQQAQSLQGLGQRLTEIADYLRKVVDGQLPINHAILAELQSVFNLLPNIFSGPVVSEQALESEAQRAFNVNSNDQLMSIYISSIVRAVIALHDLLDSLAASKAMEQQDIKPTVQNGEVSANAEQKA

SEQ ID NO: 42431 - protein, 601 aa, Legionella pneumophila subsp. pneumophila str. Philadelphia 1
MNGHLLLNVFIFLAAASIMVPLASRFRLGSVIGYLTVGMLIGPFGLKLIGNAEQIMHFAEFGVVMMLFLIGLELEPIMLWKLRKLIVGLGGLQVLLTTIALSSAAVMMGYNLRASVAVSMALALSSTALVLQMLQEKNLLKTAEGETSFAVLLFQDIAVIPILVILPLLGNHHGINVAINPHTAASIAQLPKWLHAIVVAGIIGSIVLAGHYLSRYLFLIIAKTNIREVFTAFSLSLVVGITLLMETIGVSPALGAFIAGMVLANSQYKRTVEADIQPFKGLLLGLFFISVGMGINFNLLFSQMAVIIPIVLGLITIKALILFTLGKIFQLTKIQALGFALGLSQGGEFAFVLFQYSSTLKVISPEINSFFTLVVALSMLATPFLMLLYHRFMIPKLISKLPEREYDSIHEKNNIIIAGYGRFGQIIGRFLSGENIKVTVLEKNPEQVELLRKFGYTGYFGDANRLDLLKSAGAAHAQLLIVTVGNPDTNLEIVKLAKEEFPQLKIFARARNRRHAYELHKAGVHYFKRELFDSSLTMTKEILKFLGYKPEEIEKKANAFQKHDEETLIKSFDFFEEEANLINFSRQAKGELERILQNNNP

SEQ ID NO: 42432 - protein, 346 aa, Campylobacter upsaliensis RM3195
MKKLLLCMIAFFIVGASMVEAKPKVAILATGGTIAGSIDSAVATTGYTAGVVGVDVLIKAVPEIQNLAKIEGQQITNIDSSNMRDEIWLKLTQEINKLFASGVDGVVITHGTDTMEETAYFLNLTIKSDKPVVLVGAMRPSTAISADGPKNLYNAVALATDKNAKGVMVAMNDKIQSARGVVKTHTLNVDAFSSPDFGDLGYIVDGKVYFYNNVAKTDTKKAPFDVKNLKELPKVDILYTYSNDGSGVAAKALFENGTKGIVVAGSGAGSIHEAQKEVLKELLAKGLKVAVSSRVVAGRVAVSEADKKLGFISAEDLNPQKARILLMLALTKTNDPKKIQEYFLKY

SEQ ID NO: 42433 - protein, 119 aa, Brassica napus
MFDQIIISSGVQSPLPSVTNLQVDSVNFPPSVISPASSNRLFLAGAGVQGLDIQGEFVISTVIGVYLDPNAVWSLTSFGWGCKTTEELTESVNFFRHIVTGSFEKFIKVTMKLPLTGQQ

SEQ ID NO: 42434 - protein, 744 aa, Saccharomyces cerevisiae
MITNKKIKISVPEKLGLSEESFEESWETVKYAIDHIYSDDMADLSFEQVYKTIYTIVLNKKGPILYNRLKDYLIQKLALLRETIVKDNTHDYEFLGTMARLWEVQCHCFKITGDLMMYMDKVYCKPNRCMEVYDMCLDLFRIEILQKCSSSLISALISDIERIRNLGSVDSEHTSLWKVLIGMMETLHDNRDSFFLTDFEPVLISATEEYYNKAIDIELLTPIESLEKIRKLRQFESMLDSSFLNVDSHNKLKTVLENVLIWGKLSDIIEDLTHEAMVISNGKLLQEIYDLSSEEKYRVTVIESIKSYINKNAINIPFNEGNRKKGQNAITWSSEIVELYRSQHSFLESIDFGSVRLNNLTGDVSNAILGDVFSMYFSKEGALPSEYLSTYVDHCMKRTKEKDAEIVKIKQDLLDSTKLIGLLTEKDIFEKIYKKQLSRRLLQQRSLVEIEKWMVQMIKKVLGTFFTSKLEIMLRDISLSSEMYQAFQHSTINSIEYLSFAPQVLTRTSWPFQSTNPIDEGISLPPRMSQILAGFEGYYSLKYKERVLKWAHHLSVIEIGCQFNSGYYEISFSVYAGVIFLLFEDYEELTLGEIYELTHIPIDDVKSLVMSMSTIPRCKILKKSSSSGNMKFSVNYFFSSPNRKVKVPVIACPLPSQKSDNLATASSVDTYDNEIVMELSAIIVRIMKTEGKLSHQQLLERTTKRTQSRLSLTPSILKRSIQLLIEKEYIQRNADDPSYYHYLS

SEQ ID NO: 42435 - protein, 400 aa, Geobacter metallireducens GS-15
MTVARIEEAIEDIKQGKMIILVDDEDRENEGDLTMAAEMITPEAINYMAKYGRGLICLTMTSERCDYLRLPLMVSDNTSSFGTAFTVSIEAKRGVTTGISAADRAHTVLTAVADATKPEDLARPGHIFPLRARNGGVLVRAGQTEGSVDLARLAGLKPAGVICEIMNDDGTMARMPQLKKFAKEHGIKICTIADLVAYRLKHESLVRRAADVELPTEAGEFRAIAFENDVDKLEHLALVKGEISGDEPILVRVHSECMTGDVFGSLRCDCGGQLHRAMEMIEAEGKGAILYMRQEGRGIGLFNKLKAYALQDQGKDTVEANLELGFKPDMRDYGIGAQILVDLGIKNIRLMTNNPRKLIGLQGYGINIVERVPIEIPATGSNAGYLKTKREKLGHLLENI

SEQ ID NO: 42436 - protein, 278 aa, Magnaporthe grisea 70-15
MDETTPQHHKGAMLGHADGQAGPHRQTLRHHLVAALGEFVGTFLFLFFGYASHSMIATAERPTPEGLRDGYSAQATVFIALAYAMAILVTVWAMYRISGGLFNPAITLGLGLAGQLPWIRIAVLFPTQLVASICAGAVIEAMLPGPISRVNTKLAPDVSVTQGVFLEMFFTAYLLFVVLMVAAEKSKDTYIAPVAIGLAAFVALIPGAYYTGASLNPARSFGCAVAGLQFPENHWIYWVGPFLGSALGAGFYRLLKFLNYEEANPGQDSDYPLYNQRV

SEQ ID NO: 42437 - protein, 314 aa, Chlamydomonas reinhardtii
ASSGDRSWVFQSCLAHCSSSGCTRLPHAGHKQPGMPGASPVPLPLRLFRWSCEDDCKYHCMEAEHGGSPQLQRLPVEKYHGKWPFRRVAGMQELLSVLASLANLAAHAVAGMAATRSPGGVGTGGLDGALCRLPYPFLGLWTAYSALHLNAWLWSALFHCRDTRTTERLDYCSAVAVVAAGLAAAMARPLWGRTRRRRVAAVTAVAGVVAGLIAHLRYMLTVKFDYGWNMQVCVAASVATALIWLVWVWAVRHPARSRMTAFLLLAHAAMLLEVLDFPPPTASGRLLDAHAAWHWATVPLTALFYSWLQADADW

SEQ ID NO: 42438 - protein, 155 aa, Geobacter metallireducens GS-15
MPRFIEGKLDATGLKFGIIVGRFNSFIGERLLEGALDALVRNGADEATIDVARVPGAFEIPLTAKKMAQTGSYDAIICLGAVIRGSTPHFDYVAAEVSKGVAHVSLETGVPVSFGVLTTDTIEQAVERAGTKAGNKGFDAAMTAIETVRVFREFR

SEQ ID NO: 42439 - protein, 472 aa, Marinobacter sp. ELB17
MKERLNNDFQFVEVGRVDPKKVPARKRKKEFNEIYTPFTQDQAASQSHRCLECGNPYCEWKCPVHNYIPNWLKLVAEGNIMKAVELCHQTNSLPEVCGRVCPQDRLCEGDCTLNDGYGAVTIGSVEKYITDTAFALGWKPDMSKVVRTDKRVAVIGAGPAGLACADVLVRSGVTPVVFDIYPEIGGLLTFGIPEFKLEKSVMARRRKVFEEMGVEFRLSTEVGKHIQMSDLLSDFDAVFMGMGTYTSMQGDFPGENLAGVHAALPFLISNVNRRLGFEVSTEDFINMQGKRVVVLGGGDTAMDCNRTSIRQQAASVTCAYRRDEANMPGSRREVSNAREEGVNFMFNRQPVAIVGDGHVEGVKVVSTELGEPDENGRRRPEVIPGSEEIIPADAVLVAFGFRPSPAEWFGQHQVSTSDSGLVTAPEQADFSFQTSNPKVFAGGDMVRGSDLVVTAIWEGRQAAEGILDYLDI

SEQ ID NO: 42440 - protein, 502 aa, Gibberella zeae PH-1
MRNTLIFAGNSCPVLTGQICENLGMHPASAELTQFSNGETSVRILTSVREKDVFVVQSGSPSINDSIMELLIMISACKGGSANKVTAVLPYFPYSRQSKKKSHRGAITARMLANLLGVAGVKHIITVDLHASQMQGFFKCPVDNLHAEPILAKWIRHNVSNWREAVVVSKNAGGTKRVTSLADALKLNFGIVTTDRKRVSNMTASMIMRHFDHNVDRQPTPLESNRPIPYRGPPQAERAVETDVTPKRETPPPRTRIVTNSQGSPTRVDSSARVPDPNMTEPVDSNATPPAGSPDDSVNGETDYDDHKASEVTQGRLVQGRIVEDDYPSPDRSVVDGSVDDDPMTMSHASSFFVPEPQSLGGSGDAAASSDEEDNAFEEPGAEHLITLVGNVKNRTVFIVDDMIDKAGSWIAAAETVVKKGGAKRVYCMATHGVFGGDSLEQLQACECIDQIVVTNSFPIDKDRARSISKLVVLDLSFLLAEAIRRNHYGEALSPLFQHYGD

SEQ ID NO: 42441 - protein, 487 aa, Arabidopsis thaliana
MEAVISFDFQNCFIFILIFLLTFLCFFFFFKKPKDSRVNFDLPPSPPSLPIIGHVHLLLSTLTHKSLQKLSSRTQDVNISSRGVTAVDESLVFGSSSFVTAPYGDYWKFMKKLTVMKLLGPQAQEQSRDIRADDIKRFCRNLLDKARKKESVEIGKEAMNLMNNILCKMSMGRSFSEENGETEKLRGLVTESIGLMKKMFLAVLLRRQLQKLGISLFKKDIMGVSNKFDVLLEKVLVEHREKPEKDQGTVMLDVLLAAYGDENAEYKITKNHIKAFFVDLFIGATDTSVQTIQWTMAEIMNNTHILERMREEIDSVVGKSRLIQETDLPNLPYLHAVIKEALRLHPPGPLLPREFQQGCKIGGFYIPEKTTLLINAYVVMRDPNVWEDPEEFKPERFLASSRSGQEDERREQALKFLPFGSGRRGCPGSNLAYMIVGSAIGMMVQCFDWRIEGEKVNMKEAVKGTILTMAHPLKLTPVTRQPPLTWI

SEQ ID NO: 42442 - protein, 557 aa, Oryza sativa Japonica Group
MDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKISWLSLHNYYSLTDMIMLQNCTKMFKQVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 42443 - protein, 581 aa, Penicillium chrysogenum
MEEKKFEAVQTGAEAPPAYGDSSPTRGGIGQRIFDSFKRDPNHTVTGHVGADGSGFDAETAAHNTAHSPLQRRLKGRHLQMIAIGGSIGTGLFVGSGSVLATGGPASVLIAYILIGCMLYCTVHALGEMAVLFPVAGSFAHYSTRFVDPAWGFAMGWNYALQWLIVLPLEIVAASITVDYWNPGVSNAAWVTIFWVMIVSINLFGVRGYGEAEFVFSLIKVIAVIGFIILGIILNCGGGPQGGYIGARYWYDPGAFRNGFKGLCSVFVNAAFAFAGTELVGLAAAETTNPRKSLPTAVKQVFWRIALFYIVSLTLVGLLVRYDDERLISGSSSADAKASPFVIAIENAGIKALPSIMNVVIMIAVLSVGNSSVYGSSRTLAALAEQGQAPKFLAYIDRKGRPLPAIIIASILGLLSYLAASDVQTTAFEWMMAISGLSSIFTGVPCVRAHILFRRAWKKQGHSLDELAFRSQPGVIGSWVGFIFNCLVLVAQFWVGFAPIGYADMTSQEIAYKFFSVYLAAPVVLICYIGYKIMYKTKFVRTSEVDLVTGRRDLDIQHLIEQEMAEQREWPKWKKVYKFFC

SEQ ID NO: 42444 - protein, 243 aa, Oryza sativa Japonica Group
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFARERGEKVEAAARAISALETVEAGAFRDRSSEGKTTNAAAAPFFGGDSIGFVDVVLGSYLGWFRVIEKMIGVRIMDAARTPRLAAWAERFEAADAVRGVLPDDVDKVIDFLQAFLH

SEQ ID NO: 42445 - protein, 1184 aa, Magnaporthe grisea 70-15
MPNEGRTNQQGDARSKDEQRAFSTDTSKAMSSSRRSPSPLSSFAPPRRPDSRPRPPREQQQPHPPLPRDNLGRGRSIERPLEPFESRSQRPEPSNNSTAQGSAEGPRQGPRQNRRSRHRSRDRPRRPSRHRSPPRPPQEPRRGFAPDSIFDRPARSGHLDQPDTAKEKERDLPHRNTAAREPSRLASSPASTSKRQRSPGPPVADQDHSAKRPRRGPSPQADEPYHFDSRAAPDKTGPGREERPQRPFSPGRPRSRSPGYGRDFDRREKRKKKKKKNKNRRDRSRSPNRDRDEFGGPAPSGRKPLPQPGRESGGRRRSRSPLAPDRPRSFSRGGSPHSQPHGAEHPPFSPSQQVPPRGRGHNPSRDFDIPPERRHYDGRATPPPPEASRSRKKGRGREERHSRKSQAPRVSGANSVEVNMSARGSGYRGGYGPGGGYQMQAPYSQGPPTGPRRFSHSSGHATPSSFHGTPPPQSPYGGSQGWGGQQQYQSPSYAHQYPPNGGYTPNGPHNPGNFTPTGPHGQYHQSPSYAPPSGPNSQYSYPQGPARGGHRGGFRGGNAFNQVGRAGYHGNSFKSTSHNGSVHGGSVHGGSVHGGSVHGGSGHASPAATSNNGDSGIQQAHGHPNEQAKDDENPFRPSKDLQVEDNTQSGHGEDNSQPQQDQPQITVPQTERQPPSGPSNPKIKFQFKSSSKVPATIPKPEISSKFNALPPTQPKAQQQQQRQEAINKERNLPQDVPTGPASTRSRHDRGPRPPHDAPRQPSGQQPLPQPRFRMVKKTMRRPIRKEGLPTEMANSDSVYYRKPGNESVVGAGTYGKVFKAINVYTNNLVALKRIRMEGERDGFPVTAVREVKLLQSLRHINIVKLQEVMVEKNDCFMVFEYMSHDLTGLLNHPSFKLEAPQKKDLARQLFDSLDYLHRRGVLHRDIKAANILVSNDGILKLADFGLARFYAKHHQLDYTNRVITIWYRSPELLLGETRYGPAVDIWSAACVMVEILTQYAIFPGEGGEISQLDKIWAVLGTPSRSEWPGLLEMPWFELLRPAFKRPNNFAKLYQHRVTPAAFDLLEAMFRFDPAKRPSAAEILEHPYFTEEEPAPRQAVELATIEGDWHEFESKQLRRKNEAKEKEARRAARAEKEKEAAGAGGSEKKRSHDQTAVASEQSQPDAKRQNVDGRPPAQEKASDAG

SEQ ID NO: 42446 - protein, 362 aa, Neptuniibacter caesariensis
MISRRKLLVQAGLLSAGALMSGKPVAQAHKKWHMPEEGEKHLRTWMAFGASREIWGAELLPEVRQDLADIANTIVEYEPVAMLVRPHERAIAERLLDSRIELVEAGIDDLWMRDTGPIFVKDESKQKSAIDFNFNGWGNKQVHDQDALVAAKVAKSAGVPLIKTSLVLEGGCIEVDGLGTAIITESCVLNSNRNPGWSKARFEDELMPLLGLEKIIWLPGIKGMDITDGHTDFYARFIRPGVVAAGFDPDPHSFDHEVTLEHLDILRASTDARGAALKVHSLEAPSELSYPYADENYAAGYIGFYVCNGAVLLQKFGDPRADRMAKQTLQEAFPDRDILQLSIDGIAAGGGSIHCATQQEPA

SEQ ID NO: 42447 - protein, 291 aa, Bradyrhizobium sp. ORS278
MFKDNLLEGRRILVTGGGTGLGKAMAARFLQLGAEVHICGRRKIVCDETATELMDLYGGRVTSHGVDIRNAMAVEEMIEAIFQEGGLTDLINNAAGNFISRTEELSPRGFDAVANIVMHGTFYVTHAVGKRWIAAKQPGNVVSITVTWVRNGSPYVVPSAMSKSAIHAMTMSLATEWGRYGIRLNTIAPGEIPTEGMSKRIKPGDEAGARTKAMNPMGRVGTMEELQNLAVFLISGGCNWINGETIAMDGAQALAMGGNFYQLRDWSDDDWTKAKESIKAQNEKDRATRTS

SEQ ID NO: 42448 - protein, 231 aa, Nocardia farcinica IFM 10152
MAIEAVLFDFSGTLFRLEEDPSWTDELVDADGRAFDVHEKAEILRRMTAPVQQLVEFDEAGQYAWDNRDLDPALHRRAYLEVLRKSGVPTEEQAARLYGRLIDPLAWTPYPDTGTVLEFLAGHGVRTAVVSNIAFDVRPAFATRGWDALLDAVTLSYEVGAIKPDPRIFRAALDKLGVAPEAALMVGDSAVADGGASALGCRFALVDPLPTAERPDALVDALRAHGLAVPR

SEQ ID NO: 42449 - protein, 629 aa, Nocardia farcinica IFM 10152
MLTGCSAGDEPVAQPCTSTENGSAITAEPSAAATATTQNLALNPEIASGYRAGMTPVETGSYAVSTANPIATEAACAVLRDGGTAADALVTAQLVLGLVEPQASGIGGGAFLLYYDAASGGIDAYDGRETAPVAATENYLRWISDTDRTEPRPDTRASGRSIGVPGVLRMLELAHREHGKTGWRELFDPAIALADQGFAISPRLAAQIAESAPELARDEAARAYFLQPDGTGKPAGTTLTNPALAKTLSTIATDGADAFYTGVLAENIVAAVASDAGGRTPGLLSTADLAGYQVKKRTALCSAYRAHEICGMPPPSSGGSTVAATLGILENFDLAALGPQEVDRDGGTPRAEAVHLIAEAERLAYADRNKYVADPDFVPLPGNSAQSLIDRNYLKQRAGLIDPQRSMGTAQPGDLGPVPVGVGPQPPEHGTSHISVVDRYGNAAAMTTTVESAFGSFHMVDGFVLNNQLTDFAADPVAPDDAPVANRLEPGKRPRSSMAPTLVFDRAPDGGRGQLTHVTGSPGGAVIIQFVVKTLIGMLDWGLDPQQAVSAVSFGAGNSPTTGVGGEHPAIDATDNGDHDPLVRRLRELGHDVSVAPQTSGLSALRRAEPGWIGGADPRREGAVLGDIR

SEQ ID NO: 42450 - protein, 406 aa, Prochlorococcus marinus str. MIT 9301
MSGFNFDVITLFPKAFELINNLGVITKALDKNLIDLNLHDLREYGEGSYRQVDDKPYGGGAGMVLKPEPIYKAYESIRKLPKSKTLLMTPQGKVLKQKDLARWSTLDQIIIICGQYEGFDERIRCLADEEISIGDYVLSGGEIPAISIINGLTRLLPGTLGDPDSLVDESHNSSLLEYPQYTRPITFKDMKVPDILVSGNHEEIKSWRRRKSFERTLERRSDLISNENYKKSPQSKRIIKENNQFMKFRIGNGYDIHRLVEDRDLIIGGVKLHHPESLGLDGHSDADVLSHSIMDALLGALSLGDIGKYFPPSDEKWKNADSLFLLSKVIDLIRQDGWEINNIDSVLVAERPKIMPHIKLMKKNISEILNIDENLIGIKATTNEKLGPEGREEGISCHSVVLLEKK

SEQ ID NO: 42451 - protein, 428 aa, Rhodococcus sp. RHA1
MSIIEQVGAREILDSRGNPTVEVEVLLDDGSFARAAVPSGASTGEHEAVELRDGGDRYGGKGVEKAVEAVLSEIAPAIIGIDATEQRTVDQALLDADGTPDKSRLGANALLGASLAVARAAAESSGLDLFRYVGGPNAHVLPVPMMNILNGGAHADTGVDVQEFMVAPIGAATFKESLRWGAEVYHALKSVLKEKGLATGLGDEGGFAPDVAGTKEALDLISVAIGKTGLVLGTDVALALDVAATEFYTDGTGYKFEGSNRTAAEMSAFYAELVDAYPIVSIEDPLDEDDWDGWVALTDQIGNKVQLVGDDLFVTNPERLEEGIVKGAANALLVKVNQIGTLTETLDAVDLAHRNGYKTMMSHRSGETEDTTIADLAVAVGSGQIKTGAPARSERVAKYNQLLRIEENLGDAARYAGEVAFPRFAFEG

SEQ ID NO: 42452 - protein, 387 aa, Zea mays
  misc_feature (192)..(192): Xaa can be any naturally occurring amino acid
MPVNVVGAANQATPELRSSGKESVQGPAAHIGIGLHLGAGIDGAGVQQGDGAAASLRPAGCVGAAVALGAHARRYSYVSHDSWRHLCQSDLACYVCCVAISTMCTVPPIVLPCCLAGGDVMKKKTMATHVEVAVFPHVPNNPMYASNTSPRTPAGAVVLAAPLSYGDDATDDVDVVATNTKQQPPQYDYDAXIDATLRTMEKETIERPSPDYLSDRQAGEMLMMDRADLVEKMHRFCTSYDLAPGALHRAVSFVDRFLSAKKINRDERQIRLLGAAAVFAVAKYEDRNTMQKINVDGVAMYAGCTRSEAVDQERELLATIGFCLSGPTAYTFVDHFMRHSQEEGTATVRSLAHHLANMALQDYRCVAFLPSVVAASAILLARMVLNC

SEQ ID NO: 42453 - protein, 159 aa, Nocardia farcinica IFM 10152
MSGTGVPTFELADAKDLRLGIVASRWHTTICDTLVANAERVAKQAGVEHVTVVRCAGAMELPVVAQELARTHDAVVALGVVIRGGTPHFEYVCDAVTAGLTRVSLDAATPVANGVLTTNTEEQALDRAGLPGSAEDKGEQACAAALDAALTLRALRGQG

SEQ ID NO: 42454 - protein, 514 aa, Broussonetia papyrifera
MDTKSITLLQEALKPLPMAIFLVIPLLFLLGHILRSRGRLPYPPGPKGLPIIGSMSMMDQLTHRGLAALAKQYGGIFHLKMGYLHMVAISSPETARQVLQLQDNIFSNRPANIAIRYLTYDRADMAFAHYGPFWRQMRKLCVMKLFSRKRAASWESVRGEVEKTVLSVAGSTGTAVNVGELVFKTTMDIIYRAAFGASNKEGQDEFISILQEFSKLFGAFNMADFIPWLTWVDPQGLNGRLKRARKALDAFIDKIIDEHVVKKNEAAETDMVDDLLAFYSNEEAKVNDAEDLHNAIRLTRDNIKAIIMDVMFGGTETVASAIEWAMTEMMRCPEDLKKVQQELADVVGLDRRLEESDFEKLTYLRCAIKETLRLHPPIPLLLHETAEDAAVAGYHIPKGSRVMINAWAIGRDKNSWADPDSFKPARFLRDGVPDFKGSNFEFIPFGSGRRSCPGMQLGLYALELTVGHLLHCFTWNLPDGMKPSELDMNDVFGLTAPRATRLVAIPTKRVVCTI

SEQ ID NO: 42455 - protein, 307 aa, Oryza sativa
  misc_feature (114)..(114): Xaa can be any naturally occurring amino acid
  misc_feature (126)..(126): Xaa can be any naturally occurring amino acid
AVTAALAAPCKVRNRTGGHGARVAGACARRAARLPHTVVAKQYATAASAEAAAPTLVSAAGGGGGGEVPAVAASGAQWASSWEVDDWEFADWRDVAAAEPEVTAAGKPRLVFAXPPSREEAEEATXTELRDAIDRVYFSEAPIEVVKEQDKDLSKLGADAIIPAMPGHVMQAFTLLKSSPEAQGVVASLASDKNVWDAVLKNEKVMEFYKTHQQSLVYTFPEGTASVVSPEKLADASSENSSSGEKPESSPFADFMDNARKTVIDIVNNITNFFQDMFRKPNEAEILGGSFMALAIAVILLIMFKKA

SEQ ID NO: 42456 - protein, 420 aa, Lupinus angustifolius
MASVNQSVSVSPTASSDSVFAHLLPAPEDPILGVTVAYNKDPSPVKLNLGVGAYRTEEGKPLVLNVVRRVEQQLVNEASRNKEYLPIVGVADFNKLSARLIFGADSPAIQENRVTTVQCLSGTGSLRVGGEFLARHYHQRTIYIPQPTWGNHPKIFTLAGLSVKTYRYYAPATRGLDFEGLLEDLGSAPSGSIVLLHACAHNPTGVDPTTEQWEQIRKLLRSKALLPFFDSAYQGFASGSLDIDAQAVRLFVADGGELLLAQSYAKNMGLYGERVGALSIVSKSADVASRVESQVKLVVRPMYSNPPIHGASIVAAILRDRDLYNEWHIELKAMADRIIKMRQQLFDALQSRGTPGDWSHIIKQIGMFTFTGLNAEQVSFLTKEYHIYLTSDGRISMAGLSSKTVPHLADAIHAAVTRVV

SEQ ID NO: 42457 - protein, 306 aa, Glycine max
  misc_feature (81)..(81): Xaa can be any naturally occurring amino acid
MEIVPIPADSYNLGFIGAGKMAESIARGAVRSGVLPPSRIRTAVHSNPARRDTFESFGVTALPSNDDVFMFPLLFYFFSHXNNNRRDADFTFFFSSLSKVARDSNVVVFSTKPQPVKDVVSKLTPLLTKNKLLVSVAAGTKLKDLQEWAGNDRFIRVMPNTPAAVGQAASVMSLGGSATEEDGNIIAKLLGSIGKIWKAEEKYFDAITGLSGSGPAYVYLAIEALADGGVAAGLPRDLSLSLASQTVLGAASMVIQTGKHPGQLKDDVTSPGGTTITGIHELENGGFRGTLMNAVVAATKRSRELS

SEQ ID NO: 42458 - protein, 319 aa, Corynebacterium efficiens YS-314
MRIRSFTMTTKIILDCDPGHDDAVAMLLAHGNPDIELLGITTVGGNQTLAKVTHNARVVATIAGMDTPIYPGVTRPLVRPVEVAEDIHGDTGMEIHNYDLPEPTVGVEDTHAVDFIIDTVMNNEPGTVALVPTGPLTNIALAVRKEPRIAERVKEVVLMGGGYHVGNWTAVAEFNIKIDPEAAHIVFNESWPLTMVGLDLTHQALATPEVEEKLAALGTETGDFVVALFDAFRKNYQDAQGFDNPPVHDPCAVAYLIDPTVFTTRKAPLDVELSGALTTGMTVADFRAPAPEDCTTQVAVDLDFDKFWTMVVDAVKRIG

SEQ ID NO: 42459 - protein, 511 aa, Glycine max
MEAPSPTKPNDPTKPSNTSTTLSLEAGPAQASPLRKMFAVASIAAGIQFGWALQLSLLTPYVQLLGVPHAAASFIWLCGPISGLVVQPIVGYYSDHCTSRFGRRRPFILGGALAVAVAVFLIGYAADIGYAAGDDISKTTRPRAVGVFVIGFWILDVANNMLQGPCRAFLADLAAGDQRKTRIANGFFSFFMAVGNVLGYAAGSYKGLHKMFPFTETKACDVFCANLKSCFFFSILLLLFLATVALLYVKDKQVEARALDDATQPSCFFQLFGALKELKRPMWMLMLVTAVNWVGWFPYFLFDTDWMGREVYGGQVGEDAYANGVRVGSLGLMVNAVVLGFMSLAVEPLGKMVGGVKRLWAIVNFILAIGFGMTVVITKVAEHQRKMNPAAVGHPSEGVVVGSMVFFGVLGVPLAITFSVPFALASIYCSASGAGQGLSLGVLNLAIVVPQMVVSTLSGPWDALFGGGNLPAFMVGAAAAALSAIMAIVLLPTPKPADEAKASSMMAGGFH

SEQ ID NO: 42460 - protein, 384 aa, Oryza sativa Japonica Group
MDGKKPYVIAIIIQVIYTGLYVVSKAAFDQGMNTFVFIFYRQAAATLLLLPLAIILERRNAPAMSLRLFTKLFMYALLGNTITMNMYNVSLKYTSATVASATSNSVPVVTFFLAVLLRLEVIRLRTLSGVAKAAGVALCLAGVLVIALYAGPAISPLNHHRALSGGVHGAESSVGTGTRARWMKGTFLMLLSNTTWSLWIVLQASLLKEYPNKLLATLIQCALSTLQSLLLAAAVVRADPAAWRLRLDAGLLAVAYTGFVVTGVSFYLQAWCIEKKGPVFLAMSNPLCFVFTIFCSSFFLAEIVHLGSIVGGVLLVAGLYSVLWGKSKEHNINMQLTLAAAASTEQVKQRQEEDHKMEIAGGDEQEEIKQQQQGKMAASPEQQV

SEQ ID NO: 42461 - protein, 418 aa, Zea mays
MAAAAATPPIPAPNPTDVWVGGSWTVDCSCGVTFDDGEEMISYEQFWRYTRLADPTMEATLLQRVRIFTTADPSSNNLEVVILYDFKCDTIWTEKLYFSSDAAFLGYSLILTILRTSSLRDEASRVMVAAPILAFVTTHIMYLNFYELDKGRRKDLNILKQAFISYQLVASASTMHISLSAEFDYSVGPTILCPWMRFFPLEFSGTTVMLCFLEKMSFISVGLLNKCHFHTTLDLTTYHKNGQSGLNQQPYLSYQAMTQLLKGINSYRSSLKVPALSENKNTACLAEQLARQFKGHECTNTFLDATIFAFWTKTSVDIEPKRIRLKSSSYTSNTMLDTVTAATVQMISSASGTKASGSDIGALIEVVTLLYGSKHATKRRLDMLEKKALECSEPTVPSSKQVFDEMSARAWQVFEMAS

SEQ ID NO: 42462 - protein, 325 aa, Arabidopsis thaliana
MISKWCKKNGLETKSQYHPNLVNEDETVTRSDREIFNSLLCKVSSSNLQDQKSAAKELRLLTRKGTEFRALFGESPDEITRLVNPLLHGSNPDEKLQEDVVTTLLNISIHDDSNKKLVCENPNVIPLLIDALRRGTVATRSNAAAAIFTLSALDSNKVLIGKSGILKPLIDLLEEGNPLAIKDVAAAIFTLCIAHENRSRAVRDGAVRVLGKKISNGLYVDELLAILAMLVTHWKAVEELGELGGVSWLLKITRESECKRNKENAIVILHTICFSDRTKWKEIKEEENAHGTITKLSREGTSRAQRKANGILDRLRKAMNLTHTA

SEQ ID NO: 42463 - protein, 212 aa, Pseudomonas putida
MSLKLGDIAPDFEQDSSEGKIRFHEWLGNSWGVLFSHPADFTPVCTTELGLTAKLKDDFAKRGVKAIALSVDPVDSHHRWIDDINETQNTVVNFPIIADADRKVSDLYDLIHPNASDTLTVRSLFVIDPNKKVRLTITYPASTGRNFNEILRVIDSLQLTDNHKVATPGNWQDGDDVVIVPSLKDEEEIRQRFPKGYRAVKPYLRLTPQPNR

SEQ ID NO: 42464 - protein, 752 aa, Geobacter metallireducens GS-15
MSKKQDALEYHSSGRKGKIEVVASKPCLTQRDLSLAYSPGVAEPCLEIEKNPEDAYKYTAKGNLVAVVSNGTAVLGLGNIGALAGKPVMEGKGVLFKRFADIDVFDIELNTENPDEVIKACQLLEPTFGGINLEDIKAPECFYIEEELKKTMNIPVFHDDQHGTAIISAAALTNALEIIDKKIEDIRIVVNGAGASAIACANLAISLGVKKENLVMCDTKGVIYKGRTEGMNKYKERFAVDTPLRTLEEAATGADVLYGLSSKGAFTPEIVRKLAKNPIIFAMANPDPEISPEEAHAVRGDVLIATGRSDYPNQVNNVLGFPFIFRGALDVRATTINEEMKKAAVFALAELAREECPDSVCRAYGNVKFSFGRDYIIPKPFDPRALLRVAPAVAKAAMESGVARQPIEDMEKYVEHLESLQGKAKEALRMIINKAKADPRKLVFPEGDNEKILRATQILIEEEIAKPILIGNQDKIREKMAELGLDFNGSVQIIDPATFERSEEYAQELFSLRQRKGLTLTEARRIMTRKSRTHFGCMMVHMGDADCLLSGIDTHYPETIRPALEVIGRQPGLSSVHGLYMMVFKKGIYFMADTTVCIEPTPEELAETAILAAEKVRMLDIEPTIAMLSFSNFGSVNHPQAQKVRRAVEIVKQKAPDLIVDGEMQSDTAVVSEMLQKSFSFASLKEAANVLIFPDLNSGNICYKLLHHLGGAEAIGPILMGMQKPVHVLQRGDDVSDIVNMAALAVVDAQNS

SEQ ID NO: 42465 - protein, 421 aa, Marinobacter sp. ELB17
MSQDLKEAALEYHAKPRPGKLSVEISKPTKTARDLALAYSPGVAEPVREIARDPENAYKYTMKGNLVAVISDGSAILGLGNLGPLASKPVMEGKGVLFKRFAGIDVFDIEVNSESPQAFIETVERIADTFGGINLEDIKAPECFEIERALIEKCSIPVFHDDQHGTAIVTAAGMLNALELQGKKIEEATIVCLGAGAAAIACMKLLISCGVRSENICMVDRKGVIHSGRDDLNQYKAMFANDTDKRTLDDAIDGADVFVGLSGPDLLSAEQLKKMAPNPVVFACSNPDPEIDPAIANAVRDDLIMATGRSDYPNQVNNVLGFPFIFRGALDVRATVINEEMKIAAVNAIRELAKEPVPQEICEAYGADSFEFGRNYIIPKPMDVRLLEVVPAAVARAAVDTGVARNPYPAHYPLKSMDDII

SEQ ID NO: 42466 - protein, 420 aa, Burkholderia thailandensis E264
MSLTPVNPRLDTLQPYPFEKLRALFAGVTPSAHLPPISFGIGEPKHATPALIRDAAAAALDGLASYPATAGTDALREALARWLERRYGLPAIDATTQVLAASGSREALFSLAQAVIDSSPRGNRDKQGGECQNGERPIVLCPNPFYQIYEGAALLAGAEPYFVNSDPARNFAPDYSVVPADVWARTQLVYVCSPGNPTGAVLTLDDWRKLFALSDEHGFVIASDECYSEIYFDEAKPPLGGLEAAHKLGRGFERLVMLSSLSKRSNVPGMRSGFVAGDAALLKRFLLYRTYHGAALSPVWQKASVAAWGDEAHVRENRALYAQKFATVTPMLADVVDVRLPDAAFYLWANVARTGLSDTEFARRLYADYNVTVLPGSYLARDAHGANPGRDFVRIALVAGTAECAEGAQRIVDFCRGLAR

SEQ ID NO: 42467 - protein, 462 aa, Escherichia coli
MTANSPLQRIGQEKGIAMGSQELQRKLGFWAVLAIAVGTTVGSGIFVSVGEVAKAAGTAWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 42468 - protein, 380 aa, Oryza sativa
MAAAAGLSPRLVVTPGRRSHSHGRRRMCCAAAAAAQGERKTTVRSKEGDAVELCRVVNGMWQVSGPSWGRYETPAAVDAMLRYADGGLSTFDMADIYGPAEDLYGLFINRVRRERPPELLEEIKGLTKWVPPPVKMTRSYVEDNINRSRKRMDVSALDMLQFHWWDYANPGYLDALKHITDLKEEGSKIKTVALTNFDTDRLQIILENGIPIVSNQVQHSIVDMRPQRRMAELCQLTGVKLITYGTVMGGLLSEKFLDTNVSIPFAGPPLNTPSLQKYKRMVDAWGGWSLFQALLQTLKKVSLKHGVSISTVAVRYILNQTSVAGSMVGVRLGLSEHIKDTNAIFSLELDEEDMNSITEASNKGRNLMDIIGDCGDEYRA

SEQ ID NO: 42469 - protein, 628 aa, Oryza sativa
MAAAAAEIVGSAAARMAAPAVRPAPPAAAAAAAPPQPRRAVAARSLRTSTSDRVAADLALGSNGSLSAQNIAENTADATSQVVSANSRRKTKIVCTIGPSTNTREMIWKLAETGMNVARMNMSHGDHQSHQKVIDLVKEYNAKNTDGNVIAIMLDTKQMSCDDRTSVMQGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQAAPELSRKDQQMKHVGHELPYLNPTNKPRIGGDANQNLKASEAQCCQSWARV

SEQ ID NO: 42470 - protein, 414 aa, Nocardia farcinica IFM 10152
MTRFDTIERAVADIAAGKAVVVVDDEDRENEGDLIFAAEKATPELVAFMIRYTSGYICVPLTGEDCDRLGLPPMYATNQDKHGTAYTVSVDAREGITTGISAADRATTMRLLADADAKADDLTRPGHVVPLRAKDGGVLRRPGHTEAAVDLARMAGLRPAGVICEIVSQKDEGHMARTEELRVFADDHDLALISIADMIAWRRKHEKQVVRVAEARIPTAHGAFTAVGYQSIYDDVEHVALVRGDIGDGEDVLVRVHSECLTGDVFGSLRCDCGPQLDAALEMVDQEGRGVVLYMRGHEGRGIGLMHKLQAYQLQDSGRDTVDANLDLGLPADARDYGTGAQILVDLGIRSMRLLTNNPAKRVGLDGYGLTITERVPMPLRANAENLRYLRTKRDRMGHDLVGLDDLDLGETAQ

SEQ ID NO: 42471 - protein, 202 aa, Zea mays
  misc_feature (128)..(128): Xaa can be any naturally occurring amino acid
  misc_feature (168)..(168): Xaa can be any naturally occurring amino acid
  misc_feature (188)..(188): Xaa can be any naturally occurring amino acid
TQPGCDNARQAASCVTNRFFGPAHASSHGRERIGPPPPLCPSVHNLVARVSYSGKVKQIVGSTLRDLANDSMELVTNFESDKSPAEFAKFYKADELLGGHVIMLGANPSSQAAALEALRAYPGGLQKXLGIDEELVELLGHYSPIPVTYAGGVSTMDDLERIKKAGKXVDVTIGSALDIFGGDLPYKXVVLWHRKQSMVGQV

SEQ ID NO: 42472 - protein, 227 aa, Nocardia farcinica IFM 10152
MSTFSRPAEPMIAPSILSADFAHLADEARRVEGSDWLHVDVMDAHFVPNLTLGLPVVQSLLKATDIPLDCHLMIEDPGRWAPPYAEAGAHNVTFHAEATDDPVAVARDIRAAGAKAGLSVKPNTPIEPYLEILKHFDTLLVMSVEPGFGGQSFIPHVLDKARTVRRLVDSGELRLLVEIDGGINADTIEQAAEAGIDCFVAGSAVYNTDDPGATVAKLRRQAAAARG

SEQ ID NO: 42473 - protein, 309 aa, Corynebacterium efficiens YS-314
MTDIPGSPGSIVVVGSINADLTTTVHRHPHPGETLLGGGGEISAGGKGANQAVAAAQLGAEVHMVGAVGSDTMADSALVHMRASGADMSAVHTVDGPTGLAVITVADDGENTIIVVPGANASVDADYVDRHARLIEQAGIVLLQGEIPADGFNRAVDLAQGRVVINLAPVVPVGHEQLRQADPLLVNEHEGALVLEMLGAPTTETDPSTLVAVLLGQGFPTVVMTLGADGALVGDAEGLTAIPTPTVEAVDTTGSGDAFAGALVAKLADGHSLVEAARFAARVGAFAATRRGAQASYPTLVDDLPTVTA

SEQ ID NO: 42474 - protein, 446 aa, Corynebacterium efficiens YS-314
MFMGAGKTISLAGPSVILVYAIIGFMLFFVMRAMGELLLSNLNYKSLRDAVSDILGPGAGFVTGWTYWFCWIVTGMADLVAITGYVQYWWSGVPLWLPGAGAILLLFVLNLAAVRLFGEMEFWFAIIKILAIVALIFTGLVMVVSHFESPDGSVAQFSNLVDHGGFFPNGITGFLAGFQIAIFAFVGIELAGTAAAETEDPVRTLPRAINSIPVRIVVFYVLSLAVIMMVIPWDRVHTDSSPFVQMFALAGLPAAAGIINFVVLTSAASSANSGIFSTSRMLFGLSLEGAAPRRWAKLSANQVPARGLLFSIVCLIPGVAVMYAGSSIIEAFTLITTVSSVLFMVVWAYILVAYIVYRRRNPQLHAASVFKMPGGVAMAVVVLVFFVGMVGVLTLENDTRSALLATPVWFLILGAGWWFSGGARGAASRSQLTGPTTPVTPATTAS

SEQ ID NO: 42475 - protein, 281 aa, Arabidopsis thaliana
MAAPGSVQKGDEEWRAILSPEQFRILRQKGTEYPGTGEYVNFDKEGVYGCVGCNAPLYKSTTKFNAGCGWPAFFEGIPGAITRTTDPDGRRIEINCATCGGHLGHVFKGEGFATPTDERHCVNSVSLKFTPAASSFFFVVVVMADLVTVVKKTEEEWRAVLSPEQFRILRQKGTETPGTEEYDKFFEEGIFSCIGCKTPLYKSTTKFDAGCGWPAFFEGLPGAINRAPDPDGRRTEITCAVCDGHLGHVHKGEGYSTPTDERLCVNSVSINFNPAKPSSIT

SEQ ID NO: 42476 - protein, 352 aa, Zea mays
  misc_feature (92)..(92): Xaa can be any naturally occurring amino acid
MMGGFLSRVLLLAFGYAYPAYECYKTVELNKPQIEQLIFWCQYWILVALLTVLERFGDFTISWLPFYSEAKVLSFVLGYHKYTKNNTFASEXNGSHDIVYLWYPKTKGTTYVYGTFFKPYISQHENEIDRNLLELRARATDMVVLYFHKAASVGQNTFFDVLKYVAAQSPSRKSRLHPHQEPQQQQPQVQVELQQPQPQKQAAPVMRRGASIAARQAAMAQQSLETIPVPSSPKIKRQTSGRPGSVASTKPAAAASTPKPGGSPKKGEVKPAVDPVQTPATSADSPKSEPSAPPLSETEEVDNMAIDEVSGDAAEGAEELDPALEETPMEETIRVTRAKLRRRTATEDSAGN

SEQ ID NO: 42477 - protein, 461 aa, Parvularcula bermudensis HTCC2503
MPMPILMPALSPTMEEGTLAKWMVAEGDKISSGDVIAEIETDKATMEVEAVDDGIVGKILVESGTEAVKVNQMIGVLLEEGESADDIDLEALRSSVPTDAGEDNGAAKKDAAQSSKEATSPPKESPSESQEPSADRSAPSPTSTPSGSQSSSADAKAEGERLFASPLARRIAEQEGLSLPLIEGTGPRGRIVKRDVEKALEEGQAQPDGKGAVAGAGGGLDPRLYSPETYTAIKNDGMRKTIAKRLNQSFNQEVPHFPLNIDIDLTQLLAARERINAASPEKGSEGTYKISVNDFIVKASAQALMVVPGANASFTEEAILRHHHADIGVAVAIDGGLITPIVWRAETKGLQAISEEIRDLAGRARDKKLKPEEYQGGTFAVSNLGMFGIKSFASIVNTPHGAILSVGAGEDRPVVRNGEIVVRPIMTVTLTCDHRVVDGATGAEFLAAFKRFCEEPASMLL

SEQ ID NO: 42478 - protein, 169 aa, Bacillus anthracis str. Ames
MKRIVTATVRNQSGVLNRITGVMTRRHFNIESISVGHTESSDISRMTIVVHVENEQQVEQLIKQLHKQIDVLKVSDITEEAMIARELALIKVATSVARAELYSLIEPFRAAVIDVGKDSIVVQVTGTQEKVEALIELLRPYGLKEIARTGVTAFTRSMKKQDKQVMLIQ

SEQ ID NO: 42479 - protein, 224 aa, Bacteroides thetaiotaomicron VPI-5482
MSIADNLKQVLAELPQGVRLVAVSKFHPNEAIEEAYQAGQRIFGESKVQEMTAKYETLPKDIEWHFIGHLQTNKIKYMIPYVEMIHGIDTYKLLAEVNKQAAKAGRIVNCLIQIHVAQEETKFGFSPEECKDMLHAGEWKELSHIRICGLMGMASNTDDVEQINREFCLLNRLFQEIKANWFADSDTFRELSMGMSHDYHEAIAAGSTLVRVGSKIFGERNYNT

SEQ ID NO: 42480 - protein, 473 aa, Parvularcula bermudensis HTCC2503
MGENTYDVVVIGGGPGGYVAAIRARQLGLSVALVEKEHLGGVCLNWGCIPTKALLRTAEIYTAMSHAAAYGLKADNIGFDLDAVVKRSRKIAGQLSSGVRYLMKKNDVTVYNGTARFVSAGDGAAVLHITDNEGGGEEIRGTHTIIATGARARTVPQAGLAPDGDKVWTAKEAMVPDQFPDRLLVVGSGAIGIEFASFYNALGAEVTVVERLDRILPVEDEEVSAFARKSFEGRGMRIHTGANVTGLEKSDAAVTVSLQTKDGDTVTETVDRVIVAIGIIGNTEDIGLEDIGVEVANGHIVVDPYLRTSVEGVYAIGDVVGPPWLAHKASHEGIICVEALAGEEEVHALDVSAIPGCTYCQPQIASIGLTEAKAREEGYDIKVGKFPFQGNGKAIALGEPEGFVKTIFDSVTGELLGAHLVGAEVTELIQGFGIAKTLEATEQELFHTVFPHPTLSEMMHESALDAFDRVIHT

SEQ ID NO: 42481 - protein, 1419 aa, Ostreococcus tauri
MTDAYVLRSAFAVGDDPRTGNPAAVCVVHRNRPGDDDVDAFDDFFNVHSEASVRYQALATELDLSETAFAIREKPLSSDDNSNSMAEYRIRWFTPTQEIGLCGHASMATASRALEFESASRPGISFTYRDGEITIERDANDPSRFIMEMDASAPRSFEGSDVALATIRDAFESSSAFASDEDDIESSLANTEFTVRRNSIGDTFLVIQSSRSDDASACDSVARAYLRLPKPSLENIALVGGRGVCVVVPRTPAGLDIPLSASGARPEYCVRWFGPLVGIEEDPVTGSACCGVAPLLDEIAPPLEPSRDGFRFGYQHSRRGGHVWCAVTRSSGRDRVRVAGRCVSSTRRGGRLNRSRARTVETGKRCWRSGERNTPGDARARAWTRTMGCARRDGRDARGRGERFVAGRGGKGEARRRPRNESGRSRGQRGASTSEKTPNGRRAGSSYFSLSGTSRRGEIDTMPSPAVRARLKAVELEKEHLAALASKLRESQEEAAERMHAERKEAEEAKKSMSDRLQKLESDRNALQQNMAAFQAQAQALSKAKEEHSRALRKEKRAAEAAVRALEQVKEDAATAVQERDFTIANQAAILQELDDELERAERSRERAELDAAAKDKHLAKLRAQLDEAKRELEIRTKNQSSKQNDDSGGVRASHEKLLQLAGRAQEAEADATRARQAVKNLQLEVEERKAEMETLQCELEKCLQEERVERQRAEEAFCEIEIERNTLEILVEKRTLEKMALEERLEEVTQEADILRIEMKERDEMLREGAQLIEEKEGELDTAVAYVVQLQDQLEQLQASGLDENVEVAEQLKALEQKQEAMRLEKQKVVKCMQDEIAERDALLSASKDKLKLKEAEIAALQAEYRTKTTELGPLEIELQSLREKLYALKFELNEKNTRLEENDALVKQLMSAEKRQTANVRRLEFGLAERDEKLRNFNEELNNLKIESERDEKDISKRMNELRQREIALEELHRTTEARVDEIRKQYDSEVERLNAELAHSQQRINELTREIERLKSDTVSQNSQEIDALKQDLVETHAKWEAAQAEIATLCNSISELEHHAEESNSTLKAELEMTKGELQSALTDAEEQRASANEVESESRALMKEMQKTCEDMDNRIHDYQEVVTLRESELKMLKKQLHGKSNEAETYRTKAVKGTEVITTLEMALKTKVDECERIKGEIVKAQKQLAMFQQELSSSKKVQKELQESLSEFQLRFQKSEEARDELAGSLSRQEEYHEEKIKARETVHQLELENAADDIRSLKRKMTALAVALQQHVRINELDPEVALLVDELAEVTQVMPQTALPTPTMTFNEAKTKPKTYRKTPAKPKTNPSNLITPVRPDASLKANIDKLNERADQISFHDYATRQAETEGDVYATPGNENAGIRQKTAADGKRPLAPVAQPRAALSDLGNNV

SEQ ID NO: 42482 - protein, 186 aa, Bdellovibrio bacteriovorus HD100
MNTSEKTPVSFEPTPNPATMKFLLHKKVTDQGFDCPTVQEAERSPLAAKIFGFPWTSSVYVGPDFITVTKQDWVDWELLAHPLSGLIQEHLDRDEPVVVTFVEAEEDNENDSPMVRNIKSVLNREIRPVVALDGGDIVFHKYENNVLYIHMKGACSGCPSSTVTLKEGIEVRMKELFPEIVEVVSV

SEQ ID NO: 42483 - protein, 248 aa, Bacteroides fragilis YCH46
MGLLDGKTAIVTGAARGIGKAIALKFASEGANIAFTDLVIDENAQNTAKEIEAMGVKAKGYASNAANFEDTAKVVEEIHKDFGRIDILVNNAGITRDGLMMRMSEQQWDMVINVNLKSAFNFVHACTPIMMRQKAGSIINMASVVGVHGNAGQANYSASKAGMIGLAKSIAQELGSRGIRANAIAPGFIITDMTAGLSEEVKTEWAKKIPLRRGGTPEDVANIATFLASDMSSYVSGQVIQVDGGMNM

SEQ ID NO: 42484 - protein, 117 aa, Chlamydomonas reinhardtii
MAATLLNSGSIWFKLAAVSGCTAVGLGAYGSHGFKPQDPYYLEVFRRANHYHLLHSLLLAIAPSTRRPWLVGGLTLVGVTLFSGSCYTVALQQERTWAKLAPIGGMTLMAAWLALAF

SEQ ID NO: 42485 - protein, 97 aa, Datura inoxia
ATYKVKLVTPDGPVEFDCPDDVYILDRAEEEGHDLPYSCRAGSCSSCAGKVTAGTVDQSDGNYLDDDQMAEGFVLTCVAYPQSDVTIETHKEEELTG

SEQ ID NO: 42486 - protein, 334 aa, Xylella fastidiosa Dixon
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLVAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILDYIEDKVVATDFRGETCTCVFDADAGIALDPTFIKLIAWYDNEWGYSNKCLEIAKVIAAK

SEQ ID NO: 42487 - protein, 97 aa, Datura stramonium
ATYKVKLVTPDGPVEFNCPDDVYILDQAEEEGHDLPYSCRAGSCSSCAGKVTAGTVDQSDGNYLDDDQMADGFVLTCVAYPQSDVTIETHKEEELTG

SEQ ID NO: 42488 - protein, 501 aa, Burkholderia thailandensis E264
MNLAALSTQHQRQSGFLARRQFGNWIDGAAAEPRSGRYLPVVDPATEMTIAEVAASDARDVDAAVAAARRAFDSGDWPRMRPASREKLLHQLADRIERYADELAALETLETGKLVGLARAIDVLGGAEYVRYMAGWATKLEGSTLDTSIAVPAGTEYFAYTRREAVGVVGAIVPWNFPLAIALWKVATALACGCTVVLKPSEETPLTALRLGELAQEAGLPDGVLNVVTGTGADTGAALVAHPGVDKITFTGSVGVGKAIGHAAVDRMARFTLELGGKSPLIVFDDADPDVAARGAAQGIFFNQGQVCTAGSRVYVHKSLFERVVAGIAAAAESMKIGSGFDPNTQIGPLVSKRHFERVLGHIDAAKEEGATLVTGGTRALDGGYFVKPTVFVDAAPSMRIVREEVFGPVVTVTPFDTVDDAVRLANDSDFGLAASVWSQNLSRVHRVVPRLKAGIVWVNTHNMLDNNLPFGGVKQSGYGRELGRAALEQFTELKSVCIAH

SEQ ID NO: 42489 - protein, 176 aa, Triticum aestivum
  misc_feature (105)..(105): Xaa can be any naturally occurring amino acid
MAPAVMASSATTVAPFQGLKSTAGLPVSRRSCSAGLSSVSNGGRIRCMQVWPIEGIKKFETLSYLPPLSTEALLKQVDYLIRSKWVPCLEFSKVGFVFREHNSSXPGYYDGRYWTMWKLPMFGCTDATQVLNEVEEVKKEYPDAYVRVIGFDNMRQVQCVSFIAFRPPGCEESGKA

SEQ ID NO: 42490 - protein, 234 aa, Pyrococcus furiosus DSM 3638
MKVAVITGASRGIGEAIAKALAEDGYSLALGARSVDRLEKIAKELSEKHGVEVFYDYLDVSKPESVEEFARKTLAHFGDVDVVVANAGLGYFGRLEELTEEQFHEMIEVNLLGVWRTIKAFLNSLKRTGGVAIVVTSDVSARLLPYGGGYVATKWAARALVRTFQIENPDVRFFELRPGAVDTYFGGSKAGKPKEQGYLKPEEVAEAVKYLLRLPKDVRVEELMLRSIYQKPEY

SEQ ID NO: 42491 - protein, 770 aa, Marinobacter sp. ELB17
MLSTLRTIVQEVNSARDLQEALSIIVSRVQKAMNTEVCSVYLLDPATNRYVLMATEGLYRKAVGKVSLGYSEGLVGLVGSREELINLEDAPSHPRYRYFPETGEERFRSFLGVPIIHHRRLMGVLVVQQRESSRSFNEGEEAFMVTISAQLSGVIAHSEATGAIGGLSLTGEEAHDIGFDGVPGAPGVAIGTGVAVYPAADLDLVPEKATDDIEHELDLFQCAVSAVREDIERVAARLASQLRPQEQALFDVYLRMLSDEALPDEVNGKIREGNWAQGSLKQVVQQYVRNFEMMDDHYLQERAVDVRDLGRRLLSHLQEGEQASLEYPERTVLVSEEITPAMLGEVPKGQLVGLVSVKGSSHSHVAILARAMGIPTVMGLVDIPVNQLDGKELVVDGFEGQIFASPSADLRAYYQVICDEENELIRGLEALRDLPCETTDHHRVSMLVNTGLMTDVVRSLTHGAEGIGLYRTEVPFMIKDRFPSEQEQREYYREQLEAFAPNPVTMRTLDIGGDKCLTYFPIHEENPFLGWRGIRVTLDHPEIFQLQVRAMMKASEGLNNLQIMLPMISNISEVEESLHLIYRVYHEVREDGYNIHMPKVGVMIEVPAAVYQIRELADRVDFLSVGTNDLTQYLLAVDRNNPRVAPLYHSYHPAVLQALVRIAQDAHAVGKPVGVCGELAGDPGGAVLLMAMGYDSLSMNAASLPKVKSVIRSVSLEWATNLLEDILLLDSPHVIKSCVDLALRNAGFGRYMRPGKSTGKTLAEVASASA

SEQ ID NO: 42492 - protein, 284 aa, Zea mays
  misc_feature (32)..(32): Xaa can be any naturally occurring amino acid
CVRECQATGIIGENVISHCQFKEDNTSVGGSXREGERQALGLSPVKYHGKWPFLRVSVFQEPLSTALSAVNLLMHFTGWLSFFLLVNYKLPLRPQTKRTYYEYTSLWHIYAILSMNAWFWSSIFHTRDIELTEKLDYSSAVALLGYSLILSLLRAFNVKDEASRVMFAAPILAFVTTHILYLNFYELDYGWNMKVCVVMAAVQLLTWAVWAGVSRHPSRLKLWTVVFGGALVMLLELYDFPPYMGFADAHSLWHASTIPLTYLWWSFIKDDAKFRTSTLSKKAK

SEQ ID NO: 42493 - protein, 461 aa, Zea mays
MPRTTVVESSGCPPLRALTTDILGLVKVVEAHARPAGAAKVVETWGAPDASRAIVAASLADRAADPVLAVARRNGVVELLNPLNGSALAAVKTAGSAPNDSGAEGDPLAALHLFARQTSDSILGTFLACTEKGKASIRSITKENADSGSDVGPSATWDVCNGANVQFCSVDHGESYVIFGGKGIEVNLWDITSSSKTWSAKSPRANSLGIFTRPWFTAGTFLCKNDHRKIVACTNNHQVRLYDTALQRRPAVSVDFRESPIKAVAADPNGHDVYIGTGTGDLASFDMRTGKLLGCYIGKCSGSIRSIVRHPELPLIASCGLDSYLRIWDTNTRQLLSAVFLKQHLTTVVLDSHFSVEEPGEMKFKQLESLVEAEAEVRKKKKKKKSRPTEEDEEQVGVVDHSDNNGEMYARKEKKKKKKKKSRTIERDEEPDNDGEMCSPKRRKSVERSKCLKKSKKQQVA

SEQ ID NO: 42494 - protein, 210 aa, Triticum aestivum
TLPDWSTRTLTWTEAVKKLARVPPPEQAIYLHTTAVAPTVMASSGTSVAPFQGLKSTAGLPVSRRSNGASLGSVSNGGRIRCMQVWPIEGIKKCDTLSYLPPLSTEALLKQVDYLIRSKWVPCLEFSKVGFIFREHNASPGYYDGRNWTMWKLPMFGCTDAIQVINEVDEVKKEYPDAYVRIIGFDNMRQVQCVSFIAFKPPGCDESGKA

SEQ ID NO: 42495 - protein, 398 aa, Marinobacter sp. ELB17
MNFPVLYLRKGAERRLRAGHLWVYSNEVDIKRSPLTGFEAGVQAELRASNDKPLGTVFVNPHALICGRLISRDPTHGMTPQRLTQRMEIALELRQRLFNKPFYRWVFGDSDGLSGLVIDRFGDTVVVQISSAGMEQMKDAIVRAIQRLTQASSIVLKNDGKMRKVEGLENYVEQAHGSAPEMLQLEENGVKFEVPLAGGQKTGWFYDHRMNRARLQAYAPGKRVLDVFSYVGGWGIQAASAGATSVTCIDSSASAIESVHHNARLNGLTNVDTIEGDAFDALKALADEKQKFDIVVLDPPALIPRRRDQKAGEQAYARLNQLGLRLLERDGLLVSASCSMHLSQEKLVDIIRGSGRKIDRFVQLLEQGHQAPDHPIIPGIAETDYIKSCFVRSLTGFL

SEQ ID NO: 42496 - protein, 362 aa, Saccharomyces cerevisiae
MSRKFDLKTITDLSVLVGTGISLYYLVSRLLNDVESGPLSGKSRESKAKQSLQWEKLVKRSPALAEVTLDAYERTILSSIVTPDEINITFQDIGGLDPLISDLHESVIYPLMMPEVYSNSPLLQAPSGVLLYGPPGCGKTMLAKALAKESGANFISIRMSSIMDKWYGESNKIVDAMFSLANKLQPCIIFIDEIDSFLRERSSTDHEVTATLKAEFMTLWDGLLNNGRVMIIGATNRINDIDDAFLRRLPKRFLVSLPGSDQRYKILSVLLKDTKLDEDEFDLQLIADNTKGFSGSDLKELCREAALDAAKEYIKQKRQLIDSGTIDVNDTSSLKIRPLKTKDFTKKLRMDATSTLSSQPLD

SEQ ID NO: 42497 - protein, 177 aa, Prosthecochloris aestuarii DSM 271
MPIKSRIRTIPDYPKKGIMFRDITTLLKDPVGFRLVIDQITQHYLENGINFDMIIGMEARGFIIGGALSYTLGKGFVPIRKPGKLPGETVNQEYQLEYGTDKVEMHIDALEKGTRVLLVDDLLATGGTALAGAALIEKVGGVVADMAFIVNLPDIGGQKKLEEKGYSLFSLTEFEGD

SEQ ID NO: 42498 - protein, 280 aa, Aspergillus nidulans FGSC A4
MEVQARPPIAVTNAVSWRSEGIRYRKNEVFLDVVESLNLLVSATGNVLRSEILGAIKMKCYLSGMPELRLGLNDKVMFETTGRASRGKAVEMEDVKFHQCVRLSRFENDRTISFIPPDGEFELMSYRLNTQYMLKAKAQFKRRSTANNVEILVPVPDDADSPRFRTNIGTVHYAPEKSAIVWKIKQFGGGKEFLMRAELGLPSVKGDDELGGGMTGGFGGSMGGTMQGKAKRPINVKFEIPYFTTSGIQVRYLKITEPKVCQLSPFSFALFYIISSCLVT

SEQ ID NO: 42499 - protein, 232 aa, Burkholderia thailandensis E264
MPDLAARLASVQRRIDEAARAAGREPRAVTLLAVSKTFPADAVRAAYAAGQRAFGENYVQESIDKIDSLADLRAELEWHFIGPLQSNKTRPVAERFDWVHTIDRLKIAQRLAEQRPAHLPPLNVCVQVNISGEASKSGVAPSDAAELARAIAALPALRLRGLMAIPEPAADPEAKRAPHRALHALFEQLRADGLALDTLSMGMSDDLEAAVAEGATIVRIGTAIFGARDYAH

SEQ ID NO: 42500 - protein, 428 aa, Lentisphaera araneosa HTCC2155
MSTIIDIIAREILDSRGNPTVEVEVILEDGTVGRAAVPSGASTGEHEAIELRDGDKSRYLGKGVLKAVENIEDTIVEELVGYDVTDQAGIDKAMIDLDGTPNKSKLGANAILGVSLACAHAAANFLQIPLYRYIGGSNAKVLPVPMMNIINGGSHSDAPIAFQEFMIRPIGAKTFSEGLRMGVEVFHNLKKVLHDRKLSTAVGDEGGFAPALDGTEDALESIIKAIELAGYKAGRKEDGADVSIGLDCAASEFFVDGQYNYAKFEGEGGAILSSEEQAQYLADLVAKYPIDSIEDGMDENDWDGWKAVNNLIGDKCQLVGDDLFVTNVDYLAKGIELDCANSILIKVNQIGTLTETLDAISMANRNGWTAVVSHRSGETEDTTIADIAVAVNAGQIKTGSASRSDRIAKYNQLLRIEQELGDLAVYGG

SEQ ID NO: 42501 - protein, 311 aa, Zea mays
  misc_feature (237)..(237): Xaa can be any naturally occurring amino acid
  misc_feature (260)..(260): Xaa can be any naturally occurring amino acid
MYAAAPSSSRVAAAAAAFFIVISLSPQLLVRPFGASTTVHWAAAQELDEEDFSYRRNAGNGPARWGLIRREWATCNVGLLQSPIGLSDTLAGLADRSGRLGRSYRPAAASLVNRGHSIMVRFNSNPGGVVIDGVAYRLRQMHWHAPSEHAINGRRYALELQMVHQSDTNRYAVVSQLYRISRRRPDRTIHRLERYIRRIARRKNHEELIDEEVDPRRPVSRSTAYYKYTGSFTTPPXCTEGVTWVVAHQVNKRKISSLQXTRRVTRRQVRLLRNAVHDGTRSNRRPLQEANGRAITFYYTSPAHGRGANGD

SEQ ID NO: 42502 - protein, 121 aa, Triticum aestivum
SRRRPRSPPPSRSPPTSPPPRLLPTFRQGSGGDGGEARAAADQGGAGGGIRLEARRRLASLPGRYEALWKEVDGVKQLWKNRKELKVEDLGIATLFGVELYAWFCVGEIAGRGFTLTGYKV

SEQ ID NO: 42503 - protein, 479 aa, Prochlorococcus marinus str. MIT 9301
MTDSSFDFDLIVIGAGYGGFDAAKHAAGKGLKVAIVESSDMGGTCVNKGCVPSKALLAASGKVREIADYEHLAKFGIHASPVRFERSKIADHANNLVLNVRENLTKTLKRSGVEIILGIGRIEGNQKVGVRDKNGIDKIFTCKNIVIATGSSPFVPRGITLDNRTVFTSDDAVKLEWLPRWIAIIGSGYIGLEFADVYTALGCEVTMIEALENIMPTFDPDITKIAKKNLIQARDIDTKSNVFATKIIPGCPVKIELTDAKSKEVVETLEVDAVLVATGRSPNSNNLNLESVGIETVKGFIPIDDQMRVKNGDEIIPNIWAVGDVTGKLMLAHTAAAQGTVAVDNICGGNVGINYKSIPAATFTHPEISSVGLSEAEAEEISAKENFTLGVVKSFFKANSKALAELESDGLLKLIFNKDNGKVLGAHIFGLHAADLIQEISNAISRNQDVIQLSKEVHTHPTLSEVVEVAYKQAASQIK

SEQ ID NO: 42504 - protein, 417 aa, Prochlorococcus marinus str. MIT 9301
MELVDAPHSKCGTFGYVGSSPTAPTLMNTYSRFDISFKKGKGCWLWDKTGKKYLDAVAGIATCSLGHSDRVLRRRLSTQLRKIQHISNLYNIEEQEQLSRTLTNISCAKSVFFCNSGAEANESAIKLIKKYGNTINKGKESIILAAESSFHGRTLAALSATGQPKYQKGFEPLIQGFKFFKFNNFDSVKKLFEECENNNQKISGVLVEPIQGEGGVIPGSKIFFKSLRNICDEYNSLLILDEVQSGVGRTGKMWGYENLGIEPDGFTLAKGLGGGHAIGALLVKEKANIFYPGDHASTFGGNPFACKAALTVLEEINRRNLINNVYLRGEQLSAGFEELSKKFPNIITGKRGLGLIQGLVINKDYVDAKKITLKAFDKGLLVVPAGGNVVRIVPPLVISRREINILLDKLNLIFGEL

SEQ ID NO: 42505 - protein, 226 aa, Brassica napus
MSSQTSAAIISSAFTAAPYPDSKKPIGSIRFQQLPLSPSYCKVSSRISAMAKPNDALSVDTSLSPRVKSLKPSKTMVITDLASTLVQSGVPVIRLAAGEPDFDTPQIVAEAGMNAIRDGFTRYTLNAGITGLREAICHKLKEENGLSYAPDQILVSNGAKQSLLQAVLAVCSPGDEVIIPAPYWVSYTEQARLADATPVIIPTKISDNFLLNPKDLESKLTEKSRL

SEQ ID NO: 42506 - protein, 234 aa, Bdellovibrio bacteriovorus HD100
MGDRQWMLVDENGKFISQRTLPKLATVEVFYEDTALTVGFQKMFFKISTNNSFKRQVKVQVWNDTFDAALEPDLYSQALSQYLGVNCRLVRYAPYSQRRVLSTDKAWKPEVRFADGRPVQLINTKSLEELNSRLAEPVGVDRFRGNIIYSGQMPFEEDKWKKIRVGDVVFSQPKRCSRCTITTIDQATGVATGPDPLKTLAGYRREGSSVFFGTLWIPENTGVIKLGDNLEVLE

SEQ ID NO: 42507 - protein, 377 aa, Chlamydomonas reinhardtii
MSTIGKPIECKAAIAWEAKKPLEVRTVTVAPPGPGEVRVQIKATALCQTDAYTLGGLDPEGRFPCILGHEAAGVVESVGEGVTSVKPGDHVIPCYQAYCGECKFCKHPESNLCVSVRAFTGKGVMKSDGKPRFTVDGKPIYHFMGTSTFSEYTVVHEQSVAKIDVNAPLDKVCLLGCGVSTGWGAVFNTAKVTAGSTVAVFGLGAVGLAVIEAAKRAGASRIIAVDINPTKFPAAKEFGATDCINPKDHEKPIQQVIVEMTEWGCDYTFECIGNTAVMRAALECAHRGWGTSVIVGVAAAGQEISTRPFQLVTGRRWMGTAFGGYKSRVQVPDLVTDYMSGATLLDKYITHNMKFDQINEAFELLHAGECLRCVLTF

SEQ ID NO: 42508 - protein, 478 aa, Sulfolobus solfataricus P2
MKSYQGLADKWIKGSGEEYLDINPADKDHVLAKIRLYTKDDVKEAINKAVAKFDEWSRTPAPKRGSILLKAGELMEQEAQEFALLMTLEEGKTLKDSMFEVTRSYNLLKFYGALAFKISGKTLPSADPNTRIFTVKEPLGVVALITPWNFPLSIPVWKLAPALAAGNTAVIKPATKTPLMVAKLVEVLSKAGLPEGVVNLVVGKGSEVGDTIVSDDNIAAVSFTGSTEVGKRIYKLVGNKNRMTRIQLELGGKNALYVDKSADLTLAAELAVRGGFGLTGQSCTATSRLIINKDVYTQFKQRLLERVKKWRVGPGTEDVDMGPVVDEGQFKKDLEYIEYGKNVGAKLIYGGNIIPGKGYFLEPTIFEGVTSDMRLFKEEIFGPVLSVTEAKDLDEAIRLVNAVDYGHTAGIVASDIKAINEFVSRVEAGVIKVNKPTVGLELQAPFGGFKNSGATTWKEMGEDALEFYLKEKTVYEGW

SEQ ID NO: 42509 - protein, 437 aa, Bacteroides thetaiotaomicron VPI-5482
MNIAVVGTGYVGLVSGACFSEIGVNVTCIDVNEKKIQALKDGKIPIYEPGLDEIVRRNYHEGRLHFDTDITTCLNEVEIVFCAVGTPPDEDGSADLKYVLEVARTVGSNMNKKLLFVTKSTVPVGTAKKVKAAIQDELKKRDLDISFDVASNPEFLKEGAAIKDFMSPDRVVVGIESEEAKRLMTLLYRPLMLNNCRILFTDIPSAEMIKYAANSMLATRISFMNDIANLCALVGADVNMVRKGIGADSRIGSKFLYPGCGYGGSCFPKDVKALIKTAEMNGYEMRVLKAVEEVNEQQKQIIFKKLSEYYETKLIGKNVGIWGLAFKPETDDMREAPSLVVIRKLLEAGCRVRVYDPIAMDECYRQLGDAVIYATDMYDATLNTDALLLLTEWKQFRLPSWEVIKKIMKCPLIIDGRNIYEAQDMVNLGFDYVCIGR

SEQ ID NO: 42510 - protein, 353 aa, Bacteroides thetaiotaomicron VPI-5482
MKVLVTGAAGFIGSFTSKKLLEQGHEVVGLDNLNDYYDTSLKYGRLANLGINKDEIGWYKYTRSSYYTAFNFIRMNLEDRQAVQMLFANGDFDCVCNLAAQAGVRYSIENPYAYIESNIDGFLNILEGCRNSKVSHLIYASSSSVYGLNGNVPFSEKDSIAHPVSLYAASKKADELMAHAYSHLYNIPTTGLRFFTVYGPWGRPDMSPFLFADAILHHRAIKVFNNGNMFRDFTYIDDIIEGIIRVMQHVPIGNKNWKPENPSPDSSSAPYKIYNIGNSRPVKLMDFIQAIENAIGREAEKIYLPMQPGDVYQTYADITSLEHDTGFKPDTSLLEGVRKTIDWYCDFYKLDSK

SEQ ID NO: 42511 - protein, 362 aa, Nostoc sp. PCC 7120
MTQNYRITLLPGDGIGPEIMAVAVDVLKVVGQQFDIQFDFQEALIGGAAIDATGEPLPSATLDTCRHSDAVLLAAIGGYKWDSLPPHQRPEGGLLGLRAGLELFANLRPAQILPQLIDASTLKREVVEGVDIMVVRELTGGIYFGKPRGIFTTETGEKRGVNTMVYTESEIDRIGRIAFETARKRRGKLCSVDKANVLDVSQLWRDRITNLSQEYPDVELSHLYVDNAAMQLVRAPKQFDTIVTGNLFGDILSDAAAMLTGSIGMLPSASLGASGPGVFEPVHGSAPDIAGQDKANPLAQVLSAAMMLRYALDQPQAADKIEQAVLQVLEQGDRTGDIISVGMNLLGCRGMGDSLIKALAKS

SEQ ID NO: 42512 - protein, 355 aa, Neurospora crassa
MAANYWESTQRKHWLFTKDELAAMRAKLEAEEPNLVASFPLPQLRHLNIYFNQQSPTYFCFTLEINRLGKRMGLRQQALATAQVYIKRFYTKVEIRRTNPHHVLVTALYLACKMEECPQHIRLMANEARGFWPTDFQSQTEVARIGECEFYLISEMSSHLIVHSPYRTLTSLQGELGLAQEDVNLAWSVINDHYMTDLPLLHPPHVIALTAILLALVLRQDPSGRLPGTAASASGLVAASAALAQAQAQAQARAAMMAGGGQTVPGLTPQSSSGLQAMLPPQSPAGEGPAEGNKNPRMAKVHRFAAWLSDSNIDIEAMVDCTQELISFYECHEQYNDKNTREQINRFVKARGLDK

SEQ ID NO: 42513 - protein, 305 aa, Schizosaccharomyces pombe 972h-
MSRLRAPVAKFLADGLKGIRSTALAGSRLSNCRYTSTSSKDTDTSSHMTHFGFKDVPEDEKEHLVKNVFSSVAKKYDEMNDAMSLGIHRLWKNIFVSRLNPGNSTVPMKILDVAGGTGDIAFRILNHATNHNGDRNTRVIVADINPDMLSVGLRRSKKTPYYDSGRVEFIEQNAEILDKIPDNSIDMYTIAFGIRNCTHIPKVLEQAYRVLKPGGVFSCLEFSKVYPAPLAELYRQYSFKILPLLGTIIAGDSQSYEYLVESIERFPDAKTFAKMIEDAGFTLAGETGYETLSFGIAAIHTGIKL

SEQ ID NO: 42514 - protein, 141 aa, Triticum aestivum
  misc_feature (35)..(35): Xaa can be any naturally occurring amino acid
  misc_feature (108)..(108): Xaa can be any naturally occurring amino acid
  misc_feature (130)..(130): Xaa can be any naturally occurring amino acid
PNGAQVRDSRDKTSDKFEFIVQKRGVHRFCSRNKXSPYHETIDFDVHVGHFSYFEQHAKDEHFAPLFEQIGKLDEALYNIQFEQHWARGQTDRQAILNENMSRRAVHXALFESAALIAANVIQVYSCAGXQRKLGTLGFKQ

SEQ ID NO: 42515 - protein, 315 aa, Lotus japonicus
MAAIIEIPTKVLTNSSGQQRIPVIGMGSAPDFTCKKDTRDAIIEAIKQGYRHFDTAAAYGSEQALGEALKEALDLGLVSREELFVTSKLWVTENHPHLVVPALQKSLKTLQLEYLDLYLIHWPLSSTPGKFSFPIAVEDLLPFDVKGVWESMEECLKLGLTKAIGVSNFSVKKLQNLLSVANILPAVNQVEMNLAWQQKELREFCSANGIVLTAFSPLRKGGSRGANEVMENDMLKEIAEAHGKSIAQVSLRWLYEQGVTFAAKSYDKERMNQNLQIFDWALTKEDLEKIDQIKQNRLIPGPTKPQLNDLFDDQA

SEQ ID NO: 42516 - protein, 470 aa, Parvularcula bermudensis HTCC2503
MSQSFDVVVIGGGPGGYNAAIRAAQLGLSVACIEKRPSGRFGGTCLNVGCIPSKAMLHASEAYAHAKSHLKELGVKVSGVELDLPAMLGQKDDAVQGLTDGIAYLFKKNKVTGLKGHGRIEGPGKVILTDEDGKEEPLSASTIVIATGSSVMSLPNVEIDEDVIVSSTGALELKKVPDHMVVVGGGYIGLEMGSVWRRLGAKVTVVEYLDRITPGMDGEVSKQFMRILKKQGMEFKLGTKVTGIEKTKQGATLSLEPAAGGEKETLEADVVLIAIGRKPHTEGLGLDTVGIKTNDRGFIPVDDHYQTGVDGIYAIGDVTPGPMLAHKAEDEAVAVAEIIAGKGGHVNYDVIPGVVYTDPEVAMVGKTEEQLKDEGVAYKVGKFPFTANSRAKTNHETDGFVKVLADAETDKVLGVHMIGTGVGEMIAEACLVMEFGGSSEDIARTCHPHPTRTEALRQAAMGVEGWTMQA

SEQ ID NO: 42517 - protein, 247 aa, Geobacter metallireducens GS-15
MKKLVLLRHGESVWNRENRFTGWTDVGLSEKGIEEAISAGRTLKEEGFVFDVAYTSVLKRAIKTLWLVLEEMDLMWIPEYRHWRLNERHYGALQGLNKAETAERHGMEQVMIWRRSYDIPPPPLTPDDQRFPGSDPRYASLLPEELPLTESLKDTVARFLPYWHETIAPAVKEGKRVLVTAHGNSLRALVKYLDLVSDSEIVNLNIPTGIPLVYELTDNMTPIRSYYLGDPDDVARASRMVADQIKK

SEQ ID NO: 42518 - protein, 411 aa, Campylobacter upsaliensis RM3195
MNLKEEALKYHLGGKTSLQPSKPLNTSYDLSLAYSPGVAEPCLEIAKDENLAYTYTNKANLVAIVSDGSAVLGLGNIGASASKPVMEGKACLFKKFANIDAFDLEINAHSVEEIVAFCKALVPSVGGINLEDISAPKCFAIEAALQKLGIPVMHDDQHGTAIISTAGLMNAMEISNKSFKNIKVVISGAGAAGIASAKMYRNLGVENIILIDSKGVISKDRADLGIEKLEFAKDTKEKTLRDAMYGADVFLGLSKPNIIDEEMLKSMAQNPVIFALANPVPEVMPELVHQVRKDAIVGTGRSDYANQINNVLGFPFIFRGALDVRASKITENMKVAAAKALADLAKLPVSEEVKKAYAITHLEFGKNYVIPKPFDVRVKALVSTAVAKAAIDDGVAKIKEFDEKAYFKSLQ

SEQ ID NO: 42519 - protein, 409 aa, Shewanella sp. ANA-3
MSFSALSLHSQLVNTLAELGYQQPTPIQIEAIPAILAKQDVMAGAQTGTGKTAAFALPILQQLLIDNESQDAPKDVRALVLVPTRELAVQVQQSFVKYAKGTDIRVGIAYGGVSIEAQQAEFKAGIDVLIATPGRLLDHLRQGALNLKRLSVLVFDEADRMLDMGFMDEIKAVLKQVPAQRQTLLFSATLDDSIFGFSKNLLRDPKLIEVAKRNTTAAQVEQRVYAIDSDRKTEFVSHLVRSKNWQQVLIFSRTKQGVDKLTTQLNQLGVATQAFHGDLSQGAREKVLKDFKQGLVQVLVATDVAARGLDIADLQYVINFELPFIAEDYIHRIGRTGRAGSAGLAITLFSQEDALLLEEVEALLDKRLPQQWYPGFEPDFNKMEPEPRRNSKAAQKQRAKKRALGGKKR

SEQ ID NO: 42520 - protein, 138 aa, Zea mays
LDRAMEWLEAEAKLNLHGFSTVAAYVLVLQWVDAVRGRPRALPLEVSVVCGVGKHSDVPGESRVRELAQEVLGRMGSPLKLSARNRGRLVAKRDRVEQWLASLPVPEDGTDPSPDAANEEPFVFALFRKLGQFFSNLM

SEQ ID NO: 42521 - protein, 393 aa, Schizosaccharomyces pombe 972h-
MVENVNINNKRAGKMSAAPTPHNTPSGTSAPNFGAKAPQVNTIDEGDENLEAIDGKLGSLLHLTSEGVSELPEAVQRRISGLRGLQKRYSDLESQFQKELFELEKAYAKKYAPIFKRRSEVVRGADEPTEEEIKKGEAADENEKKEPTSSESKKQEGGDDTKGIPEFWLTAMKNVLSLSEMITPEDEGALSHLVDIRISYMEKPGFKLEFEFAENPFFTNKILTKTYYYMEESGPSNVFLYDHAEGDKVDWKENADLTVRTVTKKQRNKNTKQTRVVKVSVPRDSFFNFFNPPTPPSEEDEESESPELDELLELDYQIGEDFKEKLIPRAVEWFTGEALALENYDGFSDLDVEEDEDDVESSSNEEVSDSDEEDSDSKHTAHGQQNAAECRQQ

SEQ ID NO: 42522 - protein, 184 aa, Candida parapsilosis
FVFPHLPLPHYWKRDAAQQKISETYMTEIARRRETGDIDENRDLIDSLLVNSTYKDGVKMTDQEIANLLIGVLMGGQHTSATTSAWFLLHLAEKPQLQDELYQEVLNALSGKGGNLDDLSYEDLQQMPLVNNTIKETLRLHMPLHSIFRKVVSPLVVPNTKYIVPRGHHVLVSPGYAHTNERFY

SEQ ID NO: 42523 - protein, 215 aa, Burkholderia xenovorans LB400
MHSSYPTITGLGLVPTVIEQSGRGERAYDIYSRLLRERIVFLVGPVNEQSASVIVAQLLFLESENPDKDISFYINSPGGSVYDGLAIYDTMQFIKPEVSTLCTGFAASMGTFLLTAGQRGKRYALPNARIMIHQPSGGSQGTAADVEIQAKEVLYLRERLNAMMAERTGRSIEEIARDTDRDNFMSAHAAKTYGLVDEVLETRAALGASPHLHDR

SEQ ID NO: 42524 - protein, 184 aa, Candida orthopsilosis
FVFPHLPLPHYWKRDAAQQKISETYMKEIARRRESGDIDENRDLIDSLLVNSTYKDGVKMTDQEIANLLIGVLMGGQHTSATTSAWFLLHLAEKPQLQDELYQEVLNALSGKGGNLDDLSYEDLQQMPLVNNTIKETLRLHMPLHSIFRKVVSPLVVPNTKYIVPKGHHVLVSPGYAHTNERFY

SEQ ID NO: 42525 - protein, 468 aa, Sulfolobus tokodaii str. 7
MSEVIEIKSPSNLKVIGTVKRMSKDEVRGEIEEAYKGFETISRMPLYKRTAILRKVSEILEREQERLARLLAMEAGKPIKDSRVEVMRASRLFRQAAEEAAIVLEGKNYRVDAYEYPPGNENRIVISTREPIGVVTAILPFNFPINSFAHKVAPAIAVGNSVVVKPSISTPLSAIEMKKILVEAGLPDSAVRIVTGYSNEIGDELITHPLVGLITLTGSTQTGLAIASKAVSLGKRIIMELGGSDPIIVLEDANIDRASSIAVRARYEYAGQNCNAGKRIIVREEIYDKFVKAFKEKVKALKVGDPLDESTDIGPVINQESVEKLNKALEDAQSKGGNVEVLNKGPETGYFFPLSLVTNPSLDMLVLKTEIFGPIAPIVSVKSDEEAINIANSTEYGLQSAIFSNDVNRALKIAKELKFGAIIINDSTRLRWDSLPFGGFKKTGIGREGVRDTMLEMTENKLIAITLL

SEQ ID NO: 42526 - protein, 368 aa, Saccharomyces cerevisiae
MARTITFDIPSQYKLVDLIGEGAYGTVCSAIHKPSGIKVAIKKIQPFSKKLFVTRTIREIKLLRYFHEHENIISILDKVRPVSIDKLNAVYLVEELMETDLQKVINNQNSGFSTLSDDHVQYFTYQILRALKSIHSAQVIHRDIKPSNLLLNSNCDLKVCDFGLARCLASSSDSRETLVGFMTEYVATRWYRAPEIMLTFQEYTTAMDIWSCGCILAEMVSGKPLFPGRDYHHQLWLILEVLGTPSFEDFNQIKSKRAKEYIANLPMRPPLPWETVWSKTDLNPDMIDLLDKMLQFNPDKRISAAEALRHPYLAMYHDPSDEPEYPPLNLDDEFWKLDNKIMRPEEEEEVPIEMLKDMLYDELMKTME

SEQ ID NO: 42527 - protein, 196 aa, Oryza sativa Japonica Group
NILFKHIKELLSGDTALIAETGDSWFNCQKLRLPEGCGYEFQMQYGSIGWSVGATLGYAQAAKDKRVMSCIGDGSFQMTAQEVYTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 42528 - protein, 473 aa, Marinobacter sp. ELB17
MIYPVILAGGTGSRLWPLSRQLNPKQFLKLTDPKWSMLQSTVARLNGLPVQPPLIICNEEHRFIAAEQMRQAGFQGAHIILEPCGRNTAPAIALAALQLQKARQKGQEDPVMLVLAADHLIQNVPAFQKCVQQASTLAQADKLVTFGITPTRPETGYGYICHGDPINEHGHTVKAFVEKPDVETAKSYLESGNYLWNSGMFMFRAGRYLEELGKHRPDILAACEAAMENVSQDFDFTRIDEAHFAECANESVDYAVMEKTDAAAVVALDAGWSDIGSWSALWEVSPKDSHGNSSSGDVMTLDTNNTLVRADSRLLATLGVDDLVIIETKDAVLVAHKDKVQDVKKLVAQLQADGRHEHLNHREVYRPWGLYDSIDNGERYQVKRITVKPGAKLSVQMHHHRAEHWVVVSGTAKVTNGEKTYLVTENQSTYIPLGQVHSLENPGVINLELIEVQSGSYLGEDDIVRYEDTYGRT

SEQ ID NO: 42529 - protein, 471 aa, Arabidopsis thaliana
MAMEKDLSPNSPRIRKLRDTSYPTTPTSRMNTNNQRDNHYPNIPNSPRDYNYTPSSPTARIRHRRRSSENLAEVNRSNVSRVSNLLLGDKNKYRSMWIRTCSSLWMLGGVVFIIYMGHLYIWAMVVVIQIFMAKELFFLRRRAHEERRLPGFWLLNWHFFFTAMLFVYGRIIQQQLVNTVSSDRFIYKLVSGLIKYQMVICYFLYIAGLIWFILTLKNKMYKYQFGQYAWTHMILIVVFTQSSFTVANIFEGIFWFLLPAALIAMNDVAAYFFGFYFGKTPLIKLSPKKTWEGFIGASVATIISAFIFANVLGQFQWLTCPRKDLSTGWLHCDPGPLFRPEYYPFPSWITPFSPWKGISTLPVQWHAFSLGLFASIMAPFGGFFASGFKRAFKIKDFGDSIPGHGGFTDRMDCQMVMAVFAYIYIQSFIVNRDYSVEMILDQISRSLGHEEQKMLYEKLGDILQHKLQGRF

SEQ ID NO: 42530 - protein, 368 aa, Burkholderia thailandensis E264
MKTKAAIAWKAGEPLTIEEVDLEGPRAGEVLIEVKATGICHTDYYTLSGADPEGLFPAILGHEGAGVVVDVGPGVGTLKKGDHVIPLYTPECRECKFCLSRKTNLCQKIRATQGRGLMPDATSRFSIGGKPIFHYMGTSTFSNYIVVPEIAVAKVREDAPFDKICYIGCGVTTGVGAVVYSAKVEAGANVVVFGLGGIGLNVIQGARMVGADKIIGVDINPKRVELARKFGMTHFVNPNEVENVVDHIVQLTDGGADYSFECIGNVKVMRQALECTHKGWGQSFIIGVAAAGEEISTRPFQLVTGREWKGSAFGGARGRTDVPKIVDWYMEGKINIDDLITHTLPLEKINDGFDLMKKGESIRSVVLY

SEQ ID NO: 42531 - protein, 372 aa, Nocardia farcinica IFM 10152
MSADTAAALVLEDGRVFRGTAYGAVGQTLGEAVFCTAMTGYQETLTDPSYHRQIVVATAPQIGNTGWNDEDDESQRIWVAGYAVRDPARRVSNWRATRSLPDELDRQGIVGIAGIDTRALVRHLRTRGSMKAGIFSGAALADAEELLARVTGQPSMLGADLAEEVSTDGVYTIEPTGDHRFTVVAVDLGIKTNTPRMFAQRGIRVHVVPSTTSLDQVLELKPDGVFLSNGPGDPATQNDAVAITQGVLERGVPLFGICFGNQILGRALGRETYKMKFGHRGINIPVVEHETGRISITAQNHGFALEGERGEQFDTPFGRAEISHVCANDGTVEGVRLLDGRAFSVQYHPEAAAGPHDAAYLFDRFAGLMEGA

SEQ ID NO: 42532 - protein, 483 aa, Coccidioides immitis RS
MGSLYCRRSLSKALQARISSRILPAAPPVAGFNHRSRRRFHSTPVPWGIRSQILKDVGEGITEVQIIQWYVQEGARIEEWKPLCQYQSDKAVDDITSRYEGVIKKLHFQADDTVPTGMALCEIEVDDAKYPETNAPAPPKAESAPEPTTSASAVSQETAQEVLAENSQAQVETAPAAPKSKYATFATPAVRGLLKEHGLDITKITGTGKDGRVMKEDVFKYLAERDSQAAAPAAQPTATTPSVDTPQIETPTRLTPIQSQMFKTMTKSLSVPHFLYADDLSISALASIRQKILSHPTEPQKISFLPFIIKAVSLALQQYPLLNARVDTTTNPDKPSLVMRSSHNIGVAMDTPTGLLVPNIKNVQARSILDIAAEVTRLAAVARAGKLTPADLNGGTITVSNIGTIGGTYVAPVLVPNEVAILGVGRSRTVPVFDEQGNVVKDQKMTFNWSADHRVIDGATMARMAEKVRMYVESPETMMLALR

SEQ ID NO: 42533 - protein, 649 aa, Sulfolobus solfataricus P2
MMIWIEDENGNKYQCDSNGNCENLAIVKVNTKEYNNDGKIYSIEGKSFVKLSKFPITLKLNLKADQILSLTTQQIYSEVYGKAFTYYNQLAIDMEPVTEPPKELKYDIKSLDHEKYIRTYPCWLYPVFNNIPDYTVFALVKSGNSYEAFFTLSNNYVTAYLFGDSVRLYTGFNTDEIKRSYFLSIGTSDNPYKAIENAINIASKETFTFKLRKEKGFPDKVMNGLGWCSWNAFLTKDLNEENLIKVVKGIIERGLRLNWVIIDDGWQDQNNDRAIRSLNPDNKKFPNGFKNTVRAIKSLGVKYVGLWHAINAHWGGMSQELMKSLNVNGYFTNFLNSYVPSPNLEDAIGFYKAFDGNILRDFDLVKVDNQWVIHAIYDSFPIGLASRNIQIALQYSVGKDVINCMSMNPENYCNYFYSNVMRNSIDYVPFWKDGTKLHIMFNAYNSLLTSHIVYPDYDMFMSYDPYAKVHLVARVFSGGPIYITDRHPERTNIELLRMAVLPNGEVIRVDEPALITEDLLFKDPLRERVLLKLKGKVKGYNAIAFFNLNSGEVEEEYNNNEDYYYYKVFSGEFGVGKFNVKLRELDAEVVITFPKSNRVIGLREYILPPFTVIVSDNVVIPKADGTLLYVKDTELNEVKAREGIPVTIE

SEQ ID NO: 42534 - protein, 230 aa, Lipomyces starkeyi
MSSAYNVSLAAPTYSETYRNISDAYIHLSMLERLWAAWYAYMQNDVIATGLMTFVIHEVFYFGRCIPWLIIDYIPYFHKYKIQQGKVNNLKEQWQCTSSVLLSHFTVELPQIWLFHPICAYFGMSHDVPFPSFLTMFYQISLFFCLEDSWHYWNHRLLHYGPFYKYIHKQHHLYSAPFGLAAEYASPIEVMILGLGTIGSPILWCALTKNLHIFTVYIWIVLRLFPAVMA

SEQ ID NO: 42535 - protein, 645 aa, Ostreococcus tauri
MRDGFRGTPSKPYTLKRRRKAFDIRATRARGLDGHGDASARASRVVDDASTPERARAPSTRRHARVGDRCPRSRDLRTRDKGGDVTASGAYVADAQTEADRRVEAMAVATMMKYHPNARVVAEESFERACETDASAALELTATMRRASEDERNGWARELRRGVEASRVAVYHDPLDGTNEYAAGERRAITVLFGVAVDGVPVAGVIGQPFYAREGDGETLGRVVWGGAGMGVRGLDVADGYEAPPPPPRGEHVVAVNRNIRENRQAPVLEALKSRVDVLISATGYHYLTLLERRAHSALLLRKASKKWDTCAGEALLRATGGIVTDTVGRRYDYTYNLDAVPNLSGMVASSDVGLHCEMTAIIRDVIKPLGEYPYDVVDPSVKRGVLEGLTTPPGGWRAVTVDVGGCLIEPAERVGDVYARIASALGCDHVTSESASTHFKQAFALYRGKDCCDCEALRYYGDGKSFWRKVVNHVLTSALTRKIDASTVERMLDHLYEYYERPSSWYIAHGAVDAIRRLRRSGVRVAVASNWDARLPDLLKSLGVHDEFDALVVSANIEKEKPSTEFFNVLVSELGVDRSTVLHVGDGVQNDYQGAAAAGFGASVLWSSRPIDGVDRRSRDFNEIADAILHANAAHVHQRHYFTH

SEQ ID NO: 42536 - protein, 178 aa, Novosphingobium aromaticivorans DSM 12444
MTTDDLKRLVRTVPDFPSPGILFRDITTLIAHGEGLSACIDHLAHKARAAGAQAVAGMEARGFIFGAAVAARMGLGFIPVRKPGKLPVKTIGIDYALEYGRDRLEIDPTAIREGQRVVIVDDLIATGGTALAAAELLRMAGAHVTHALFVIDLPELHGAERLRGAGLTVEALMDFPGH

SEQ ID NO: 42537 - protein, 305 aa, Synechococcus sp. WH 8102
MVWTVDDIPSQEERVALVTGANSGLGLATARAMSARGATVIMACRCRRKAETARTQLLEAGLTGLDLLDLDLADLNSVRRAAAEVSDRYGHLDLLFNNAGVMAPPRQLTVQGHELQLGVNHLGHMALTLQLLPLMQGRNDARVVTVTSGAQYFGRIRWDDPSWAQGYDRYGAYSQSKLANVMFALELEARQQEQGGGIRSLAAHPGLARTDLQPTAIASGGNRLEAVAYRLMDPLFQSAAMGALPQLHAATAATAQGGEHYGPDQLGGMRGHPTRCRIAPAALDREQRQRLWQLSEELAGGLLMP

SEQ ID NO: 42538 - protein, 327 aa, Iris x hollandica
MEGKEEDVKLGANKFSERQPIGTAAQVADESKDYKEPPPAPLFEPGELKSWSFYRAGIAEFIATFLFLYITILTVMGVSKSKSKCATVGIQGIAWSFGGMIFALVYCTAGISGGHINPAVTFGLFLARKLSLTRAVFYMVMQCLGAICGAGVVKGYGKMLYQTQGGGANVVAPGYTKGDGLGAEIVGTFVLVYTVFSATDAKRNARDSHVPILAPLPIGFAVFLVHLATIPITGTGINPARSLGAAIIYNNDHAWDDHWIFWVGPFIGAALAAMYHQIVIRAIPFKSRSLKLFVFDHHFCCNVPVFSLNICYANYYVLFQLCCLLSL

SEQ ID NO: 42539 - protein, 671 aa, Oryza sativa
  misc_feature (21)..(21): Xaa can be any naturally occurring amino acid
  misc_feature (33)..(33): Xaa can be any naturally occurring amino acid
MLPPPAAAAAALLLLLALSAXGANDIASDAAAXLQAFIAPFGSATVSWNTSQPTCSWTGVVCSGGRVVEVHLPGVGLRGNVPVGALGGLDKLAVLSLRYNALSGPLPSDLAKCAELRVINLQSNHFSGELPPEILALPALTQLNLAENRFSGRIPASIAKNGRLQLLYLDGNLLTGELPNVNMPLLTSFNVSFNNLTGGIPSGLSGMPATSFLGMSLCGKPLAACRTPISIPPSQAPALSPEGAVSAVGRGRGGRRLAGGAIAGIVIGCALGFLLVAGVLVLACGALQRKPRPHHSRDVAAELALHSKEAMSPSVYTPRVSDARPPPPPAAVVPAIQPAVAANVAGKKKLFFFGRVPRPYDLEDLLRASAEVLGKGTYGTTYKAALETGPVVAVKRLKETSLPEREFRDKVAAIGGLDHPNVVPLQAYYFSKDEKLMVYEFVAMGSLSSMLHGNRGSGRSPLLWESRRRIALASARGLEYIHATGSKVVHGNVKSSNVLLSRSSVDARVADHGLAHLVGPAGAPSSRVAGYRAPEVVADPWRLSQKADVYSFGVLLLELLTGKAPTHAVLHDDEGVDLPRWARSVVREEWTSEVFDTELLRHPGAEDEMVEMLRLAMDCTVTVPDQRPAMPEIVVRIEQLGGAGSARTARSVSMDDADDRPLRPAGSTRES

SEQ ID NO: 42540 - protein, 479 aa, Craterostigma plantagineum
MSQVDAEGVVDGLRRTYISGKTKSYEWRVSQLKALLKITTHHDKEVVEALRADLKKPEHEAYVHEIFMVSNACKSALKELHQWMKPQKVKTSLATYPSSAEIVSEPLGVVLVITAWNYPFLLALDPMIGAIAAGNCVVLKPSEIAPATSALLAKLLNQYVDTSAIRVVEGAVPEMQALLDQRWDKIFYTGSSKVGQIVLSSAAKHLTPVVLELGGKCPTVVDANIDLKVAARRIISWKWSGNSGQTCISPDYIITTEENAPKLVDAIKCELESFYGKDPLKSQDMSSIINERQFERMTGLLDDKKVSDKIVYGGQSDKSNLKIAPTILLDVSEDSSVMSEEIFGPLLPIITVGKIEECYKIIASKPKPLAAYLFTNDKKRTEEFVSNVSAGGITINDIALHFLEPRLPFGGVGESGMGSYHGKFSFDAFSHKKSVLKRSFGGEVAARYPPYAPWKLHFMEAILQGDIFGLLKAWLGWSS

SEQ ID NO: 42541 - protein, 319 aa, Nostoc sp. PCC 7120
MRIANDVTELIGGTPLVKLNKIPQAEGVVARIVVKLEGMNPASSVKDRIGVSMINAAEAEGLIIPGKTILVEPTSGNTGIALAMVAAARGYRLILTMPETMSQERRAMLRAYGATLELTPGTEGMRGAIRKAEEIVASTPDTHMLQQFRNPANPKIHRETTAEEIWNDTDGEVDIVIAGVGTGGTITGIAEVLKQRKPSFQAIAVEPSNSPILSGGQAGPHKIQGIGAGFVPDVLRLELVDEVIRVSDDQAMSYGRRLAREEGLLSGISSGAALCAALQVGKRPENAGKLIVMIQPSFGERYLSTPLFQDLTNETAGVS

SEQ ID NO: 42542 - protein, 415 aa, Neurospora crassa
MSFANMLNRLHGQPESYDKKSKYSFGRTLGAGTYGIVREASGPTGRVAVKIILKKNVKGNEQMVLDELEMLQRLKHPHIVKFVDWFESRDKYYIVTQLATGGELFDRICEQGKFTEKDASQTIKQVLGAVNYLHENNVVHRDLKPENLLYLTRDADSDLVLADFGIAKMLDNKDEVLTTMAGSFGYAAPEVMLKQGHGKPVDMWSMGVITYTLLCGYSPFRSENLQDLIDECSSGSVVFHERYWKDVSNDAKDFILRLLQPKPENRWTSQVRLTLAHPWLRGDSATNHNLLPEIKAYLTKARLRRGIEMVKLANRIEALKMQEDDPENTDMPGDATLAADQAQSRHRALSLASTKGGSSDAENATAPAEKRTLSKTIKTAIFREVVLAKVREMKEAEEANKLKEEAETKAKSFQA

SEQ ID NO: 42543 - protein, 303 aa, Sulfolobus tokodaii str. 7
MIDPKIKKLLESTIQLPIGKASVEEIRSLFKQFSSLTPREEVGKIEDITIPGSETNIKARVYYPKTQGPYGVLVYYHGGGFVLGDIESYDPLCRAITNSCQCVTISVDYRLAPENKFPAAVVDSFDALKWVYNNSEKFNGKYGIAVGGDSAGGNLAAVTAILSKKENIKLKYQVLIYPAVSFDLITKSLYDNGEGFFLTREHIDWFGQQYLRSFADLLDFRFSPILADLNDLPPALIITAEHDPLRDQGEAYANKLLQSGVQVTSVRFNNVIHGFVSFFPFIEQGRDAIGLIGYVLRKVFYGK

SEQ ID NO: 42544 - protein, 4533 aa, Sorangium cellulosum
MSDVRRARRSPASRARLARARQASDPSRLRGALTRALARLPMELRTHGSFMSHTTDTGGAPARPNEGSIHDWLRATLGELLGVPPAEVDFGVRFRELGLASLQVTTLVARLSAHLGRALAPTLPWQHPTPSALARHLEGAPLDEHPHAADGAKARSRGTSAPAANEPIAVVGMSCRLPGGATSPAAFWELLCEGRHGIREVPAERWDVEAFVHDDVAAPGKMTTRWGGFLDRVDGFDPGFFGMSPREVQQIDPQQRLVLELAWEAIEDARVDPVRLRGRDVGVFVGAMGSDYAKLTATEPRLIDQHTAPGVDTSILSGRVSYQLGLQGTSVTVNTACSSSLVAVHLACQSLRSGESTMALAGGVHLVLSPHGTVGMTKFGAMNPAGQCRAFDASANGYVRGEGGGIVVLKPLRAALADGDRVYCVIRGSASNNDGFSNGLTAPNPKAQEEMLARAYENAGVEPGSIDYVEAHGPGTILGDPIEAGALGAVLGPSHSADRPLRIGSVKTNLGHLEPAAGIAGLLKVALSLHHGLLPASLNYEAPNPHIAFDAWRLAVQTQLDAWPSSGGPARAGISSFGFGGTNCHVVVEEAPGSRALLLPIGAESAEELRARVAAIVPVARRLRGPREAAAMCRLVARCWGSGGACRVAIVARSAGELTRKLEEALATEASPLPITSPRPRLAFVLSGHGSQWIGMARTLLAEEPIFRAEIEACDRVVLTHRGISIVTELLADEGASRIEDLDVIQLALFAVEVALAALLGAWGVAPEVLIGHSFGEITAAYLAGVLSREDALLVLAERSRLVRDAGADGGAMLAVTGADDAAIDAVVAQIEGLSIGVYNGPGSIVLSGTRSAIAQAEAELARGGVRVDRVKVSYASHSPQMDPLVAPLRACLDAVSPRPARVPLRSTTRDAWLAGHECGADHWAQNLRAPVLFGRGIEAIAREAPTVFVEPSPHPVLVKSIERTVQACGASARALPLCFRGEDEREGLYACLAALFALGFQPAWGAALGRGEADALAPAAERALADVLGAPLGADRGAPDRPPAPIPFVLSAKSDAALRAQAARLHAHVLTSRDLALPDLAYSLATTRTGFDRRAAVVADDRATLLAGLEALAEGSGTRDTVVGSAVPEGGIVFVFPGQGSQWAKMAAALLDTSAVFRAEIDACERALAPHVDFSLLAVLRGEGEAAALLERVDVVQPVLFAVMVALAATWRSMGVEPAAVVGHSQGEIAAAYVAGALSLGDAAKVVALRARALTRLAGRGAMAAIELGVSEVEARLEGLVGRVSIAAINGPRATLVAGDNDAVDALVRGLSAAQIFARKIRVDYASHSAHVEAIEGALVAGLADIAPRASVVPLYSAVSGARLDGAALDAAHWYRNLRETVRFEAATRALLADGHRFFVEVSPHPVLTLALQETIDASGASAAVVATLRRDEGTVARMVLSLAELATRGRALGAKALFGGARRVPLPTYAFQRERCWLDAPRGPDADVKAAGLSAADHPLLGAAVAVADSGAYLLTGRLSLGAHPFLAGHAVFGAPILPGTAFLELALVAAHGVGLDRVEELTLEAPLALPATGGVAVQIHVGPPDARGARSFALHARDDAAAPDAPWTRNARGILGARAAAPAVDLGEWPPPGAEPIAIDGLYDRLAEAGLAYGPDFRGLRGVWRRGAELFADVALPDAAAREAPRFALHPALLDAALHALFAEDASRGDARVRMPLSWSGASLDAVHASSLRVRFAPRADDSVSLAIADAEGNPLASIDALAMRAASEGALRSALRAHAETLYCVTWTAAPGDAGATDPRGAWALVGSDVALAEALGSRAHVTTYADWATLADALAGGAQPPVAIVVRCASHDTTRDVAAAAHDATARALALVTAWLADERLATCALAVVTESAIATRAGEDVADLAHAPLWGLLRTAQTENPDHALVLVDVDDTIASRGALAGALDAALAAGEPQIALREGRRLTPSLARAGRGEVAARRALPADGTVLVTGGTGTLGALFARHLVREHGAAHLLLTSRSGRAAPGADALARELEAEGASVTIAACDVADRAALAELLASIPRERPLAAVVHAAGALDDGVVTSLTAPRLASVLRAKVDAAVHLHELTREMDLAEFVLFSSVAGVLGTPGQASYAAANAFLDALAHHRKARGLAALALDWGYWAERTGLTAHLGDADLARLARGGLRPLARDEGLALFDAALGRAEAALVPASFDVAALRARGGGPLLRSLAGAKDARPVAANAKTAATLAQRIARLSPEDRERALLDVVRPEIGVVLGLGASRDLDVHRPLRELGLDSLMAVELRNRLAAAAGLRLPTTLLFDHPTPAALARFLAGELLGGGEARDASRARAPSTGDAIAIVSMSCRFPGGVYTPEDLWALLRDGRDAIASFPEGRGWDTGTLYDPDPDALGKSYTRQGGFLYDADCFDPGFFGVSPREALAIDPQQRMLVETAWEAIERAGITPASLHGTDTGVFVGVMYGDYGGRLAQAPCELEGYVVTGSAASVASGRIAYTLGLEGPAVTVDTACSSSLVALHLACKALLQGECALALAGGVTVMATPATFIEFSRLRAVAPDGRCKSFSADANGAGWSEGAGMLLLERLSDARRNGHPVLAVLRGSAVNQDGKSQGLTAPNGPAQERVIRMALAQAGLAPRDVDAVEAHGTGTTLGDPIEARAIMATYGEGRPSDRPLLLGSLKSNIGHTQAAAGVAGVIKMVLALEHGELPKTLHAARPSPHVDWSAGTVRLLTEAAPWRPNGVPRRAGVSSFGISGTNAHVIIEEAPGDADASASAATAEAAPGRELPFVLSAKTEAALRAQARRLHAHVAANGELSLADLGFSLATTRSHFDERAAVVASDRDALLHGLDALARGEPAPETVAASTVSSGKLVFVFPGQGSQWPEMASALLDSEPVFREQLLACEGALAPHVDWSLLTVLRHGRDGDASLDRVDVVQPVLFAVMVALAAMWRATGVEPDAVVGHSQGEIAAAYVAGALSLEDAAKVVALRARAITRLAGRGAMAAIELPASELDRHLDGLDGRIGIAAINSPRTTLVAGDVAAVDALVGTLSAAQIFARKVRVDYASHSEHVAAIENELLRDLGGISPRASALPIYSAVTGEKLDGQALDAAHWYRNLRQTVRFEDATRALLADQHRFFVEVSPHPVLSLALRETIDDAGLSAAVVPTLRRDDGHRARFLLSLAELHARGHRVVWSALFDAHRPRRVPLPTYAFQRERFWLDAPRARADVAAAGLASAEHPLLKASVALAGSDGYLFTGRLSLAEHPWLAGHAVFGEPILPGTAFLDLALAAAHRVGLDAVDELTLEAPLALPATGGVVVQMALGATDDDGRRSLTVHARPDDAGDDAAWTLHARGQVGSRSARADAATAYDLRAWPPPGAVSVAIDALYDRLARAGLAYGPDFRGLCRVWRRGDELFAEVVLPEATARDAARFGVHPALLDAALHPLLLQVGDATGVVMPFAWSGAVLHAVGASTLRVRLARRGGGDGASADEGANATISIDVADAAGAAVATIEALAVRAVSKGAAARRGAREDALFHVAWTELARAADERGAGFAPGAPWAILDDGRAFARALAGAVGSDATSYDDVGAIAGAPSTRPAPAVVIAPCADDAANADARGIVEAAHVATARALALLHAWLAEPRLATSALVIVTRHAVATSADEDVKDLAHAPVWGLVRAAQTEHPDRAIVLVDIDGGDASLSALATALDVSEPQLALREGRRLVPRLGRLGGDDALVPPSAAAYRLHVAAKGTLESLALVPHEEATRPLAEGQIRVAVRAAGLNFRDALDALGMYPGDPGPLGAEGAGVVLEVGPGVTELAPGDRVMGLLSAAFGPIALADHRMVSRIPAGLSFVEAASIPVVFLTAYYGLVDLGRLRPGERVLVHAAAGGVGIAAVQLARHLGAEVFATASPPKWATLRALGLDDDHIASSRSGDFEAHFRRTSGGRGVDVVLDSLARELVDASLRLVALAPDGRFVEMGKSDVRDPLAVAASHPSVAYRAFDLAEAGPERIQAMLAELVALFERGVLRVPPITPCDLRRAPQAFRALAQARLVGKVVLTIPRALDPRGSVLVTGGTGTLGALVARHLVQRHGVRSLVLSSRRGPAAPGADDLRRELEAAGASVAIVACDAGDRLALERLLAGIPADRPLTAVVHAAGTLDDGVLTSLTPERLRSVMSAKVDAAAHLDELTRPLDLSAFVLFASLSGVLGTPGQANYAAANTFLDALAHQRRSRGLPAVSLDWGYWAERTGLTAHLAETDVARMERIGLRPMASDVGLALFDAALAHVDAALVAAPFDPIAQRAHAVAPILRGLARAAAPRLKAATNAASEATLAQRVRALAPADRMRALVDTVRAEVGVVLALPASKAVAPQRPLKELGLDSLTAVELRNRLAALAGIRLPATLLFDYPTLDALAAMLLAKLVDDEPASPPPLVMELDRLEHALGTPEGDDGTRALVATRLRSLLARWSVGTHGNGTSAVSKDFETATDEELFAQFDAGFGGPSQ

SEQ ID NO: 42545 - protein, 321 aa, Mycobacterium tuberculosis H37Rv
MVRIAYLGPEGTFTEAALVRMVAAGLVPETGPDALQRMPVESAPAALAAVRDGGADYACVPIENSIDGSVLPTLDSLAIGVRLQVFAETTLDVTFSIVVKPGRNAADVRTLAAFPVAAAQVRQWLAAHLPAADLRPAYSNADAARQVADGLVDAAVTSPLAAARWGLAALADGVVDESNARTRFVLVGRPGPPPARTGADRTSAVLRIDNQPGALVAALAEFGIRGIDLTRIESRPTRTELGTYLFFVDCVGHIDDEAVAEALKAVHRRCADVRYLGSWPTGPAAGAQPPLVDEASRWLARLRAGKPEQTLVRPDDQGAQA

SEQ ID NO: 42546 - protein, 388 aa, Burkholderia thailandensis E264
MKIHEYQGKEILRKFGVAVPRGKPAFSVDEAVKVAEELGGPVWVVKAQIHAGGRGKGGGVKVAKSLDQVREYANQILGMQLKTHQTGPEGQKVNRLLIEEGADIKKELYVGIVIDRVSQKVVVMASSEGGMDIEEVAEKTPEAIHKVAVEPSTGLQDAEADDLAKKIGVPDASIPQAREILKGLYKSFWETDASLAEINPLVLTGDGKVIALDAKFNFDSNALFRHPEIVAYRDLDEEDPAEIEASKFDLAYISLDGNIGCLVNGAGLAMATMDTIKLFGGEPANFLDVGGGATTEKVTEAFKLMLKNPGLKAILVNIFGGIMRCDVIAEGVIAGSKAVNLNVPLVVRMKGTNEDLGKKMLAESGLPIISADSMEEAAQKVVAAAAGK

SEQ ID NO: 42547 - protein, 357 aa, Mucor circinelloides
MGCCQSNEVHDGKARNEEIDNQIKRDKLNMRNEVKMLPLGAGESGKSTILKQMKSIHDGGYSRDEREAFKEIIFSNTVQSMRVILEAMENMGVSYASSQNRLHSTVILDLPSQIERDSLPPEVTLALKSLWKDENLLSVFDRSREYQLNDSAKYYFDSIDRIGDINYIPTDQDVLRSRVKTTGITETTFVIGDLTYRMFDVGGQRSERKKWIHCFENVTAIIFLVAISEYDQVLIEDETVNRMQEALTLFDSICNSRWFIKTSIILFLNKIDIFKEKLPKHPLKESFSDFEAPCTGPESYEAASDYILHRFVSLNQSDSKQIYTHFTCATDTQQIKFVMAAVNDIIIQNNLRDVGLL

SEQ ID NO: 42548 - protein, 357 aa, Pyrococcus furiosus DSM 3638
MEKRVSEMKFCFCGEKKDSRVKPLRVAIIGAGPAGLSAACSLACDGFDVHVYDKMPEPGGMVAFGIPEWRIPISKVRQAVKEIEELGVVFHMRTKVVYDSPKELGDEFAERFVSLEKLMKEYDAILIATGAWRPRILDIPGKELKGVENALQLLLRINLARIGYLPQTKMPSFEGKRVVVIGAGYTAVDVAKEAKLLGAKSVTIAYRRSLQDSYAKNEFKKLIKEGVKFLEYVTPVRIFGDENVREVEFAKTKVVRGSVITTEEKRTIPADVIIFAIGQIPTNPIKEVLCSNEDILKNAGIFFAGDVISPRNIGTAIREGRKVAEEIKAWLTEHAFLNIRLSYPVSLRDISKSATQC

SEQ ID NO: 42549 - protein, 270 aa, Mucor circinelloides
IFEVVDQLGIPLESKSNADYSKLFQNVQPLKRGEPYPEAYLEPLKALWADSGIRAAKQEGNIFALHDNAAYFFDQLDRFWKDDYLPTDQDIIRCRAKTTGIVETVFHIGPLTYRMFDVGGQRSERKKWIHCFENVTAILFVVAISGYDQCLVEDRDSNQMHEGLMLFDTICNSPWFINTSMILFLNKIDIFREKILTSPVSKWFPDYKGDDSSFEQTSAYFKKRFKRLNHNPSKQVYTHNTDATDTTLLQHVMTAVSDIILNENINTLML

SEQ ID NO: 42550 - protein, 518 aa, Oryza sativa Japonica Group
MATLLLLAVAAAAAAWVWWGRYAWRARAVARRLAAQGVRGPRRGGLLRGCNDEVRRRKAEAEADGVAMDVGDHDYLRRVVPHFVAWKELYGTPFLYWFGPQPRICVSDYNLVKQILSKKYGHFVKNDAHPAILSMIGKGLVLVEGADWVRHRRVLTPAFTMDKLKVMTKTMASCAECLIQGWLDHASNSKSIEIEVEFSKQFQDLTADVICRTAFGSNSEKGKEVFHAQKQLQAIAIATILNLQLPGFKYLPTKRNRCKWKLENKLRNTLMQIIQSRITSEGNGYGDDLLGVMLNACFSTEQGEKRDELILCVDEIIDECKTFFFAGHETTSHLLTWTMFLLSVYPEWQDRLREEVLRECRKENPNADMLSKLKEMTMVLLETLRLYPPVIFMFRKPITDMQLGRLHLPRGTAIVIPIPILHRDKEVWGDDADEFNPLRFANGVTRAAKIPHAHLGFSIGPRSCIGQNFAMLEAKLVMAMILQKFSFALSPKYVHAPADLITLQPKFGLPILLKALDA

SEQ ID NO: 42551 - protein, 338 aa, Escherichia coli K12
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSSATVYGDQPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 42552 - protein, 145 aa, Arabidopsis thaliana
MASLFTPSPTTTSSSGDTIYVAAVPLKAAAGPPQLIMSMAYSLNISNLQHFMVLIKPSSPIRQEPRNPESIEAAISLLSGNLIPGVVLQRRLKNVPRQRCWMVGPSKGNDAMEMAMEFNKSWETDLRVGFHDCRHYTNGLVLYKL

SEQ ID NO: 42553 - protein, 494 aa, Zea mays
MPSGGVFSGSVNLKHVKLGYQYLVNHFLTLLLVPVMAATALELARLGPGELLSLWRSLELDLVHILCSAFLVVFVGTVYVMSRPRPVYLVDYACYKPPASCRVPFATFMEHTRLISDDDKSVRFQTRILERSGLGEDTCLPPANHYIPPNPSMEASRAEAQLVIFSAIDDLVRRTGLKPKDIDILVVNCSLFSPTPSLSAMIINKYKLRSNIRSFNLSGMGCSAGLISIDLARDMLQVHPNSNALVVSTEIITPNFYQGSRRDMLLPNCLFRMGAAAILLSNRRREARRAKYRLVHVVRTHKGADDRAYRCVYEEEDEQGFSGISLSKELMAIAGDALKSNITTIGPLVLPMSEQLLFFFRLVGRKLVNKGWRPYIPDFKLAFEHFCIHAGGRAVIDELQKNLQLSPRHVEASRMTLHRFGNTSSSSLWYELAYIEAKGRMRRGDRVWQIGFGSGFKCNSAVWKCLRSIKTPTNGPWDDCIHRYPVDVPEVVKL

SEQ ID NO: 42554 - protein, 595 aa, Oryza sativa
  misc_feature (158)..(158): Xaa can be any naturally occurring amino acid
MAMQTMQTEQQQQQRRKGSPEMDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTVYVLXANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGNYNKVSTVQYGVSRMY

SEQ ID NO: 42555 - protein, 548 aa, Triticum aestivum
MATQAGTAAAPRLSPQVICSVFVEQYYHILHETPDQAHKFYQDTSRIGRTGSDGVMEYVTTLPEISKKIMAMDFSKYLTEIETADAVLSHNGGVLIVVTGSLTMVDDFCQRFTQSFFLAPQDGGGYFVLNDIFRLITQRNLENGRTQKDEPVAQSVADPAPAVVVERSTTDLVADVDVRNPTVNGTTVQSNLTANGAVENKVEPPVKVTKEVPKKTSVAVPPSPPAQKDNPPPAQKDIPKKTPVAASPPPPSPAQKDVTKKTYASIVKVMKEGPPTPVVKPKPSPKPATKPPTKAVEGSEKSSVKPSQAAEGTPSGTSVGKNKTSHDEQGFSIFIKGLPYNSTVPMVEEEFKKFGTIKPDGIQVRNNKIDQYCFGFVEFESQQSMQAAIQASPLYIGDTEVGIEQKRTSTRVVNGVVMNAGGGGRFQYGRGHRGDNFRGRGGGYMNSASYRGGDNFNRRDDGEDFSRRDDGDNFNRRNDGSENFNRRNDFRNRNEFSGRGRGPPHQGNGYHHHNGNGFHQPRPFQNENGTGRYTRVNNGTKQTPVAAA

SEQ ID NO: 42556 - protein, 216 aa, Picrophilus torridus DSM 9790
MEIKDIIDLTNSIYNEMPVWPSSPLPEIKRSGIIPRDDYNIEEIKTMTHTSTHIDAPYHFSESGETIDNLNLRSIVGDGFCIEIDKKPGEEITAQDLRSKWREYYNNIILIRTGFSKIRSFDRNFLYNFPGLSTDAADFFMDKNVKTIGIDTLGIEPYWHSDFPVHKKLLSRGFIFIEDMNLENLIEGKRYFIVALPIKIKNGSGAMARCIALDIY

SEQ ID NO: 42557 - protein, 372 aa, Parvularcula bermudensis HTCC2503
MWSKIRDAARWGRLERDLKAVLDDRVPGATVTISPSRVLGDQAATIVLGEGHALTADKIDELSAALNHQAAPQKVTLVAPRHGQPSPSTPHRAPQRDGHRPLPTGPDTPPPGGAGAQPQRPQKSRPGNAARVLAVASGKGGVGKSTIAARLALALATATEDRPAARVGLLDLDIYGPSQPLLFGLEGRKAETREGRLVPLEAGPLALMSIGFLVGDDKALAWRGPMVMGAAKQLLFETAWPEGLDWLVIDTPPGTGDAHLTLLQRAVLDLGLLVTTPSPLALADVRRGASLFRQLGTPLAGLVENMASLDGGPSPLGPSLDENAVDLPILARLPLGSALAEPPLIGKDIAPQAAFHALAAHLIALDPPSGTD

SEQ ID NO: 42558 - protein, 5331 aa, Sorangium cellulosum
  misc_feature (2792)..(2792): Xaa can be any naturally occurring amino acid
MTGEKNLRAYLEGLTTSLRQARRRLSDIEGKQREPIAIVGLGLRLPGGAVDPESLGSFLERGVDAVAPIPASRWDADAIYDPDPNAIGKSYVRSAALLDRVDLFDAAFFGISPREAKHVDPQHRLLLETAWQALEEAGIVPASLKDTKTGVFVGAGASEYATLRGDAEKADAYATMGTSTSFAAGRLAFTLGVQGPALSVDTACSSSLVALHLACQSLRRDECDLALAAGVQVMASPEPFVLISRTRALAPDGRSKTFSASADGYGRGEGVVVLALERLRDARANGHPVLAVIRGSAINHDGTSSGITAPNGSSQQKVLRAALEDAGLAPTDVDVVECHGTGTSLGDPVEVHAVAAVYGEDRPAERPLLLGAVKTNIGHLEAAAGLAGVAKVVAALRRATLPPTLHTHPPNPHVAWETLPLRVVDAAQRWDRRADGAPRRAGVSAFGFSGTNAHVIVEEAPAPEGATAPEAERACAHASPLPVVISAKTEGALRGQAARLHAHLAARPELALADIAASLATTRSHFEHRAVVVAHDREAVLTALDGLARGANASPPPGTLVGGDAPKGRLAILFTGQGGQRAAMGHGLYQAFPVFRDALDAVCAHLDRDLDRPLREVLFAPKGSELARLLDETVFTQTALFALEVALFRLVEAWGVAPDALLGHSVGEITAAHVAGVLSLEDACALVSARARLMQALPARDAAMVAIAASEGEVAAVIAARGEGGARATIAAINGPSSTVVAGDRDAVLDVAARFEALGRKTSRLRVSHAFHSHHMDGMLDAFRRVAEGLTFHPPRIPIVSNVTGQRAGDGELCSADYWVRHARSAVRFADGLGTLHTERVSTFLELGPHGVLSALGQSALEADAPSRALFVPTLRADRDDGDALVTALGALHARGHRVDWRAFFAPVGARRVPLPTYAFQRERFWVDDAPPEPREAAQPAPAEARFWRAIEESNVDMLRDALGVASEGEERAALSTLLPALSAWRRKGQVLGLVDTWRYRVAWRPIAATSRGDASGTWLVVRAAGAYDGVVESVVRALEGRGGDVVTLGLGADACARAELAARLREAVAGRGALRGVLSFVGLDDGPSTSQPAVPAGLARTLTLVQALGDSALDARVWLFSRGAVSVSRADAIVNPAQAATWGLARVVSLEHPERLGGAVDLASSLGASGALDAAAIDHLVAALGGALAGEDELALRPEGLFARRLVRAPLGEAPRPRAPRGTVLVTGGTGALGAHVARLFAQRGAKHLVLTSRRGPDAPSARALHDELTALGARVTIAACDVGDRAALEELFAAMPADAPLSAVVHAAGVLDDGVLDALTPERLDAVFRAKALAARHLDELTRSRDLDAFVLFSSASGVFGSAGQGSYAAANAYLDALAEARRARGVTATSIAWGAWAGGGMLEDAVASDLRRSGLSPMRPEVATAALAHALDHDDDVVTIADIDWARFAPSFASVRERPFVSELPEAKRAQGALAANPARPDESALLTALRAQSDDDRLRHLVGLVLGETAAVLGHADASRVDAHKGFFDLGLDSLMAVELRLRLQKATGIRLPSTIMFDQPSPERVATFLRDALARTLGERGDVDAALVARTRHDGEPVAIVGLSLRLPGGTGDLAGLWDLLERGVDAVGPIPASRWDAGAAYDPDPDAKGKSYVRSAALLDGVDLFDAAFFGISPREAKHVDPQHRLLLEAAWQALEEAGVVPASLKGSKTGVFVGAGASDYALLQRDSDEDDAYAAMGTASAFAAGRLAFTLGLEGPALSVDTACSSSLVALHLACQSLRQGECDLALAAGAQVMASPEAFVLLSRTRALAPDGRSKTFSANADGFGRGEGVVVLALERLSDARANGRPVLAVVRGSAMNHDGASSGITVPNGTAQQKVLRGALDDAGLAPAEIDVVECHGTGTALGDPIEVNALAAVYGEGRPADRPLLVGAIKTNIGHLEAAAGLAGVAKVVAALRNGALPATLHTSPLNPHLAWDELPVRVIDGACPWLRRAEDTPRRAGVSAFGLSGTNAHVIIEEAPGDADASASAATAEAAPGRELPFVLSAKTEAALRAQARRLHAHVAANGELSLADLGFSLATTRSHFDERAAVVASDRDALLHGLDALARGEPAPETVAASTVSSGKLVFVFPGQGSQWPEMASALLDSEPVFREQLLACEGALAPHVDWSLLTVLRHGRDGDASLDRVDVVQPVLFAVMVALAAMWRATGVEPDAVVGHSQGEIAAAYVAGALSLEDAAKVVALRARAITRLAGRGAMAAIELPASELDRHLDGLDGRIGIAAINSPRTTLVAGDVAAVDALVGTLSAAQIFARKVRVDYASHSEHVAAIENELLRDLGGISPRASALPIYSAVTGEKLDGQALDAAHWYRNLRQTVRFEDATRALLADQHRFFVEVSPHPVLSLALRETIBDAGLSAAVVPTLRRDDGHRARFLLSLAELHARGHRVVWSALFDAHRPRRVPLPTYAFQRERFWLDAPRARADVAAAGLASAEHPLLKASVALAGSDGYLFTGRLSLAEHPWLAGHAVFGEPILPGTAFLDLALAAAHRVGLDAVDELTLEAPLALPATGGVVVQMALGATDDDGRRSLTVHARPDDAGDDAAWTRHATGALGPRAAGASLDVGAFPPGDATPLATAGLYDRLARAGLAYGTDFQGLRAVWKRGDELFAEVVLSEATARDAARFGLHPAALDAALHALAAEVLDGGEKAHVAMPFSWSGVSLHAVGASTLHVRIARKGGDTVALAIADAAGQKVASVDALALRPASATRVRGAKPRTGPVHDAXLRVDWIELPSGPEGAAPRAWAILGSDARLASALEAAGAHVTRHRDPGAWIDAIRGGGAPEVVAVLACTTRPDAPSGALAATHGAAADALAALQAWLAEERLASCALVVLTERAVATRPDEDVLDLVHAPVWGLVRAAQVENPDRALILVDVDADDASLPALPALVAAAVARAADASEPQLALREGRRLVPRLGRLGGDDALVPPSAAAYRLHVAAKGTLESLALVPHEEATRPLAEGQIRVAVRAAGLNFRDALDALGMYPGDPGPLGAEGAGVVLEVGPGVTELAPGDRVMGLLSAAFGPIALADHRMVSRIPAGLSFVEAASIPVVFLTAYYGLVDLGRLRPGERVLVHAAAGGVGIAAVQLARHLGAEVFATASPPKWATLRALGLDDDHIASSRSGDFEAHFRRTSGGRGVDVVLDSLARELVDASLRLVALAPDGRFVEMGKSDVRDPLAVAASHPSVAYRAFDLAEAGPERIQAMLAELVALFERGVLRVPPITPCDLRRAPQAFRALAQARLVGKVVLTIPRALDPRGSVLVTGGTGTLGALVARHLVQRHGVRSLVLSSRRGPAAPGADDLRRELEAAGASVAIVACDAGDRLALERLLAGIPADRPLTAVVHAAGTLDDGVLTSLTPERLRSVMSAKVDAAAHLDELTRPLDLSAFVLFASLSGVLGSPGQANYAAANTFLDALAHQRRSRGLPAVSLDWGYWAERTGLTAHLGDTDLQRMARGGLRPLTTDDGLALFDAALAHVDAALVAAPFDPVALRAHAVAPILRGLVRAGAARRKLANNAASAAPLAQRLAGLAPKERERAMIDVVRPEIGVVLGLPPSRHLDGDRPLKELGLDSLMAVELRNRLAAIVGTRLPATLLFDYPTPTALARFLATALVGRGDAAAAPSAARAASAGASDDAIAIVAMACRFPGGVLTPEDLFRLLREGGDAISAFPENRGWDLDALSDGAARQGGFLHDADLFDAEFFGISPRETLALDPQQRLLLEMTWEALERAGIIPASLHGSKSGVFVGVFGSDYVARLLHGPSGAQAMESLRGYIGTGSASSVASGRIAYALGLEGPAISVDTACSSSLVALHLACHAIRRGECSLALAGGVTVMATPGIFGEFSAQHAGAPDGRCKSFSADANGAGWSEGAGIVLLERLSDARKNGHPVLAIVRGSAVNQDGKSQGLTAPNGPAQERVIRDALASAGLAPADVDAVEAHGTGTTLGDPIEARALFATYGAAHAKERPLWLGSLKSNLGHTQAAAGIGGVIKMVLALQSGVLPRTLHAASPSQHIDWSSGAIRLLTEEVPWKPGGSPRRAAVSSFGISGTNAHVVLEEAPRAAAGDDQAAEPARAPLAPPVPVLLSAKSDAALRAQAGKLHAHLAEHEDVALVDVAASLATTRSHFERRAAVVADDRAALLSALAALAEGRAGAGTVAGEALPPGKVAFVFPGQGSQWPSMARALLASSPAFRAEIEACERALAPHVDWSLLAVLGGDEAHAAPMLERVDVVQPVLFAVMIALAATWRAAGVTPDAVVGHSQGEIAAAYVAGALSLEDAARVVALRSRAITKLAGRGAMAAVELTTADLEARLAPFGGRLAIAAINSPHAALVSGDPDAIDELVAELSGAQLFARKVRVDYASHSAHVEAIERTLLEALDGIAPRPATVPLYSAVTGERLDGEALGAAHWYRNLRHTVRFEHATRALLDDGHRFFVEVSPHPVLTVALRDTIDASGHDAVACASLRRDEGDLARFNLSLAELHTRGLAVDWRAFFAPFAPRTVALPTYAFQRERFWLDAPKASGVIPAAASPAEARFWSAVEDGDVATVTDALDVGDDERRAALATLLPTLATWRRARRAQSTIDAWRYRVAWRALTAPPKGDIAGTWLVVAPEVAGALADGVARALEARGARGVLVPVDAEDAARTPLAGRLRAVAGGQAIRGVISFAALDERPAPLEPSVPLGLAVSLGLVQALGDAAIDAPLWLVTRGAVAVGASERVTRPLQAMTWGLGRVVALEHPERWGGLVDLGEESAPDANGARDANVHDRLANLVARRDDEDQLALRAAGTYVRRLVRAPHDGARPPAFAPRGAALVTGGTGALGAHVARWLARIGAEHIVLASRRGAAAPGAAALAEELSALGARVTLAACDVADREAVAALVRDVEAGGATVRAVFHAGGAMHEAPVAAMRVEELADAIAAKARGAQHLHDVFAQRPLDAFVLFSSGAGVWGGGRQGAYAAANAFLDALAEARRADGLAATSIAWGAWAGGGMLATDAERRLKHRGVAPMDPELAVAALAHALDHAETCLAVADVDWARFAPSFASARPRPLLDELAEARSALDALREPPDDARTAAGPEPASTLRTTLAALPEGERHRHLLALVRTETAAVLGHADASRVEPNRGFFDLGLDSLMSVELRRRVQRATGIKLPATLAFDHPTPSALASKVLAAIVLHDATPRASPAAELERLEGMLSAIYADEALRDDLTARLRAFLDKRAVRTERPDDAAFAEKLGSASADELIRLIDQKLGDRIDVDRY

SEQ ID NO: 42559 - protein, 642 aa, Saccharomyces cerevisiae
MSSQFFLKTSQDIELFQSYPTFEQSNTNSKDFPVISSVLSPCGRFLALSTKENVKVFTGPCLDNVLLTMKLSDVYDLHFSPAGNYLSTWERASIQDPNHKNVKVWYLNKPFKKDCVSEDIVPAYEYQAKSQSGWFLQFSKLDNYGLRLFKHDLKIVKLSSANADNFDFQSPFAVLSDDETSQHFTTYLISPAEHPTICTFTPEKGGKPAQLIIWALSEGKITKKIASKTFFKADSCQLKWNPLGNAILCLAITDFDSSNKSYYGENTLYLLSFQGVNGTLGGNSVRVSLTTGPVHDFTWSPTSRQFGVIAGYMPATISFFDLRGNVVHSLPQQAKNTMLFSPSGHYILIAGFGNLQGSVEILDRLDKFKCVSKFDATNTSVCKWSPGGEFIMTATTSPRLRVDNGVKIWHVSGSLVFVKEFKELLKVDWRSPCNYKTLENKDEAFFENHIINNWEPLPDSTTSSLDPKISNKSELQIHSSVQEYISQHPSREASSNGNGSKAKAGGAYKPPHARRTGGGRIVPGVPPGAAKKTIPGLVPGMSANKDANTKNRRRRANKKSSETSPDSTPAPSAPASTNAPTNNKETSPEEKKIRSLLKKLRAIETLKERQAVGDKLEDTQVLKIQTEEKVLKDLEKLGWKDE

SEQ ID NO: 42560 - protein, 309 aa, Burkholderia xenovorans LB400
MTAKKIRHYLQFKDFSLEDYEYVLERARILKRKFKNYETYHPLHDRTLAMIFEKNSTRTRLSFEAGIFQLGGHAVFMSTRDTQLGRGEPIEDAAQVISRMVDIIMIRTFGQDILQRFSENSRVPVINGLTNEYHPCQVLADIFTYFEHRGPIRGKTVAWVGDANNMLYTWIEAAQILGFKLRLSTPPGYKLDRAVVAAESAPFYEEFDDPNEACAGADLVTTDVWTSMGFEAENEARKKAFADWCVDADMMARANPDALFMHCLPAHRGEEVSAEVIDGPQSVVWDEAENRLHVQKALMEYLLLGKLNH

SEQ ID NO: 42561 - protein, 516 aa, Geobacter metallireducens GS-15
MTRTRLLQQLEEEKCWDLLVIGGGATGLGVAVEGASRGYRTLLLERDDFGSGTSSRSTKLIHGGVRYLQQGNLSLVLEALHERGILIRNAPHLVHNLSFVVPLYDWWEGPFYGIGLKLYDMLAGKLGLGPSQILSREETLRRIPTVEPAGLRGGVIYHDGQFDDARLAVALARTCADLGGVPLNRMEVAGLLKGDGLVRGVAARDRESGREYEIEARVVVNATGPSCDAIRQLDDPGAQPVIAPSQGVHLVLPREFLPGDSAIMVPHTDDGRVLFAVPWHERVIVGTTDTPVERVTAEPRPLAAEVGFLLEHAARYLSRDPATSDILSVFAGLRPLVRGEAVNTAALSRDHTIMVSTAGLVTITGGKWTTYRRMAEDTVNSAVRMAGLAERPSRTADLPIHGWLAKGGVDGEWAMYGAEAAALEELCAVQPALRRQLHPRLPYRLAEVVWGVRYEWARSVEDVLSRRTRALILDARAAMEAAPEVAALMATELGRDEAWQAAEVAAFRALAEGYLP

SEQ ID NO: 42562 - protein, 1205 aa, Picrophilus torridus DSM 9790
MDETFGNNRYSVIKKLGEGGKGIVYKCIDNNLNRIVALKLIKSESLDDESYSRIIREAETTARLSHPNIVSIYDMQKEDNRFFMVIEYIDGKDLLDYIDNKPLKLDEILSLIIPITSALSYAHKNGVLHRDIKPENIMVSKNGEPKLMDFGLAKALDRPGITRAGTIVGTPAYLSPESALGKESDNRSDLYSLGCVLYYMSTGRPPFTINDTIKLIYSHIHDYPAEPSKINKDIPRQLDSIIMKLLRKNPDDRFQSADELLYALKALEMENRPDNKKEIIEKTDSYKDQSMLIGLDNIISELQSAVDSGLSGSGSIYLITGESGQGKTRILEKTMDYAVLRGTKSILLKGRESRMSTPNYLFTEMFREFFYEAPQQLVYKVCGDYGDVAVKILPELISKLGRINDYMSSEPDQARLRFYDGVIEIIKNMSIEYPVLMEIDDINYADSGSLSIIDSIMDKLQSLRFVIIATMSKSDSYNDELDHIISNRILNKMETKNLDRSQTAMLIASRLNEDVSKISDEFTDFIFVKTDGNPFYIEEVLKLLKDKKLIFRDEHGSWDRKPIEEIGIPSSIGSFIKERLSSLDDITMDIISMASVIGYEFDVDVLESISGIDENQFEKIIENSIKRKIVYERKTAPGEFRLFFSNPQLHDYLYENMSMFRKRKLHAKIANAIESIYGDNNSAFFQDLARHYLEAGNLQKALDYNIKLADNWSESFQFDQAVKEYRRALEILGEIHKPGKESEMLRANLLYKISENAVFNNDISENDSIYLDEAIRIFDRYGEDKKIAESILISSASYNKFDYYIDYTRSFLNRLYENKGDPEVIGIASTAIIGSLWYTANVSEARKWGKKYIDYVRSINYYDKYTIRCKEILLLVHPLNSYSDLDDIIKSYEEIAYESTNLLEKHPDDLILLNTLSTLFNNFGTMMARMVFDLKKAEQAFDRGIQFAGKISRGQKARLEISKYEELFLSGNRDVVNRYFDMVFKSNSRDDFYIMVSKFGELYFDYFHGDIDKTITLISELEKIPSMQVLTSIPEVKVPVFVDNKKITEIYDYIEDIIKKIDGEITGDTIKGYIITLMHAVYVSSIANNSENAIKYLSLIKNEYNKYGLWWIGSYMNIAESYYQSYFGNRDAAKKLMNDSALKFHEHGFDIYYGIYMYELAVLYHMDGEQEKCNMALDSALSVFTPINFTLYIEKCLRLKELLKA

SEQ ID NO: 42563 - protein, 522 aa, Oryza sativa
MPSAHPLPASSQATTAWATRTLTSTRSVGRTPTLSTPHAPGPYTSSTNAEAIATQPYPLTDKWATNLHPGPITSHRIATPNPNNNLIPDTRAEAEEEVGDRSIAIDRLSDWLIDRHAASAADEAGGGGGAAAADDAAGAAHAAAAGCGGGGGGAAAAGALVPPAPPAPGPPRGAAGGPISLPLSLLPFRSAIEPIVSGNLPPGFDSSTCRSVYVGNIHLQVTDSLLHEVFQSIGPVEGCKLIRKEKSSFGFVDYYDRRSAAIAIVSLNGRQLDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPTPFNPGMSATDLLAYERTLALSKMAANPALMSQHAALKQAAAMGMGAGASQAIYDGGYQSANAVFY

SEQ ID NO: 42564 - protein, 389 aa, Xylella fastidiosa Dixon
MSRDLPVIRLKNAWRSSHPWLFQKLLEKPSVRLKPGTIVDVVGVDGEWVGRGFYNGHSRIAVRILETRQDVVVDEAWFVRRIAEAVGLRREVLKLDAVSDAWRVVHSEGDGLSGLVVDRYGDLLVVQFFAAGMFRHREWIYTALRQQFPGARFHSFADEHVQKQESFDFHSTIDTESVVITEHGVKFLVDPMGAHKTGFFADQRENRQWLSQGVAGKTVLDLCCNTGGFAVYAALRGAADVVGVDIDQDVIQIAKANAKLNSVRPKFLQTDIFPYLRDAAVRGDQYDVVILDPAKMTRDRDQIINALKKYLDMNKLALGVVKKGGLFATFSCTGLISEEQFLEMLRRAAFYSGRTIQILKVAGAGPDHPFMAHVQESRYLKATFCRVLD

SEQ ID NO: 42565 - protein, 138 aa, Chlamydomonas reinhardtii
MSVYSLYVINKSGGLIYNRDFTEAARVDTNDSLRLASIWHSLHAIAQQLSPVPGCTGIELLEADTFNLHCFQTLTGTKFLLVVDPHASFIPALLQRIYELYSDYVMKNPFYETEQVIKCELFDENVEQLIRRYLQQAM

SEQ ID NO: 42566 - protein, 799 aa, Xylella fastidiosa 9a5c
MALNGASYLNENILWLHELRLTDLARVGGKNSSLGEMIGNLTALGVSVPGGYATTAAAFKAFIAYNNLSKRIYDKLATLDVEDVKALTAAGKEIRDWIIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRTLGSKLVRMVYSDSPGERVKIEDTPTELRHCFAISDADVQELAKQALIIEEHYGRPMDIEWAKDGVSGKLFIVQARPETVKSRSHTTQIERFALQQRGEILTEGRAIGQKIGSGISRVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 42567 - protein, 309 aa, Saccharomyces cerevisiae
MSAVFNNATLSGLVQASTYSQTLQNVAHYQPQLNFMEKYWAAWYSYMNNDVLATGLMFFLLHEFMYFFRCLPWFIIDQIPYFRRWKLQPTKIPSAKEQLYCLKSVLLSHFLVEAIPIWTFHPMCEKLGITVEVPFPSLKTMALEIGLFFVLEDTWHYWAHRLFHYGVFYKYIHKQHHRYAAPFGLSAEYAHPAETLSLGFGTVGMPILYVMYTGKLHLFTLCVWITLRLFQAVDSHSGYDFPWSLNKIMPFWAGAEHHDLHHHYFIGNYASSFRWWDYCLDTESGPEAKASREERMKKRAENNAQKKTN

SEQ ID NO: 42568 - protein, 284 aa, Pyrococcus furiosus DSM 3638
MFFAKLEFFNPFSRSIKDRPVYNMIMKAIESGEIDGTDTLYEATSGNVGIALAALSAVLGLKFRAYVPKPTPKITEILIKMFGAEVIRTKFETIDPEFINFVKEEAKKDKAVNLNQFENDANFEAHYYGTAKELDEQLKSIKKKPEVIIAGVGTSGHIAALSKYFKEKYGTKIIGVVPAEGEKIPGIKRIETKPKWFFQVKVDKVVEITTREAVEGALRVARTDGLIIGLSSGAVVKAYEKINPKGTTVLIFPDDGFKYVEIFQAFLQEAQDTTSSQTARHQSP

SEQ ID NO: 42569 - protein, 225 aa, Geobacillus stearothermophilus
MMFKTLKEDIEVIFEQDPAARSYLEVILTYSGLHAIWAHRIAHALYKRKFYFLARLISQISRFFTGIEIHPGAKIGRRFFIDHGMGVVIGETCEIGDNVTVYQGVTLGGTGKEKGKRHPTIKDNCLIAAGAKVLGSITIGENSKIGAGSVVLKDVPPNSTVVGIPGRVVVRDGVKVKKDLNHTDLPDPIADRFRELEEEIVRLKSELEALKQQERKSEYEQHPAL

SEQ ID NO: 42570 - protein, 763 aa, Oryza sativa Indica Group
MGSKSNTERARKALEAMKQLGFSKKEATPVLKNLLRLFGNNWEPIEDECYRALADAILDRHQVSLSPKPSSFFFGLHFDSTYLAAGVLQETAADRGCSATRPTPDDDHHPLTLCGASRDVDTETDEPRTKKPRATNSDPQSPPSLTDDQDVPAAISPPSHGASPQFRPQTRASARLRQASPSSVTAAHKRPRQMMDEDFQDSAFLREPKPEPDIDMDAIQGTAATSDCPNAHLGLIDYPLNASSSRVALPLALLPPDQNVPQISGPKKRAIQPCSKVNTGEGSSVIDVASSTMGEVKMSLKCSVDPKFRMPSLEAVFKMVEDKYLHSYKILPPEFSIGSLMNEICQCVVQLGSDHIAEHNTESDVAGNGRCSQNEPMTGSIPFVKPIACEDGGNRKCKSAGESFIVEDSENSSVAKQKTHLALANLKPIHDVTDISKGEERVRISVANEFASEKCPPSFYYIRGNLVFQNAYVNISVARIGDEDCCADCFGNCLSAPIPCACTRETGGEYVYTPEGLVRTPFLDECVSMNRFPEKCHKFFCKSSCPLERSRNEASPEPCRGHLARKFIKECWSKCGCNMQCGNRVVQRGITCNLQVFFTGEGKGWGLRTLDELPKGAFVCEYVGEVLTSTELHERTLQNMNNGRHTYPVLLDADWGSEGVLKDEEALSLDSTFYGNVGRFINHRCYDANLVEIPVEVETPDHHYYHLAFFTTKKVEAFEELTWDYGIDFGDGKDPVKAFQCLCGSRYCRGIRHPRKRGKAAAK

SEQ ID NO: 42571 - protein, 188 aa, Vitis vinifera
MKGQGSYVPPPYIPLGQSDSEVEIVPHDSDLPDHRHTSDSPSQWSSGICACCDDMQSCCIGFFCPCFLFAKNAEFLGSGTLAGSCMTHLIFWALVNTVCCLLSDGTLLGLPGCFVACYACGYRRALRSKYNLQEAPCGDFTTHFFCHLCAICQEYREIRERSGPETPDLRLSVVTAPPVQTMETASKE

SEQ ID NO: 42572 - protein, 146 aa, Arabidopsis thaliana
  misc_feature (113)..(113): Xaa can be any naturally occurring amino acid
  misc_feature (120)..(120): Xaa can be any naturally occurring amino acid
  misc_feature (138)..(138): Xaa can be any naturally occurring amino acid
VLNSFVCLLIRWSLLDSVKDYTHLLISIPPLADIGDPMLRNVELVRDKLSSGNLRWLCYLSSTSVYGDCGGAWVNENHLPNPKTQSAKVRLAAEQGWLSLGRDLGVSTQILRXGGYFWTXGEGQLAIDTLVKQERLSXGQKRRASR

SEQ ID NO: 42573 - protein, 371 aa, Lactobacillus amylovorus
ESTDGLRRGMKVEDTGAPISVPVGEDTLGRVFNVLGQPIDGGPEFSKDHPREGIHKEAPKYEDLTTSREILETGIKVIDLLEPYVRGGKVGLFGGAGVGKTTIIQELIHNIAQEHGGISVFTGVGERTREGNDLYFEMKASGVLSKTAMVFGQMNEPPGARMRVALTGLTLAEYFRDVEGQDVLLFIDNIFRFTQAGSEVSALLGRMPSAVGYQPTLATEMGQLQERITSTKKGSITSIQAVYVPADDYTDPAPSTTFAHLDATTNLERSLVEQGIYPAVDPLESSSSALDPEVVGQEHYEVATRVQHILQRYHELQDIISVLGMDELSDEEKLIVARARKVQFFLSQNFFGAEQFTGVPGSYVPIKETIK

SEQ ID NO: 42574 - protein, 113 aa, Brassica napus
SSGKQSALEASPITIGDRQVVLEEKKTNSRGGNNGGGRGRYFGGRGSFRNESFKGGRGGGVGGGGRGWYGRGEFSGRPNPRNGGEGYQRVPQNGGGGRGGGGRGGPRGGGVSS

SEQ ID NO: 42575 - protein, 219 aa, Mycobacterium tuberculosis CDC1551
MFDGVARKYDLTNTVLSLGQDRYWRRATRSALRIGPGQKVLDLAAGTAVSTVELTKSGAWCVAADFSVGMLAAGAARKVPKVAGDATRLPFGDDVFDAVTISFGLRNVANQQAALREMARVTRPGGRLLVCEFSTPTNALFATAYKEYLMRALPRVARAVSSNPEAYEYLAESIRAWPDQAVLAHQISRAGWSGVRWRNLTGGIVALHAGYKPGKQTPQ

SEQ ID NO: 42576 - protein, 222 aa, Helicobacter pylori
MLDYRQKIDALITKIEKARIAYSRHHIVKIVAVSKNASLEAIQHYYNCSQRAFGENKVQDLKTKMHSLEHLPLEWHMIGSLQENKINALLSLKPALLDSLDSLKLALKIEKRCEILGVNLNALLQVNSAYEESKSGVMPEGTLEIYSQISETCKRLKLKGLMCIGAHADDEKEIEKSFITTKKLFDRLKNASVLSMGMSCDFELAIACGANLLRIGSFLFKE

SEQ ID NO: 42577 - protein, 317 aa, Corynebacterium efficiens YS-314
MNELIKNLGDEERAHVLAEALPWLQHFRDKIVVVKYGGNAMVDDSLKAAFAADMVFLRTVGAKPVVVHGGGPQISDMLRRVGLEGEFKGGFRVTTPEVMEIVRMVLFGQVGRDLVGLINSHGPYAVGTSGEDAGLFTAEKRLVDIDGTPTDIGLVGNIVNVDATSLMDLIDAGRIPVVSTIAPGADGQVYNINADTAAGALASAIGAERLLVLTNVEGLYTDWPNKSSLVSKIVASELDAILPGLDAGMIPKMESCLNAVRGGVNAAHVIDGRIAHSVLLELLTMGGIGTMVLPDNYAREDYPEGTVFRKNYQDGHA

SEQ ID NO: 42578 - protein, 202 aa, Arabidopsis thaliana
  misc_feature (75)..(75): Xaa can be any naturally occurring amino acid
  misc_feature (78)..(78): Xaa can be any naturally occurring amino acid
  misc_feature (84)..(84): Xaa can be any naturally occurring amino acid
  misc_feature (86)..(86): Xaa can be any naturally occurring amino acid
  misc_feature (90)..(90): Xaa can be any naturally occurring amino acid
  misc_feature (98)..(98): Xaa can be any naturally occurring amino acid
  misc_feature (102)..(104): Xaa can be any naturally occurring amino acid
  misc_feature (107)..(107): Xaa can be any naturally occurring amino acid
  misc_feature (112)..(112): Xaa can be any naturally occurring amino acid
MASSMLSSATMVASPAQATMVAPFNGLKSSAAFPATRKANNDITSITSNGGRVNCMQVWPPIGKKKFETLSYLSXTLXRFRNWXKXSDYXIPAQWIPXVEFXXXSTXLGTVXSTVTHPETINERTGKWGSFPWSVDPPPSMFKGMEKGKKETPWLLRETGIQKPRKARGYFFWPKSPQFPGISPFFLGNPKIFPPFCYHPGV

SEQ ID NO: 42579 - protein, 402 aa, Corynebacterium efficiens YS-314
MKNLATVEDTLTSWPQVLLNTYGTPPVELVTGKGSTVTDADGNVYIDLLAGIAVNALGHAHPAIIEAVTTQLSQLGHVSNLFATRPVVEVAAELVQRFALDDATIASQTQVFFCNSGAEANEAAFKLARLTGRHRILAATNGFHGRTMGSLALTGQPDKRIPFAPLPSGVEFYPYGDLDYLTTLVESDPTDTAAIILEPIQGETGVIPAPEGFLTGVRELCDKHGLLFIVDEVQTGIGRTGDFFAHQHEGVTPDVVTMAKGLGGGLPIGACLATGEAAKLFGPGKHGTTFGGNPVSAAAARAVLSVIDEEFCADVARKGELFAEQLRGVAGVADVRGRGLMLGVVLDQPVAKQAVTAGFKHGLILNAPADNIIRLTPPLVITDDEIRDAVRALAAVLAELNA

SEQ ID NO: 42580 - protein, 318 aa, Corynebacterium efficiens YS-314
MTNPNVRHFLADDDLTPAEQAEVLTLAAELKRNPLAKRPLEGPLSVAVLFDKTSTRTRFSFDAGIAHLGGHAIVVDSGSSQMGKGETLQDTGAVLSRYVEAIVWRTYAQSNLTDMAETATVPIVNALTDDLHPCQILADLQTIVENLSPEQGPAGLKGKKAVYLGDGDNNMANSYMIGFATAGMDISIIAPSGFQPKQVFVDRARARAQETGATVTVTDNLDEVAGADVVITDTWVSMGMENDGIDRTTPFVPYQVNDEVMARANEDAIFLHCLPAYRGSEVSASVIDGPASRVFDEAENRLHAQKALLVWLLENQPG

SEQ ID NO: 42581 - protein, 350 aa, Rhodococcus sp. RHA1
MTTVETPRSSRSVVVTVAAVVEETSDARSLVFDVPDERRHEFAYKPGQFLTLRIPSDRTGSVARCYSLASSPFTDDLPKVTIKRVAGGYGSHWLCDNVGVGDRIEVLPPAGVFTPASLDEDLILFAAGSGITPVMSILKSALSVGNGKVVLVYANRDEKSVIFADELRELAARHEHRLTVVHWLESVQGLPTPRQLANLSDRFRDHRAYLCGPRPFMDAIHESLALAGVPRDRVHAEVFTSLSGDPFADVVVEELPDTEAGTSTVEVQLDGEAHNLSWPRRATLVDVMLSKGLDVPYSCREGECGSCACTVVQGEVDMDNASILDPEDIASGYILACQARPVSEHVRIEF

SEQ ID NO: 42582 - protein, 536 aa, Schizosaccharomyces pombe 972h-
MSTLEPEKRRQHEDKSNEIIDSPIFLNKISALPESENVHCLLLKQLIGSPQLKQTWQFNFCVDLNFLLENMHASVFPTVDVRITHGYDSKSDSLARLTAQMNHCPVNVKLYSVYVPMWGTHHSKIMVNFFKDDSCQIVIHTANLVEPDWIGMSQAIFKTPLLYPKANDSLSTSSVPEYGNPSKIRKHEGSLDIKDDRNCDIIDVDSAFENFKHKSDTRSSDDLGVIGRQFQQDFLAYLKNYRHTYELIEKLKMYDFSAIRAIFIGSVPGKFEGEEESSWGLGKLKKILKMLEKDSKKDEKTKFEESDICISQCSSMGSFGPKQEYIAELTDGFGCQRGNWKFLFPTVKEVQQSMLGWQSGSSIHFNILGKTAASQVETLKKGKNLCKWVAMKAGRQRVAPHIKTYMRFSNDGELLRWVLVTSANLSKPAWGTLEGHKAKSRSTRGLRIRSYEAGVLLYPKLFEESQRAPCIMTPTYKTNTPNLDEKRREFYGKRVIGVRMCWDFPPVEYEDKDEIWSPVINRTDKDWLGYVWPPNW

SEQ ID NO: 42583 - protein, 662 aa, Triticum aestivum
  misc_feature (541)..(541): Xaa can be any naturally occurring amino acid
  misc_feature (580)..(580): Xaa can be any naturally occurring amino acid
RHEVGEWQLTSWRSADDPSPGDYRRTLQTTGLPEIILWYRDVKTYRTGPWNGIYFNGVPEARAYAGKYPLLVTTSPWEITYGYTAAPGAPLTRVVVNYTGKAERLEWDASSREWNRIFQGPRDPCDEYGKCGPFGLCDPEAASSGFCGCVDGFSAANTSALVVKDNSDGCRRDVALDCAGGTTTDGFKVVPGMKLPDTHNASVDMGVTLEECRARCLANCSCLAYAAADIRGGGDGTGCVMWAYAIVDLRLVDRGQNLYLRLSKSEIGGRKRFPTLLVATTLPSAVTILLLVFMIWWRRKNRIIGAIPRNPTMAVPSVSLAIIKDITRNFSKSNIIGQGGFSIVYKGQLPEGRTIAVKRLKQTALTTKGKNDFAREVEVMVGLRHGSLVRLLAYCDEGKERILIYEYMQNKSLNIYIFGTPNLRASLDWVRRLELLREIAHGVAYLHAGSGESVIHRDLKPGNILLDDEWKPKIADFGTAKLFADNRTGHDQTIVISPGYAAPEYVRGGEMTLKCDVYSFGVILLETLSGQRNGSLQRLLXPQAWELWEQNRIIELLDMTIVPLPKSEPEILPELKRCIXIGLLCVQEMPDDRPAMPEVVAMFTSTTSQIDWPRRSVLDSRIVMPLNLSLELDTDHLNPTAIEVRSPSSRSSYCCLASNQSN

SEQ ID NO: 42584 - protein, 439 aa, Bacteroides thetaiotaomicron VPI-5482
MKVLKFGGTSVGSAQRMKEVAKLITDGEQKIVVLSAMSGTTNTLVEISDYLYKKNPEGANEIINKLESKYKQHVDELFATQEYKQKGLEVIKSHFDYIRSYTKDLFTLFEEKVVLAQGELISTAMVNFYLQECGVKSVLLPALEFMRTDKNAEPDPVYIKEKLQTQLELYPDMEIYITQGFICRNAYGEIDNLQRGGSDYTASLIGAAVKASEIQIWTDIDGMHNNDPRIVDKTAPVRQLHFEEAAELAYFGAKILHPTCIQPAKYANIPVRLLNTMDPDAPGTLISNDTEKGKIKAVAAKNNITAIKIKSSRMLLAHGFLRKVFEIFESYQTSIDMICTSEVGVSVTIDNTKHLNEILDDLKKYGTVTVDKDMCIICVVGDLEWENVGFEAKALDAMRDIPVRMISFGGSNYNISFLIRDCDKKTALQSLSDMLFNNK

SEQ ID NO: 42585 - protein, 625 aa, Ostreococcus tauri
  misc_feature (1)..(1): Xaa can be any naturally occurring amino acid
XRAPEVGGVHVVERSEGYVYARRCRARPPSRGSTPVGGHWRAQPWSTDIRGSPSSHDSWVPPRGPRTRPSHRASTVAVMTRTRPRARDVERDDGARDRRHRARARATMGGRRWARDDAMGANDDGRDDGAGRKMDVRARATSAPVVRASARAFEWKGAALKPLAASVAVGLAINFVVPRPEAVVPQAWALLAIFLSTISGLVLSPLPVGAWAFVGLTTAVVTGTLSFQNAFAAMTNDVIWLIVLAFFFARGFVRTGLGDRVATMFVRALGKSTLGLSYGLTISEAILAPAMPSTTARAGGVYLPIITSLAKQAGSEPGPTANKLGSFLIQTQLQSSGHSSAMCMTAAAQNLLSLKLAASLGVVIASPWISWFKAACVPAIIGLLVTPLLVYKLYPPEVKDTPEAPAEAARKLKELGPLSQDELMVVITMAITVFMWIFQPFGIKPVVAAMLGMSLQLVSGVITWAECLNEKGAWDTLLWFAVLIGMSAQLNALGFIDYLSSTVAGALTAANLAWPQVMLILHGCYFAIHYLFASQTAQVAALSTAFMAMMMASGAPPVLVGLTMAFHTNLFGAITHYASGQSACYYGAGFVELKDYFRLGAICGVVNVLIWGIFGGLWWKAIGLY

SEQ ID NO: 42586 - protein, 444 aa, Zea mays
GTDDDLPQSYQNSRGMKGSGRITGNGRDSVGASLYTRVQPQTDMETQIHELEQEAYCSVLRAFKAQSDAITWEKESLITELRKELQVSDKEHRELLNKVNGDDIIRRIRKWRESTGGLMINLVNNSQRTHDPIPSPTTSARKRQKMSQPILSACVPAPSAMHSQPLTAPMQPSSSGAKKGAQPGTKVKKTKPGQKIPGGSAVKSMPSSAGPGGRGTIINRNMSAGLPPESSQLNPLIGRKVMTRWPDDNSFYEAEITDYDASKDIYTLVYDINTADETWEWVDFKEMAPEDIRWDGEEPDLNLIGRGAPVHGMKSSSRGGPMSGTGRDRGPQKNSFKKDYPSQNGIGKKSVDYIEILHTETLIKEVERVFSSANPDPLEMERAKKALKEHEQSLIDAIARLAEASDDDRVRSLEYNRGWRNQHGGRYADDMTMDGHMAGDADAM

SEQ ID NO: 42587 - protein, 265 aa, Bacteroides fragilis YCH46
MIFLKTEDEIELLRQSNLLVGRTLAEVAKLVKPGVTTKELDKVAEEFIRDHGAVPTFKGFPNQYGDPFPASLCTSVNEQVVHGIPGDIVLKDGDIVSVDCGTYMNGFCGDSAYTFCVGEVDEEVRQLLKVTKEALYIGIQNAVQGKRIGDIGYAIQQYCESHSYGVVREFVGHGIGKDMHEDPQVPNYGKRGYGTLLKKGLCIAIEPMITQGDRQVIMERDGWTVRTRDRKCAAHFEHTIAVGAGEADILSSFKFIEEVLGDKAI

SEQ ID NO: 42588 - protein, 194 aa, Triticum aestivum
EGTKAAELFSTFFGKPGGLLRLKKSSEIGRINPEFAQGTKIPFRDGFPFLIASRGSRDARNEGLRDPVPINRFSPNILGEGSPPYAGDLGKPRKINKLPFAGGNLCARCKVPPINQEKGIPGGEPTETMGTFRSGEGIPPTPKNKQKVYFGQTLFSKEWVSPKGKGGFFKVGAPVYFLQTSPCSEEFPPWARPG

SEQ ID NO: 42589 - protein, 272 aa, Shewanella sp. ANA-3
MSQQKICFIGAGNMTRSIISGLIRSGYPAALVQATNPSQGKLDALAADFGVRVSQDNFSAAQDADVIVLSVKPQLMEQVCQALQGIDMSNKLVITIAAGIKAERYSQYLAQSITLVRTMPNTPMQIGVGMTGLYAPQPLSDAQQAIAERLMSSGGEIVWVNEESEINQVIALAGSSPAYFFLLMESMIDAGKQMGMDEAKARSLVQQAALGAAMMAKQNPELTLGNLRENVTSKGGTTAQAIATFEAADLRGVVKNAMENCIKRAEEMANTF

SEQ ID NO: 42590 - protein, 302 aa, Triticum aestivum
  misc_feature (116)..(116): Xaa can be any naturally occurring amino acid
  misc_feature (157)..(157): Xaa can be any naturally occurring amino acid
MATESPFRADVLRGKAALVTGGGSGICFEIAAQLARHGAHVAIMGRRREVLDKAVAALRSEGLRAVGFQGDVRNQEDAARVLASTVEHFGKLDILVNGAAGNFLASPEDLTPKGFXRTVLEIDTVGTYTMCYEALKYLKKGGPGRGPSTGGLIINIXRATLHYTASWYQIHVSAAKAGVDSITTRTLALEWGTDYEIRVNGIAPGPIGGTPGLRKLAPDEMGKGKREMMPLFKLGETRDIAMAALYLASDAGKYVNGTTMVVDGGLWLSHPRHIPKEEVKELSKVIEKKVRASGVGVPSSKL

SEQ ID NO: 42591 - protein, 188 aa, Legionella pneumophila subsp. pneumophila str. Philadelphia 1
MKKIICLLSNLVLTVGIMSAHAETAIIKTSEGNITCELFTKEAPNTVANFVGLATGTKEFKDIKTGKMVKRPFYNGLTFHRVIAGFMIQGGDPLGNGTGGPGYTFDNENTNASFNKPGVLAMANAGPNTNGSQFFITVAPTPELQGGYNVFGQVISGQEVVDKISKMPTDPQDKPITPVVIENITIQK

SEQ ID NO: 42592 - protein, 238 aa, Shewanella sp. ANA-3
MTTIADRLAVAQSRIAQAAQKCARLPHSIRLLAVSKTKPMEDIIAAYNAGQRCFGENYVQEGVTKIEALKATHPDIEWHFIGPLQSNKTALVAQHFDWMHTLSREKIAQRLNEQRPAHLAPLKVCIQINISDEYTKSGIDAEQMLPLADSISQLPHLQLRGLMAIPSATNDIAQQTDELSKLKQLFDTLKQHYPAVDTLSMGMSNDLDVAVECGSTMVRIGSAIFGERDYGVKDTTSN

SEQ ID NO: 42593 - protein, 172 aa, Bacteroides fragilis YCH46
MAGVNNRVKITNDIELKDRLVAINRVTKVTKGGRTFSFSAIVVVGNEEGIIGWGLGKAGEVTAAIAKGVESAKKNLTRVPVLKGTVPHEQSAKFGGAEVFIKPASHGTGVVAGGAMRAVLESVGVTDVLAKSKGSSNPHNLVKATIMALGEMRDARMIAQNRGISVEKVFRG

SEQ ID NO: 42594 - protein, 471 aa, Ralstonia metallidurans CH34
MAQSVADVMKLVNENDVKFVDFRFTDTKGKEQHVSVPVSHFDEDKFESGHAFDGSSIAGWKGIEASDMLLMPDSGTAYIDPFYEEPTLVLSCDVIEPSDGKGYDRDPRSIAKRAEAYLKSTGLGDTAFFGPEPEFFIFDGVTWNIDMQGCSVKIQSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSIWKDGQNLFAGNGYAGLSEFALYYIGGIIKHARALNAITNPGTNSYKRLVPGFEAPVKLAYSARNRSASIRIPYVSNPKGRRIETRFPDPLMNPYLGFSALMMAGLDGVMNKIHPGEAADKNLYDLPPEEDAKIPTVCSSLDQALEYLDNDREFLTRGGVFSNSMLDAYIELKMEEVTRFRMTTHPIEFDMYYSL

SEQ ID NO: 42595 - protein, 399 aa, Enterococcus faecalis V583
MNVSNRAQQLTPSVTLAAAAKAKALKAKGVDVLSLTVGEPDFVTPKNIQKAAIASIEDGRASYYTPSGGIPELKQAIVSYVEREYQLRYQPKQVIVTDGAKYALYLLFQAILNVGDEVIIPVPYWVSYGEQVKLAEGKPVFVSSTQEQSFKVSVAQLEAVRTDKTKAIILNSPSNPTGVIYTEEELRQIGEWAVAHNILIIADDIYGRLVYNGHRFTPIATISEAIRQQTIIINGVSKTYAMTGWRIGFAVGDEKIIQAMTQLASQSTSNPVAVSQYAAIEALTGEQSTVEDMRQAFEKRLNHIYPKVAALPGVSLIKPEGAFYLFPNVKKTLEICGYDNVTNWVEDLLQEAHVALVTGEGFGAPEHVRMSYATDLMTLEKAIERMNDFIEKKRIQHNA

SEQ ID NO: 42596 - protein, 285 aa, Burkholderia xenovorans LB400
MSSTTAPSDLTTSLDGSETADRARRFGGIARLYGAPALAAFEGAHVAVIGIGGVGSWVAEALARSALGTLTLIDLDNVAESNTNRQIHALDGNYGKPKVEAMAERIAAINPFCDVRLIEDFVEPDNFEATLGGGFDYVVDAIDSVRTKTALIAWCVEKKQPLITVGGAGGQLDPTRIRIDDLALTIQDPLLSKVRGQLRKQHGFPRGPKAKFKVSAVYSDEPLIYPEAAVCDIDMEAEHVSTSPGHTGPVGLNCAGFGSSVCVTASFGFAAAAHVLRALAKQATA

SEQ ID NO: 42597 - protein, 390 aa, Brucella abortus
MATIRVPTLGESVSIAVDEPLVELETDKVTVEVPAPAAGVLAEITAKEGDTVEVGALLGQISSDGAAVAAAPAQKKEEAKPAAAAPAAAPVASASSGPAMQPAPAAAKLLAESGLSADQVEGSGKRGQVAQRGHSSRPSRKAVSAAPAAPVAARPASSADDASREERVKMTRLRQTIAARLKDAQNTAAMLTTFNEVDMSAVMELRNKYKDRLEKKHGVKLGFMGFFTKAVTHALKEIPAVNAEIDGTDIVYKNFCHVGMAVGTDKGLVVPVIRDADQMSIAEVEKELARLARAARDGSLSMADMQGGTFTITNGGVYSLMSRDLCASRTLGMYKIQECPMVVGGQIVVRPMMYLALSYDHRIVDGKEAVTFLVRAKESLEDPEHLVLDL

SEQ ID NO: 42598 - protein, 488 aa, Mycobacterium tuberculosis H37Rv
MADPGGFLKYTHRKLPKRRPVPLRLRDWREVYEEFDNESLRQQATRCMDCGIPFCHNGCPLGNLIPEWNDLVRRGRWRDAIERLHATNNFPDFTGRLCPAPCEPACVLGINQDPVTIKQIELEIIDKAFDEGWVQPRPPRKLTGQTVAVVGSGPAGLAAAQQLTRAGHTVTVFEREDRIGGLLRYGIPEFKMEKRHLDRRLDQMRSEGTEFRPGVNVGVDISAEKLRADFDAVVLAGGATAWRELPIPGRELEGVHQAMEFLPWANRVQEGDDVLDEDGQPPITAKGKKVVIIGGGDTGADCLGTVHRQGAIAVHQFEIMPRPPDARAESTPWPTYPLMYRVSAAHEEGGERVFSVNTEAFVGTDGRVSALRAHEVTMLDGKFVKVEGSDFELEADLVLLAMGFVGPERAGLLTDLGVKFTERGNVARGDDFDTSVPGVFVAGDMGRGQSLIVWAIAEGRAAAAAVDRYLMGSSALPAPVKPTAAPLQ

SEQ ID NO: 42599 - protein, 371 aa, Lactobacillus crispatus
  misc_feature (158)..(158): Xaa can be any naturally occurring amino acid
ESTDGLRRGMKVEDTGAPISVPVGEDTLGRVFNVLGQPIDGGPEFSKDHPREGIHKEAPKYEDLTTSREILETGIKVIDLLEPYVRGGKVGLFGGAGVGKTTIIQELIHNIAQEHGGISVFTGVGERTREGNDLYFEMKASGVLSKTAMVFGQMNEPXGARMRVALTGLTLAEYFRDVEGQDVLLFIDNIFRFTQAGSEVSALLGRMPSAVGYQPTLATEMGQLQERITSTKKGSITSIQAVYVPADDYTDPAPSTTFAHLDATTNLERSLVEQGIYPAVDPLESTSSALDPEVVGQEHYEVATRVQHVLQRYHELQDIISVLGMDELSDEEKLIVARARKVQFFLSQNFFVAEQFTGVPGSYVPIKESIK

SEQ ID NO: 42600 - protein, 108 aa, Triticum aestivum
MASATLLKSSFLPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 42601 - protein, 493 aa, Coccidioides immitis RS
MPPTRSLRQRAVTNENDENAPTTRLTRAKAAAASSHENQLNAAAAKRPLQSKKSSLNSANTGAQRKRAALGDVSNVNKSEGVETMDAKELKKGTTSRVGLTSKATTQTGGVQKITRSNTSRSALGVRDANKREAEPKRPGSGSGVMGSAQLKRQQSQKFLSANENNAVTDEPPRKRIDSGKKTTAFQEEAKLEETDSVPTEEPQDADKPLNLDAEDQFDPLMASEYVIEIFDYLKEIEPQTMPNPDYIEHQEELEWEVRGVLIDWLIEVHTRFRLLPETLFLAVNIIDRFLSIDIVALDRLQLVGVAAMFIASKYEEVLSPHVANFSHVADETFTDKEILDAERHILATLNYDISYPNPMNFLRRISKADNYDVQTRTFGKYFMEISLLDHRFMRYRQSHVAAAAMYFARLILDRGPWDVTIAHYAGYSKEEIIPVFHLMIDYLYRPVAHEAFYRKYANKRFLKASLHARHWAKKYRSMYLSQESYENRQRHS

SEQ ID NO: 42602 - protein, 229 aa, Brassica napus
STHASEKCCSVFRVVSLCMSPINDSFMSGSLDRSVRLWDLRVNACQGILHLRGRPAVAYDQQGLVFAIAMEGGAVKLFDSRCYDKGPFDTFLVGGDTAEVNDIKFSNDGKSMLLTTTNNNIYVLDAYHGEKKCGFSLEPSQGTSLEATFTPDGKYVLSGSGDGTLHAWNIENPSEVARWENNIGVASCLKWAPRRAMFVAASTVLPLWIPNDGEAPAPADPSADQQRPQ

SEQ ID NO: 42603 - protein, 371 aa, Lactobacillus johnsonii
  misc_feature (216)..(216): Xaa can be any naturally occurring amino acid
ESTDGLRRGMEVEDTGGPISVPVGKDTLGRVFNVLGDPIDGGPALGKDVKREGIHKEAPKYDELSTSEEILETGIKVIDLLEPYVRGGKVGLFGGAGVGKTTIIQELIHNIAQEHGGISVFTGVGERTREGNDLYFEMKASGVLSKTAMVFGQMNEPPGARMRVALTGLTIAEYFRDVEGLDVLLFIDNIFRFTQAGSEVSALLGRMPSAVGYQPXLATEMGQLQERITSTKKGSITSIQAVYVPADDYTDTALSTTFAHLDATTNLERRLVEQGIYPAVDPLESTSSALDPEIVGEEHYEVAVKVQHILQRYQELQDIISVLGMDELSDDEKLIVERARKIQFFLSQNFFVAEQFTGIPGSYVQSRKQLK

SEQ ID NO: 42604 - protein, 327 aa, Nostoc sp. PCC 7120
MTMPKKLLQTIKPFLKTVFTLGLVLALALGHADGALAARSGGRIGGGSFRAPSSRTYSPRYAPPGGGYGYSPYPGGGFGFPFLLPLWGIGGGFGGLFGILVFFAIANFLVQTFRRVSSGEVSEDVGYNSNPTVTVTRLQVGLLAQARDLQPELNHIAETADTNSPTGRTEVLQEASLALLRHPEYWVYAGAGTQQAKLNSAESQFNRLALAERSKFSEETLSNINNQLKAARTKDALPGADEIDNPTRLITEGPGEYIIVTLLAATLGKFELPAVNSSDDLRQALRQIGSIPSEQLLAFEVLWTPQAEGDTLTSDDLFAEYPDLKLV

SEQ ID NO: 42605 - protein, 650 aa, Nostoc sp. PCC 7120
MVKSAPPPTTGRKPSKVEGLKENSNFLREPVATQILEDTTHFTEDAVQILKFHGSYQQDNRDNRTKGQEKDYQFMLRTKNPGGLVPPQLYLALDKLADEYGNHTLRATTRQGFQMHGILKKNLKAAIATIVRNLGSTLGACGDINRNVMAPPAPFKNRAEYQYAWEYAQNIADLLSPQTGAYYEIWLDGEKAISAEESPEVKAARQSNGNGTIIHDTEEPLYGTYYMPRKFKVSVTVPGDNSIDLYSQDLTLVVLTDKKGNLEGFNIFAGGGLGRTHNKEETFARLADPIGYVAKEDVYSAVKAIVATQRDYGDRTDRRHARLKYLINDWGVDKFRAKVEEYFGKPIAPFKQLPEFKYHDFLGWHEQGDGNLFLGISIDNGRVKDEGAFQLKTALREIVEQFNLPIRLTPNQNLIFYEITPENKPAIQAILDRCNVVSDPTTIEPLVRYAMACPALPTCGLAITESERAIPGILERIRTLLDKLGLQNEHFVVRMTGCPNGCARPYMAELGFVGSAPESYQVWLGGSPNQTRLAQPYVEKLHDNDIESFLEPIFVYFRKYRKSGESFGDFCDRVGFDAIREFVAEYQPETTPVTIEPEQPEVVSKSRKARYRVSLHDDLYNKVKATATSQGRSMTDLVKDALEAYFQSLS

SEQ ID NO: 42606 - protein, 453 aa, Pseudomonas fluorescens Pf-5
MEITTMNQPQSAVGNCLDVQSFINAQPLSRYQWRVVILCFLIVFLDGLDTAAMGFIAPALSQDWGIDRASLGPVMSAALIGMVFGALGSGPLADRFGRKVVLVGAVLLFGAFSLASAYSTNVDQLLVLRFLTGLGLGAGMPNATTLLSEYTPERHKSLLVTSMFCGFNLGMAGGGFISAKLIPAFGWHSLLLIGGVLPLILALVLVLWLPESARYLVVRNRGTDKVRKTLAPIAPAIVGEAGSFSVPEQKTVKARNVFAVIFSGTYSVGTLLLWLTYFMGLVIVYLLTSWLPTLMRDSGASMEQAAFIGALFQFGGVLSAVAVGWAMDRFNPHKVIGCFYLLAGVFAYAVGQSLGNITLLATLVLIAGMCVNGAQSAMPSLAARFYPTQGRATGVSWMLGIGRFGAILGAWMGATLLGLGWNFEQVLTALVIPAALATTAVVIKGMVSHADAT

SEQ ID NO: 42607 - protein, 565 aa, Anabaena variabilis ATCC 29413
MSLTNSIHFRNLQGDLFGGLTAAIVSLPLALAFGVASGAGAVAGLYGAVCVGFFAALFGGTPTLISEPTGPMTVIMTAVISSMTASNPEDGLAMAFTVVMLAGIFQILFGIFKLGKYITLMPYSVISGFMSGIGVILVILQIAPFLGQPSPKGGVLGMVQNLPQLLTQINPVETTLGLLTLAIIFFMPRQLKRFAPPQLVALIVGTIVSLTIFGAADIRRIGEIPAGLPTLQIPTFTPSQITIMIVDGAILGMLGCIDTLLTAVIAESLTRTEHKPDKELIGQGIGNLISGLCGGLPGAGATMGTVVNIQTGARTALSGLTRALILLVVVLWAASITQPIPMAVLAGIALKVGIDILDWSFLKRAHKVSFKATIIMYSVLFLTVFVDLIVAVGVGVFIANILTIERLSQLQSEDVRMISDTDDAIVLNEQEKQLLKQAHGRVVLFHLSGPMIFGVSKAIARKHSAMVNYDVLIVDLSNVPFLGVTASLAIENAIKESSEQGCYVLIVGASNKVKQRLEKFGIIGFVPLHHMFVDRLEALKQAVALVNHHAGSDNFAVSILPDTHQ

SEQ ID NO: 42608 - protein, 278 aa, Bacteroides thetaiotaomicron VPI-5482
METVRLNNGVEMPILGYGVYQVTPEECERCVLDAISVGYRSIDTAQAYYNEEGVGNAVRKCGVPREELFITTKVWISNGGYEKAKASIDESLRKLQSDYVDLLLIHQPFNDYYGTYRAMEEAYKAGKARAIGVSNFYPDRFIDLAEFCEIKPAVNQVETHVFNQQVKPQEIMKKYDTKVMSWGPFAEGRNNFFSNEVLKAIGEQYGKSVAQVALRFLIQRDIIVIPKSTRKERMIENFDVFDFTLSVKDMEEIAGLDKKESLFFSHYDPEMVNFLINL

SEQ ID NO: 42609 - protein, 195 aa, Triticum aestivum
MAAFGGNGCCYSSGSEDEEEEGAEGYRKGGYHAARPGDRFAGGRFVAQRKLGWGNFSTVWLAYDTLLSRFVALKIQKSARDYAHAALHEIELLSAAAKGDPTSSKCVIQLLDHFKHAGPNGKHICLVTEFLGDSLLRLIRYNRNKGIGLSRVREIRRSVLTGLDYMHRELGIIHTDLKPENVLLVSTINPSKDPV

SEQ ID NO: 42610 - protein, 489 aa, Zea mays
MDLADSQQQRLIAGAALLVATVAFFRFLLRSRSGGKRLPPTIPGAPVVGGLVKFMRGPIPMIREQYARLGSVFTVPIISRKITFLVGPEVSAHFFKGNEAEMSQQEVYRFNVPTFGPGVVFDVDYSIRQEQFRFFTEALRANKLRSYVDQMVVEAEEYFSKWGESGTVDLKYELEHLIILTASRCLLGREVREKLFDDVSALFHDLDNGMQPISVLFPYLPIPAHKRRDRARARLAEIFATIIKSRKASGQSEEDMLQCFIDSKYKNGRSTSEGEVTGLLIAALFAGQHTSSITSTWTGAYMLRFKQYFAEAVEEQKDVMRRHGDKIDHDILAEMDVLYRCIKEALRLHPPLIMLLRQSHSDFTVTTKEGKVYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLVVDN

SEQ ID NO: 42611 - protein, 455 aa, Picrophilus torridus DSM 9790
MLKRFPERGIPLDEINSILDGYGKNDIKNSRGRLFTYFYDPGLKDLDDLSSILLKFYNRNGMDYHAFPSTLKIENDLISMMSDLMHGNDDTSGTFTTGGTESILLAMKAARDLFLEKKEYVPEIVAPVTAHPAFSKAAKYLGMKITRVPVNEDYIADDTINEYINDRTAAVIASAPSFPYGGIDNIKDISEIALDKNTWFHVDACVGGMILPFLKGLGLNIKDFDFKLPGVSSMSIDLHKYGFTPKGSSVVLYKNHDLRKRQIYVNADWPGYPMSNMGMQATKSAGPLAGSWATLNYLGLDGYKKLAEKTLKAYRMIRSGITDLGYKIIGRPDATIFAFTHNDKDIIDLGIKMIENGWYPQIQPGNVFIDMPDSVHLNISPVHLDVADEFLEFFNELDKNVKPRDKNSYNVNSVEKALEMIKMEKSMLFRIIRYSRPEVSEKIFLEMTDEDFTYS

SEQ ID NO: 42612 - protein, 340 aa, Xylella fastidiosa Dixon
MIPVINQEKPGISGDFRLSVAPMMNWTDRYCRVFHRVLAPSARLYTEMVHAKAVIYGDRERLLGFASVEQPVALQLGGSEPALLAKAARIAVDWGYSEINLNCGCPSDRVQAGSFGACLMREPALVADCVAAMAAVVSVPVTVKCRLGVNEDDDYGRFAKFVDWVSRASSSRMIVVHARNAWLQGLSPKENREIPPLRYDWVYRLKRERPELAVVLNGGITSVEAGLDHLLMVDGVMLGRAAYQDPYILHQFYCALSNAPLLPRTLLLRALRPYVEAWLEQGLALRHIVRHLLGLFHGQPGGRVFRQVLTQGGQRSDADWSLVEQALSIIEGQETYAAVV

SEQ ID NO: 42613 - protein, 316 aa, Picrophilus torridus DSM 9790
MSDIKENVLNAIGNTPLVKLNKINVKNIEIYVKLEYYSPGMSIKDRIALGMIEDAERKGLIEPGDTIIGKTSGNTGIGLAIACAVKGYRFVAVMSAGNSAERQKILRALGAEVVLVPQQPGEEPGRISRKDNDAVEKKTQELTEKLNAYRPNQYINSMNWKVHQHTTGQEIIRQTSGRLDAFVAYIGTGGTFVGIARALKSFNNDIKCYPVEPDVAAFLAGKKVITTQHLIQGGGHAVKPPFWDESIVDGYIQVSEDEAIKTARALAKNEGILTGFSGGANVAAAAKLDDSLRPGSIVVTVLPDTGLKYLSTVLYE

SEQ ID NO: 42614 - protein, 290 aa, Parvularcula bermudensis HTCC2503
MAKYDLNNKVVLITGATGGIGAATARELANKGANLVLVDLDEEKLKALAAEFQQGQALVAPGDVTDAARMKEIVDEAVATYGKLDVALANAGIAGNPPSTSLTASREEVEKVMEVNIMGVWRTVHPCLEEIVKNNGYVMITASVYSFFNGVANLPYATSKAAVEMMSRSLRAELAGSGAKAGALYPGWVKTPIIEQAFGGNEIATNMIKGALPAFMRTPIPAERLAKAAVKGMEKRATRTIEPKFWAMFSAFRGLFQNGTDLLLDVHKKNHGQLRKLDDWNRERLAKQNS

SEQ ID NO: 42615 - protein, 484 aa, Oryza sativa Japonica Group
MEMTTTKRQQDHQVETMTTKKIDEEDEEVDDDGRAKRRGTVWTAASHIITAVIGSGVLSLAWAIAQLGWVVGPTVMLLFAAVIYFTSNLLADCYRTGDPATGRRNYTYMDAVKANLGGAKVKVCGCIQYLNLLGVAIGYTIAASISMMAIQRSNCFHARGEQDPCHASSNVYMIMFGIVQVFFSQIPDFDQVWWLSILAAVMSFTYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 42616 - protein, 307 aa, Sinorhizobium meliloti 1021
MDSKTTKPMPTEAGIRAFHERCEAFYPADAVNASVEQQRQWYDALCAEFDAPSPEGLTRRDERVAGRIPVRYYRPAEVASGTRVFYIHGGGFVVGSLESHDAICAELAHGAQVELVSVDYRLAPEHLWPAAFEDCCDVLEALLADGRPLVVAGDSAGGNLSAGIVLKAKAEGLAGIVGQVLIYPGLGGDLTRGSYIEMAQAPLLSTADVDYYREVLKAPADEPFAHPLRAADLSGLPPAYVSGAYFDPLRDDARAYAARLAQAGVDVTYREEPQMVHSWLRARRMSPGAREGFVRLVQAVARLAGTA

SEQ ID NO: 42617 - protein, 427 aa, Ralstonia metallidurans CH34
MATPNLPSSKPEPVSSGAWTTLWSSTFAFTICFAVWMLFAVLGIPLKKELGLNDTEFGLLAATPVLSGSLIRVPLGIWTDRYGGRIVFFVLMLLTVIPIWLISYAHTLWQLLVLGLFVGLAGGSFSVGTPYVARWFPRSRQGLAMGIFGAGNSGAALTKFVAPALILAAGTWEIVPRVYSVAMLITAIVFWLFSRSNPAHRVSSATSWRAQLAVMRDPRVWRYSQYYSVVFGGYVGLSLWMTKYYIGEYGFDMKTAAFLAACFSLPGGVLRAIGGWISDRYGAHRTTWWVMWVSWVTFFLLSYPRSDFTIHTANGPESFHIALSPTVFTILMFVVGIAFAVGKASVFKFISNDFTHNIGAVSGVVGLAGGLGGFILPILFGALADLTGIRTSCFMLMYGAVCVSLVWMHYSQRAANARPTPETLQAA

SEQ ID NO: 42618 - protein, 314 aa, Glycine max
MEKPGGGGVLSAKEAFEKLEKVGEGTYGKVYRAREKATGKIVALKKTRLHEDEEGVPPTTLREVSILRMLSRDPHVVRLMDVKQGQNKEGKTVLYLVFEYMDTDLKKFIRSFRQTGQTVPPQTIKSLMYQLCKGVAFCHGHGILHRDLKPHNLLMDPKTMMLKIADLGLARAFTVPIKKYTHEILTLWYRAPEVLLGATHYSMAVDIWSVGCIFAELVTKQALFPGDSELQQLLHIFRLLGTPNEDVWPGVSKLMNWHEYPQWNPQSLSTAVPSLDELGLDLLSQMLKYEPSKRISAKKAMEHAYFDDLDKRHL

SEQ ID NO: 42619 - protein, 429 aa, Anabaena variabilis ATCC 29413
MVSMPTLPLEGASPAHICPFDQACSYLEAAAKELRLDQGTLEILSHPRKVVTVSIPVRLDNGDIRVLAGHRVQHSDILGPYKGGTRYHPAVTLREVSALAMLMTWKCALLGIPYGGAKGGIAINPQHYSVGELEKITRRYTSELIKDIGPAVDIPAPDVGTSAREMAWMMDTYSVNVGHAVPGVVTGKPISIGGSRGREMATGRGVMIIVREALADMGRTLEGVKVVIQGFGNVGGAAAELLYQAGAKILAVSTGAGGLFAADGLDIPALKAYAAENHRSIVGFPQAVAISNAELLTLPCDVLIPAALENQITEENVDQIQAQIVAEAANGPVTLEANRVLEGRGVTVLPDILANAGGVVVSYLEWVQGLSYLFWDEERVNREMEHLMVQAYHQVIKQSQMRQVPLRLAAYTLGVGRVAQALSDRGLYP

SEQ ID NO: 42620 - protein, 182 aa, Zea mays
  misc_feature (56)..(56): Xaa can be any naturally occurring amino acid
  misc_feature (72)..(72): Xaa can be any naturally occurring amino acid
  misc_feature (96)..(96): Xaa can be any naturally occurring amino acid
  misc_feature (99)..(99): Xaa can be any naturally occurring amino acid
MQNRYSSEIPLVLIQAVLYIGVIAVTRLARPTLNKMCYNRRMEKNTMFLLSVLRVXAAWSILAAYTIPFFIXPRTVHPLLGWPLYLLGSFALSFIXINXFLFHPITVLTTWFGFIGALLVMAFPWYLNGFVRALAVFAYAFCCAPLIWASLVKTMSSLQVLIERDAFRLGEPSQNAEFTKLY

SEQ ID NO: 42621 - protein, 487 aa, Staphylococcus aureus subsp. aureus MW2
MGEFKGFMKYDKQYLGELSLVDRLKHHKAYQQRFTKEDASIQGARCMDCGTPFCQTGQQYGRETIGCPIGNYIPEWNDLVYHQDFKTAYERLSETNNFPDFTGRVCPAPCESACVMKINRESIAIKGIERTIIDEAFENGWVAPKVPSRRRDEKVAIVGSGPAGLAAAEELNLLGYQVTIYERARESGGLLMYGIPNMKLDKDVVRRRIKLMEEAGITFINGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 42622 - protein, 501 aa, Escherichia coli
  misc_feature (23)..(23): Xaa can be any naturally occurring amino acid
METKDLIVIGGGINGAGIAADAXGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLNVYNTHFKKQLSRDDIVWTYSGVRPLCDDESDSPQAITRDYTLDIHDENGKAPLLSVFGGKLTTYRKLAEHALEKLTPYYQGIGPAWTKESVLPGGAIEGDRDDYAARLRRRYPFLTESLARHYARTYGSNSELLLGNAGTVSDLGEDFGHEFYEAELKYLVDHEWVRRADDALWRRTKQGMWLNADQQSRVSQWLVEYTQQRLSLAS

SEQ ID NO: 42623 - protein, 371 aa, Lactobacillus helveticus
ESTDGLRRGMKVEDTGAPISVPVGEDTLGRVFNVLGQPIDGGPEFSKDHPREGIHKEAPKYEDLTTSREILETGIKVIDLLEPYVRGGKVGLFGGAGVGKTTIIQELIHNIAQEHGGISVFTGVGERTREGNDLYFEMKASGVLSKTAMVFGQMNEPPGARMRVALTGLTLAEYFRDVEGQDVLLFIDNIFRFTQAGSEVSALLGRMPSAVGYQPTLATEMGQLQERITSTKKGSITSIQAVYVPADDYTDPAPSTTFAHLDATTNLERSLVEQGIYPAVDPLESTSSALDPEVVGQEHYEVATRVQHVLQRYHELQDIISVLGMDELSDEEKLIVARARKVQFFLSQNFFVAEQFTGVPGSYVPIKESIK

SEQ ID NO: 42624 - protein, 420 aa, Wolbachia endosymbiont of Drosophila ananassae
SGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFKAKRYIDEIKKSAPNLYNLCFKYFTPQERFLYLKQRDFAGIEGISIDYLVMEKAKNVAMIEANFDWLDVGTWNSVLELSEKFSKEPVSFQHVIREKEPVSTTKSNKNLLGGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSISSPLEIVEFQIGEHLSDNDIVRLDDVYGRF

SEQ ID NO: 42625 - protein, 407 aa, Dehalococcoides sp. VS
MPSSITALRSRRAAALLAPLALACAAFLAPTLLAPAHAADRISGKTFATRSEVYAPHAMAATSHPLTTQIALDVMKAGGSAVDAAIAANAALGLMEPTGNGVGGDLFAIVWDPKTKKLYGYNGSGRSPKSLSLAEFQKRGLKEIPPHGPLPVTVPGAVDGWFALHERFGRKPMADNLAPAIRYAREGHPVHEVIAYYWNASVPRLSKWPGFKEQFTIDGRAPRTGEMWKNPNLAHTLEQIAQGGRDAFYKGDIARTVGAYFKANGGFLSYEDMAAHHGEWVDPVSSNYRGYDVWELPPNGQGIAALQILNILEGYDLKSYGFGSVEHLHLFAEAKKLAFADRARWYADPAFEKSSPVAKLISKDYAAQRRKLIALDKVLKEAQPATPAQLDQGDTIYMTVADTDGIL

SEQ ID NO: 42626 - protein, 337 aa, Triticum aestivum
  misc_feature (219)..(219): Xaa can be any naturally occurring amino acid
  misc_feature (258)..(258): Xaa can be any naturally occurring amino acid
  misc_feature (274)..(274): Xaa can be any naturally occurring amino acid
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSTGILCSYDPYVRLPLWPSAQARRDGIMSIWREADFFIGVPRPRGALXTTGNPTHRRERLSLVLEEVEDSMLMSPREKGAVLHQDFXGSCPVLVNTVDTTGAXDAFVGSLLVSVSKDDSIFYNEAKLREVLQFSNACGAICTTKKGAIPALPTTATALELISKGSN

SEQ ID NO: 42627 - protein, 796 aa, Pyrococcus furiosus DSM 3638
MSEKKKEVKLKVASAYQRDVGRGIVRIDRETMRELGISPGDVVEIIGTKNTAAIAWPAYPEDEGLGIIRMDGTIRKNAGVGLGDEVIVRKADVKEARKVVLAPTEPIRFGRDFIEWLHERLIGRPVVRGDYIKVGVLGQELTFVVTTTQPAGVVQITEFTDFDVSERPVKEVEKRITTGVTYEDIGGLKDVIEKIREMIELPLKHPELFEKLGIEPPKGVLLYGPPGTGKTLLAKAVANEANAYFIAINGPEIMSKYYGESEERLREVFREAEENAPAIIFIDEIDAIAPKREEVTGEVEKRVVAQLLTLMDGLKSRGKVIVIGATNRPDAIDPALRRPGRFDREIEIGIPDKQGRKEILQIHTRGMPIEPDFRKDDVLKILEELRGEEKFKDVIDRAIDQVSKAKEEEIQQVLKRISQDLYEEVKARLIDKLLEELAEVTYGFVGADLAALAREAAMAALRRLIREGKIDFEAETIPREVLEELKVTRRDFYEALKMVEPSALREVLIEIPNVHWDDIGGLEEVKQQLREAVEWPLKYPEAFRAFGITPPKGILLYGPPGTGKTLLAKAVATESQANFIAIRGPEVLSKWVGESEKRIREIFRKARQAAPAIIFIDEIDAIAPTRGTDVNRVTDRIINQLLTEMDGIVENSGVVVIGATNRPDIIDPALLRPGRFDRLILVPAPDEKARLEIFKVHTRGMPLADDVDLKELARRTEGYTGADIAAVCREAALNAMRRALEQGIIKEGMKADEIRKVAKVTMKDFEEALKKIGPSVSKETMEYYLKVQEKFKQARG

SEQ ID NO: 42628 - protein, 411 aa, Enterococcus faecalis V583
MMDAATIRQSFPILFQEVNDEPLVYLDNAATTQKPTAVLDVLRHYYETDNANVHRGVHTLAERATKDYEASREKVRQFIHAKETAEVLFTRGTTTSLNWIAKSYGDLAVTAGDEIVISYMEHHSNIIPWQQLAQRTGAILKYIDVTEDGFLDMASARQQITEKTKIVSIAHVSNVLGVINPIEELTQLAHQNGAVMVVDGAQAVPHMPVDVQAIDADFYAFSGHKMCGPTGIGVLYGKRHLLEQMEPVEFGGEMIDFVHLQESTWKELPWKFEAGTPNIAGAIALGAAIDYLTEIGLEAIHQHEAALVHYVLPKLQAIEGLTIYGPQDPKDHTGVIAFNIEGLHPHDVATALDMEGVAVRAGHHCAQPLLNYLSVPATARASFYLYNTKEDADRLVEAIKATKEFFQHGTF

SEQ ID NO: 42629 - protein, 584 aa, Mycobacterium avium 104
MSDPIHALGEPGSPASALGPRQRAAAWDRLGAEQFDVVVIGGGVVGSGCALDAATRGLKVALVEARDFASGTSSRSSKMFHGGLRYLEQLEFGLVREALYERELSLTTLAPHLVKPMPFLFPLTNRLWERPYIAAGIFLYDRLGGAKSVPAQKHLTRAGALRLCPGLKRSALIGGIRYYDTIVDDARHTLTVARTAAHYGVVVRNSTQVVALLREGDRVTGVRVRDSEDGSVTEVRGHVVVNATGVWTDEIQALSKQRGRFQVRASKGVHVVVPRDRIVSDVAIILRTEKSVMFVIPWGSHWIIGTTDTDWDLDLAHPAATKADIDYILSTVNTVLAIPLTHADIDGVYAGLRPLLAGESEETSKLSREHAVAVPAPGLVAIAGGKYTTYRVMAADAIDAAAQFIPARVAPSITEKVSLLGADGYFALINQAEHVAQLRGLHPYRVRHLLDRYGSLIGDVLALAADRPDLLNPITEAPGYLRVEALYAVTAEGALHLEDILARRMRISIEYSHRGVDCAREVADVVAPVLGWTAGDVEREVANYTARVQAEILSQAQPDDVSADELRASAPEARAEILEPVPLN

SEQ ID NO: 42630 - protein, 294 aa, Pyrococcus furiosus DSM 3638
MKLDVICMGNLNYDITFMLERFPEFHEKVNAKKVYTGLGGSAGNTATWLSFLGLRVGFIGAVGNDDFGRLHLEFFEKIGVDTRGIKVVDEPTGVAVMMVIGEDKRIVKYPGANRFKEVKENYLKLARHLHLSSNPLPLVEKAVNLAKNLGLTVSFDPGEMEVPKHIEEKIDILMMNEDEFKRKYGSLEKITELKSRIAIATLNGGGALVRDENGNVYEIRGLSAKAIDTTGGGDSFDAGFIYGYLNGWDVKDSAKLGMLLAYLTVQKVGARSAVIPLDEVKKIAKELGLDLPFQ

SEQ ID NO: 42631 - protein, 150 aa, Actinobacillus pleuropneumoniae
MDMPPGTGDIQLTLSQQIPVTGAVVVTTPQDIALLDAVKGISMFQKVSVPVLGIIENMSVHICQNCGHHEDIFGTGGAEKVAKKYGTKVLGQMPLHIRLRQDLDAGTPTVVAAPEHETSRAYIELAAKVASELYWQGSVIPSEIMIREVK

SEQ ID NO: 42632 - protein, 338 aa, Ralstonia metallidurans CH34
MTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQEDAAKA

SEQ ID NO: 42633 - protein, 758 aa, Zea mays
  misc_feature (24)..(24): Xaa can be any naturally occurring amino acid
  misc_feature (48)..(48): Xaa can be any naturally occurring amino acid
  misc_feature (90)..(90): Xaa can be any naturally occurring amino acid
LMTKILLLLLLLALPLPAALALTXAEGLALLTFKAAATDDPHSALSRXWPESDQDPCRWPGVICANASSSAPSAAPRVVGLAVAGKNISXGYIPSELGSLLFLRRLNLHGNRLSGVIPAALSNASSLHSLYLYGNRLTGGLPVALCDLPHLQNLDVSGNALSGELPLDLRGCRSLQRLVLARNAFTGELPAGVWPEMPNLQQLDLSSNAFNGSIPPDLGELPRLAGTLNLSHNHFSGVVPPELGRLAATVTLDLRFNNLSGAIPQTGSLASQGPTAFLNNPGLCGYPLQVPCRAVPPPTESPTPPATTTPLPSTASSDQHQPIRTGLIALISVADAAGVALVGVILVYMYWKVKDRKGRRDGGGDDSSKSGLCRCMLWRHGGSDSSDASSGDGDGEGKYSGGEGELVAMDRGFRVELDELLRSSAYVLGKGGKGIVYKVVVANGTTPVAVRRLGGGGGGADRCKEFAAEARAVGRVRHPNVVRLRAYYWSADEKLVVTDFVGNGNLTTALRGRPGQTVLSWSARLKIAKGAARGLAYLHESSPRRFVHGEVKPSNILLDADFTAHVADFGLARLLAVAGCAPDGPPSTGGAGLLGGAIPYVKPPATGTGPDRFGAGGGYRAPEARAPGAKPTQKWDVFSFGVVLLELLTGRGPAADHASPSTSASFSAPVSGSTATDRSGSGEHGGGAVPEVVRWVRRGFEEDVRPLAEMVDPALLRGPALPKKEVVAAFHVALQCTESDPELRPRMKAVADSLEKIG

SEQ ID NO: 42634 - protein, 401 aa, Shigella flexneri 2a str. 2457T
MNVFNPAQFRAQFPALQDAGVYLDSAATALKPEAVVEATRQFYSLSAGNVHRSQFAEAQRLTARYEAAREKVAQLLNAPDDKTIVWTRGTTESINMVAQCYARPRLQPGDEIIVSVAEHHANLVPWLMVAQQTRAKVVKLPLNAQRLPDVDLLPELITPRSRILALGQMSNVTGGCPDLARAITFAHSAGMVVMVDGAQGTVHFPADVQQLDIDFYAFSGHKLYGPTGIGVLYGKSELLEAMSPWLGGGKMIHEVSFDGFTTQSAPWKLEAGTPNVAGVIGLSAALEWLADYDINQAESWSRSLATLAEEALAKRPGFRSFRCQDSSLLAFDFAGVHHSDMVTLLAEYGIALRAGQHCAQPLLAELGVTGTLRASFAPYNTKSDVDALVNAVDRALELLVD

SEQ ID NO: 42635 - protein, 430 aa, Schizosaccharomyces pombe 972h-
MSEEVVQDAPLENNELNAEIDLQKTIQEEYKLWKQNVPFLYDLVITHALEWPSLTIQWLPDKKTIPGTDYSIQRLILGTHTSGNDQNYLQIASVQLPNFDEDTTEFTPSTIRRAQATGSYTIEISQKIPHDGDVNRARYMPQKPEIIATMGEGGNAYIFDTTCHDALTTGEALPQAVLKGHTAEGFGLCWNPNLPGNLATGAEDQVICLWDVQTQSFTSSETKVISPIAKYHRHTDIVNDVQFHPQHEALLASVSDDCTLQIHDTRLNPEEEAPKVIQAHSKAINAVAINPFNDYLLATASADKTVALWDLRNPYQRLHTLEGHEDEVYGLEWSPHDEPILASSSTDRRVCIWDLEKIGEEQTPEDAEDGSPELLFMHGGHTNRISEFSWCPNERWVVGSLADDNILQIWSPSRVIWGRDHVQVSPRDLE

SEQ ID NO: 42636 - protein, 431 aa, Coprinopsis cinerea okayama7#130
MSTGLGFRLSRGVRTTISPPIPRAYEWAAQYKPTPNRPLLDMSQGVPGIPPPQFLRDAIAEASRYPNSFGYTRWDGEPTLRAALADEMKLSYGRDADITVDDVALTAGCNLAFVAVAMTLADAGDEVILPVPWYFNHQMDLNLLGIKTVGLHTAPEDGFLPSVEKCEALITPRTKAIALVTPNNPTGAIYPPSLLSAFANLAASKGIALILDETYRDFVPSTDRPPHTLFSNTSLPWRNTLIQVYSFSKSYCLPGHRLGAVIASPHLLASLKTVLDCLQICPPRPVQIALGSLLPSDELREFVKGNAEGVQARHRVFREQLPGDWEVGAQGGYFAFVKHPFGGVRSEEVCQALAREVGVVTLPASFFTRETDENDGLAELGLGEEEKSGEGTSDASELDERWIRFSVANVDDEKVKRVCERLASFVPRGVE

SEQ ID NO: 42637 - protein, 439 aa, Parvularcula bermudensis HTCC2503
MRVAMIGTGYVGLVSGACFSDFGHTVVCVDKNASKIERLERGEIPIYEPGLEKLVAKNVDAGRLSFTQSLADAVPEADAVFIAVGTPSRRGDGHADLSYVYAATEEIAAAINGYTVVVTKSTVPVGTGSEVEAIIKKVRPDFLPGTHFSVASNPEFLREGAAIDDFKRPDRVVVGAEDDKAREVMSELYRPLFINETPIVFTNRTTSELIKYAANAFLATKITFINEIADLCEKVGANVQQVAKGIGLDGRIGKKFLHAGPGYGGSCFPKDTLALVRTAQDHDSPVRIVEAVVDINKKRKEGMVDRVAAALGGSLSGKTVAVLGLTFKPNTDDMRDSPSLDLVPGLIAAGATVRAHDPEGMGEAKHLLPEAVNYCDGPYHASEGADAVVILTEWESYRALDLDRVKGLLNQPVFVDLRNVYDSATMTAKGFVYSSIGRP

SEQ ID NO: 42638 - protein, 759 aa, Yersinia pestis KIM
MDEQLKQSALDFHQFPVPGKIQVSPTKPLATQRDLALAYSPGVAAPCLEIAADPLAAYKYTARGNLVAVISNGTAVLGLGNIGALAGKPVMEGKGVLFKKFSGIDVFDIEVDELDPDKLIDIIASLEPTFGGINLEDIKAPECFYIEKKLRERMKIPVFHDDQHGTAIICTAAVLNGLRVVKKDISDVKLVVSGAGAASIACLNLLVALGLKQHNIIACDSKGVIYKGREANMAETKAAYAIDDNGQRTLGDVMPGSDIFLGCSGSGVLTPEMVKTMAPNPLILALANPEPEILPPLAKAVRPDAIICTGRSDYPNQVNNVLCFPFIFRGALDVGATTINEEMKLACVHAIADLALAEQSDVVASAYGEQDLSFGPEYIIPKPFDPRLIVKIAPAVAKAAMASGVATRPITDFNAYVEKLSEFVYKTNLFMKPIFSQAKKEMKRVVLAEGEEERVLHATQELISQGLAYPILIGRPSVIETRLKKLGLQISAGKDFEVVNNESDPRFNEYWHEYYQIMKRRGVSQEQARRAVIGNPTLIGSIMVHRGEADAMICGTIGTYHEHYDVVEKVFGFREGAHVAGAMNALLLPSGNTFIADTYVNNDPTAEQLAEITLMAAETVRRFGIEPKVALLSHSSFGTSDCPAARKMRQTLALVNQMAPELEIDGEMHGDAALVESIRHNLMPDSPLKGSANILIMPNMEAARISYNLLRVTSSEGVTVGPVLMGITKPVHILTPIASVRRIVNMVALAVVEAITLRP

SEQ ID NO: 42639 - protein, 773 aa, Ralstonia metallidurans CH34
MSSKTTGDAPQHAPNSPEAQLRLAALEYHRSPTKGKIQVTATKALSNQRDLSLAYSPGVAYACEEIHKDPAMAAEYTSRANLVAVVTNGTAVLGLGDIGPLAGKPVMEGKGCLFKKFAGIDVFDIELDARDPDKIVEIVAALEPTLGGVNLEDIKAPECFYIEQKLRERMNIPVFHDDQHGTAIISTAALLNGLKVVGKDIAKVKLAVSGAGAAAIACLDTMVSLGVNRENIYVVDSKGVIFQGRDANMEANKARYAQDTSARTLADIVKDADVFLGCSTAGVLTGDMVKTMADRPIILALANPEPEIRPEVAKAARPDCIIATGRSDYPNQVNNVLCFPYIFRGALDCGATKITEAMKLACVKAIAELAEAELNDAVAAAYGGRELKFGPDYIIPTPFDQRLIEKIAPAVAKAAEESGVATRPIKDLEAYRQQLTSYVYHTGMIMKPVFTAAKAAPKRVAYAEGEEERVLRAVQGVVDEGLARPILIGRPHVIQMRIDKAGLRLRPGVDFELINPEDDPRYRAYHEEYHALRGRDGVTPDMAKVALRRSNTLIGTMLMHMGDADALLCGTVGRFEAHLEHVRDVIGLAPGAKVFAAMNALMLEKYTLFITDTFVNDDPSAEELAAITQLAAEEIARFGLHPKVAMMSHSMFGSSNRPSARKMRDAAEILARVAPQLEVEGEMQGDAALVEDVRRHFLPGTKLAGSANLLVMPTLDAANIAFNLLKITGGQGVTVGPILLGAAKPVHILNPQATTRRIVNMTAVAVAECNATR

SEQ ID NO: 42640 - protein, 131 aa, Sulfolobus solfataricus P2
MYVADLITRNPLTVKPETSIRDAAKIMKRENLGSLIIVDETNKPIGIVTERDILRAVADEVALDSPVSTIMTRGLITIPPNKDVTEALIIMYQNNVRHLAVVGQSGELVGVISIRDAAKAVNLLALDLSIW

SEQ ID NO: 42641 - protein, 286 aa, Legionella pneumophila subsp. pneumophila str. Philadelphia 1
MHLELHQINGNDPLGTIIGERNYQLPIPLPYTMKTVKQIHSGIWHTVIRGYDQYNRPQIATFGKNYDGQLGTGDCENRDTPTPIKLPPEMLTFHAIQTGFFHTIATGLDKNGFPIVASCGYNSDGQLGCGDKDNKNTLIPIKLPENMKSVEMVATGVKHTVIVGKDINNKPVVATCGHNGYGQLGTGDEENRLCLTPIGIPEDITSVDYVGAGAYHTVICGRNIKNQPIITLCGCNSDGELGFAPQKIAKKSSLMTNPAMFFPPRQDKSAINNLMKISKFSPCNLL

SEQ ID NO: 42642 - protein, 286 aa, Triticum aestivum
  misc_feature (187)..(187): Xaa can be any naturally occurring amino acid
  misc_feature (221)..(221): Xaa can be any naturally occurring amino acid
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVTXVFSATDPKRNARDSHIPVLAPLPIGFAVFMVHLXTIPITGTGINPARSLGAAVIYNKDKAWDDQWIFWVGPLIGAAIAAAYHQYVLRASAAKLGSYRSN

SEQ ID NO: 42643 - protein, 475 aa, Sinorhizobium meliloti 1021
MDTQLLIGSRFEAGTEAEEHILNPRTGAGIIDLAEASHAQIDAAVDAAERAFVGWSQTTPAERSNALLKIADAIEKEADEFAALEALNCGKPINAVKNDELPAIIDCWRFFAGAVRNLHAPAAGEYLPGHTSMIRRDPIGIVGSIAPWNYPLMMMAWKLAPAIGGGNTVVFKPSEQTPLTALKLARLIADILPEGVVNVITGRGETVGNALINHPKVGMVSITGDIATGKKVLAAAAKTVKRTHLELGGKAPVIVYGDADLEAVVNGIRTFGYYNAGQDCTAACRIYAEAGIYEKLVADLTSAVSTIRYNLDDDTENEIGPLISRRQRDRVASFVERAADQKHIEITTGGRTGSDEGFFFQPTVVAGATQEDEIVRREVFGPVVSVTRFTGKDDAVAWANDSDYGLASSVWTKDISKAMRAASRLQYGCTWINTHFMLTNEMPHGGIKQSGYGKDMSVYALEDYTAVRHIMINHG

SEQ ID NO: 42644 - protein, 88 aa, Glycine max
LELLEPLERSKAVGCSSTGDTSSGLSAYCASSGIPSIVFLPANKIFTAQLIQSVSNGSLVLSINTDFDGCMKLIREITAELPIYLANS

SEQ ID NO: 42645 - protein, 432 aa, Burkholderia cepacia
SLNDDATFWRNARHHLVRYGGTFEPMIIERAKGSFVYDADGRAILDFTSGQMSAVLGHCHPEIVSVIGEYAGKLDHLFSGMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 42646 - protein, 524 aa, Ashbya gossypii ATCC 10895
MAFMFKPPEQRKRNEKSPRLSLPSTLIGSATPAGDEHASGAMGNSIGSDLHREQKLRGLGQSVQIAEQLSAGSTDTAGSDVLSQHAPSSASSQTSKVLPRRPVPPGMPALAFLSKHPYAQQVTGPLPTTSGEKAGSHSGATTLSAGPTRPPLPKLPYLHVEPKLPCEELPYSALHAGSSSSSNIHSPSRALQEMRLISAGSTPVEPVPPAATVPPCKDVDELEEEMWTHVHLKDQIEELGVLGEGAGGSVTKCKLRHGSKIFALKTITTLTTDQESQKQIFRELQFNKSCKSDYIVRYYGMFTDEEHSSIYIAMEYMGGRSLDAIYKHLLKHGGRVGEKVLGKIAESVLRGLSYLHQRKIIHRDIKPQNILLNEAGQVKLCDFGVSGEAVNSLATTFTGTSYYMAPERIQGQPYSVTSDVWSLGLTLLEVAQAHFPFDSGKFAANMPPIELLMLILTFTPQLKDEPEANIVWSKAFKSFISYCLKKESRERPSPRQMLRHPWIQGQMKKRVNMEKFIYKCWQAR

SEQ ID NO: 42647 - protein, 931 aa, Ashbya gossypii ATCC 10895
MTSIPHRHTYYGGGATPPAATGPLSGSRGHAAGRSKKKQVTFGPYIIGPTLGEGEFGKVKLGWSKARLDGDSRNVAIKLIRRDTVPKNSEKEIKIYRELNALKLLSHPNIVRLEEVLQNSKYIGIVLQYASGGEFYKYIQKKRRLKEPPACRLFAQLISGVHYIHYKGLAHRDLKLENLLLDEHENLIITDFGFVNEFHKNDLMRTSCGSPCYAAPELVVSSKPYSAQKADVWSCGVILYAMLAGYLPWDDDPENPEGEDIAKLYQYITHTSLKFPEYIKPIPRDLLKRILVSNPEVRLTVADIEQHAWLQPHAQFLMWSPSDWDAKAKAETNNLFRQPSAVHAGVLRPQSSCSISSANSKGDNRGSLIMDSTLNPQPVPPQEFQSHIIMKPTSPSNGLRKMSPVRRHARSNSAASIALQAVVDAERDYFNSPSIHSLHHDSLSQNTTPPSSAGRVPTYAITRSATHHNGISSSLMNRNSVIIEVSPQKGSVPPVMIPGNRESLNGQESGGIAMADMSQRPTIVKDKTSSHMVPQAGRKQRPTSYQPCSTTAFAQSPDLVSGAGALVPIMGKQQRVSTASNPTFVDVGRSGSTRRLPGPNNQLLETPFEADRQIDDNPVVDDATIKSDDMLPSTLEIVAYDNECGTSPGSNGQHRRYSAIVMSEIYEQEEGERISCELSSPNKMGSARPDCSTARISINTPNMGLQNRECIVSSSSPESDASSKQKSGKTDKKDKRFSLLSFYSFYNNSKSSIDSSTDAVQPTGLVLDVVKHPNISRTSSQKKNPAPAGNGTQAIPRRHNTLPREAQRTPVALSYVYASLDVTPNAGTPELADVPSPINLVKMAEQPHGTKQHDPSTPTRSATVHGKSQRLSNNTPKGPIYEDPKPKRKTNKVSLMVSSINPSQAPQPPRQKEPSTARKVLDFFKRRSLRI

SEQ ID NO: 42648 - protein, 1413 aa, Candidatus Kuenenia stuttgartiensis
MRLKILTVLRVSMVASVVCGLMFFTQYTAGSYDGYAIGSTTGSLPDDGGSTPTATTGSATCVSLSSVLLNGWVNGNGLATTAWFDYGTSTGMYFDATTTIPCGTGSTYVNATLGDLTPWTTYYCRIASQNIGGISYGSETTFIPRSQISAGAYHTLTLKPDGAVWTWGANWNGQLGDESTTNRSTPVQVSGLTDVIAIAGGAYHTIALKSDGTVWAWGNNEGGQLGDGSTTDRSTPVQVSGLTDVIAIAGGYAHTIALKSDGTVWAWGDNEGGRLGDGSTTNRSIPVKVGGLSDVIAIAGGNAHTIALKSDGTVWAWGDNEGGQLGDGSTTNRSTPVKVSGLADVIAIAGGYSHTIVLRSDGTVWTWGHNEGGQLGDGSTTNRSTPVQVSGLADVIAIAGGVYHTIAVKSDGTMWAWGYNWYGQLGDGTTINSSTPVQVNGLTDVIAIAGGYYHTIAMKSDGAVWTWGFNYYGQLGDGSITNRSTPAQRSLSGMKSVATPTVTTGSATCVSLSSALLNGWVNGNGVATTAWFDYGTSTGMYFDATKTISCGTGSTYVGATLGDLTPWTTYYCRIASQNIGGIYYGSETTFMPRTQISAGAYHTLTLKPDGTVWAYGANWNSQLGDGSTTDSSTPVQVSGLTDAIAIAGGVYHTIALKSDGTVWTWGWNNSGQLGDGTTINRSTPVQVIGLTDVIAIAGGDYHTIALKSDGTVWTWGFNYYGQLGGGATTNRSTPVQVKGLADIIAIAGGYVHSIALKSDGTVWAWGYNGYGQLGDGSTTDHLTPVQVSGLTDIIAIAGGYIHTIALKSDGTVWAWGHNEGGQLGDGTTTNSSTPVQVSGLTDVIAVTARLYHTIALKSDGTVWTWGRNIYGQLGDGSTTERSLPVQVIGLTDVIAIAGGYYHTIALKSDGAVWAWGYNGNNQLGNWSTKNSSTPVRSLRYDMNSVTTPAVITGSTTCVSLSSVLLNGWVDGNRAATTAWFDYGTSSGVYFDTTATIPCGTSSAYISATLGSLTPWTTYYYRIAAQNSRGISYGSETIFLPRSQISAGAYHTLTLKPDGTVWACGANWNGQLGDGTTINRSTPVQVSGLTDVIAIAGGDYHTIALKSDNTVWAWGSNSYGQLGDGTITNRSIPTPVTYLTNIIAIAGGYVHTIALKSDGTVWAWGYNGYGQLGDGSTTNRSTPVQVSGLTDVIAIAGEYVHTVALKSDGTVWAWGYNGYGQLGDGSTTNRSTPVQVSGLTDVIAIAGGYVHTIALKSDGTVWTWGWNNSGQLGDGTTINRLTPVQVSGLTDAIAIAGGDYHTIALKSDNTVWAWGSNSYGQLGDGTTINRLTPVQVSGLTDAIAIAGGDYHTIALKSDNTVWAWGSNSYGQLGDVSTANSLTPAQCLLSPIVSTGTAINIGTTMVRSTPTARLP

SEQ ID NO: 42649 - protein, 565 aa, Staphylococcus aureus subsp. aureus MW2
MNYQALYRMYRPQSFEDVVGQEHVTKTLRNAISKEKQSHAYIFSGPRGTGKTSIAKVFAKAINCLNSTDGEPCNECHICKGITQGTNSDVIEIDAASNNGVDEIRNIRDKVKYAPSELKYKVYIIDEVHMLTTGAFNALLKTLEEPPAHAIFILATTEPHKIPPTIISRAQRFDFKAISLNQIVERLKFVADAQQIECEDEALAFIAKASEGGMRDALSIMDQAIAFGDGTLTLQDALNVTGSVHDEALDHLFDDIVQGDVQASFKKYHQFITEGKEVNRLINDMIYFVRDTIMNKTSEKDTEYRALMNLELDMLYQMIDLINDTLVSIRFSVNQNVHFEVLLVKLAEQIKGQPQVIANVAEPAQIASSPNTDVLLQRMEQLEQELKTLKAQGVSVAPVQKSSKKPARGIQKSKNAFSMQQIAKVLDKANKADIKLLKDHWQEVIDHAKNNDKKSLVSLLQNSEPVAASEDHVLVKFEEEIHCEIVNKDDEKRSSIESVVCNIVNKNVKVVGVPSDQWQRVRTEYLQNRKNEGDDMPKQQAQQTDIAQKAKDLFGEETVHVIDEE

SEQ ID NO: 42650 - protein, 476 aa, Nostoc sp. PCC 7120
MRRTKIICTVGPATSAPERLEALVEAGMNVARLNFSHGAYDFHAQTAQYLRQISADRQKPVAIMQDLCGPKIRLGTLPPEGLMVEAGQEVTFVLQEKGSSLDELPLPLPTLFAMVRPGEPILINDGRVKLIVTDRDADRIRAIAKIGGLLSTRKGVNLPATRLPVSSITEKDLQDLRFGIDLSVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQVMHDIAVTTEKSLQEGSKHCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 42651 - protein, 414 aa, Sulfolobus tokodaii str. 7
MAISLAKKYQGKLEIMPKIPIRSYEDFALIYTPGVAELVKEIQKDENQSFELTSRWNTIAILTDGSRVLGLGNVGPIASLPVMEGKALLFKFLGGVDAFPLPIKVSDKEEFIQVAKAIEPAFGGINLEDIESPKCFFILEELQKTLNIPVWHDDQQGTAGAVLAGLINAIKITGKDKNSKIVLMGAGAANIATAQLLIKYGFNPKNMILIDKEGPLYAERGDVDSLMFKHPWKYELAIQTNSERVKTIEEAFKGADILIAASSPEVRIDKKLIRMMNKPIVFALANPIPEIYPNEAKEAGAVIVATGRSDFPNQVNNSLIFPAVFRGVLDSRAKKITDEMIIAAAEELAKYAEEKGLREDYIIPRMDEIEVYYRMAAAVATKAVELGYARLKLSYREFLESAKERILRARRLSL

SEQ ID NO: 42652 - protein, 343 aa, Nostoc sp. PCC 7120
MAKLKVGINGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMVQKEQLAAV

SEQ ID NO: 42653 - protein, 166 aa, Marinobacter sp. ELB17
MSVNEQKAPELQEKLVQVNRVAKVVKGGRIFAFTALTVVGDGKGRVGFGRGKAREVPVAIQKAMEAARKNMVDVPLDGTTLQYPVRAQHGGSRVFMMPASDGTGIIAGGAMRAVLEVAGVHNVLSKCYGSTNPVNVVRSTIKGLQAMQAPEDIAAKRGKSVEDILG

SEQ ID NO: 42654 - protein, 228 aa, Ralstonia metallidurans CH34
MTQDELKALVAQAAADYVKQEVPEGAVLGVGTGSTANLFIDAVAAFKERFSGAVSSSEASTRRLQQHGFNVLDLNEVDSIPVYVDGADEIDNSGAMIKGGGGALTREKIVASVADRFVCIADGSKLVPTMGAFPLPVEVIPMARAAVARSLAALGGQPRLRMTKEGGIYKTDNGNVILDVSGLKIENPKALEQQINQLPGVVTVGLFALRGANVLLLGTEQGVQRSDY

SEQ ID NO: 42655 - protein, 457 aa, Escherichia coli K12
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 42656 - protein, 435 aa, Wolbachia endosymbiont of Drosophila ananassae
MPIEILMPALSPTMSKTGGKIVKWHKKEQDKVEVGDVIAEIETDKAIMEFESIDEGVLAKILVTEGTSGVPVNQPIALMLEEGEDESALNNYTSTSINSAVKKEVTKSAVDNQKSEHQDLNGKPISHSSVSFQRVTLESNPSMSSQCLTLGSRKEEWIPVSATQMTEGYAEGRTKISPLAKKIAQNEGVNVQQLKGTGPYGRIIKADVLEFLGSGIHTESPEKDTIVEVSNMRQVIAQRLTESKQNVPHFYLTVDCQVDKLISLKNEINSADENNKVTINDLIIKAAAFSMKKFPDINSSWIDNKILRYSNIDISIAVALEDGLITPIVKNADKKGILSISKEVKDLVSRARSGKLKPEEFQGGGFTISNLGMFGIKAFSAIINPPQSCIMAVGASKKQPIVMNEKIEIAEIMTVTLSVDHRAVDGALGAKFLNA

SEQ ID NO: 42657 - protein, 630 aa, Escherichia coli K12
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 42658 - protein, 264 aa, Triticum aestivum
MAVAGCGSREERWSLAGATALVTGGSKGIGHAIVEELAGFGARVHTCSRNAAELEECRRRWEEKNLRVTVSVCDVSVRAQREKLMETVRQTFDGKLDILVNNAGQLLFKPAAECTAEDFSNLMTTNLEASFHLSQLARPLLIHASIAGGGSIINVSSIGGSIAFAGSTVYAITKGALSQLTRNLATEWAPNKIRVNGVAPGFVTTDMIKDVDPEYMKQENSKTPLGRSGKPVEIASAVSFLCMPAASYITGQVICIDGGRTISS

SEQ ID NO: 42659 - protein, 567 aa, Shewanella oneidensis MR-1
MSITGIIVSSGIAFGKALHLNHCENHLDYRPIPLSRIPLQQSKFLKALQALKQQLSLSQAKLDPESENYQLIEADLLLLDDDELIEQVKEAIRTLQLSASVAVERIFAHQANELESLDDPYLANRAQDVRCLGQRIVTAINGRLEQGLADLSEATILLAQDLTPAEFALLPKEHISGIVLKTGGLTSHTAILARAAGIPAMLSCQFDAEFIPNNTPLVLDALSGVLYVNPEPEQQARLTVTLHHEQARRQALQTYRDVPAQTQDGHHVGLLANVGNLNEITHVKDEGADGIGLFRTEFMLMNTSTLPDEKAQYNLYCEALHALDGKTFTIRTLDIGADKELPCLCQNIEDNPALGQRGVRYTLAHPELFKTQLRAILRAANHGPIRLMFPMVNQVEELDEIFKLIAECQDALEEEEKGYGELSYGIVVETPAAVLNLASMLPRLDFVSIGTNDLTQYAMAADRTNPQLTKDYPSLSPAILHLINMTITQAKATGVTVSLCGELASSPQMAPLLVGMGLDELSVNLSSLLEVKAAICQGELAKFSELAHTAMQQNRISDLQQCITNYK

SEQ ID NO: 42660 - protein, 309 aa, Prochlorococcus marinus str. MIT 9301
MTATISRPKISNWETSNIPNLTGKIALITGANSGLGYYTAKALAEKNAHVVIACRSLEKANQTIKKLKGLNPEGLFTPLELDLSDLKNIVEVQSKIFDNFENLDLLINNAGIMHPPKTLSAQGYEIQFAVNHLAHMLLTLKLLPIIEKKEESRIVTVTSGAQFFGKVGWKNLKAENYYNKWESYSNSKLANVMFALELNENLKHKNILSLAAHPGIAKTNLFTAQKPNPGPLETFSLELFSPIFQTAEMGALPQLFAATSPDARGGDHYGPRFNFRGHPKLSPTSPFAMNKKERKNLWEKSLEIINNFL

SEQ ID NO: 42661 - protein, 284 aa, Salinibacter ruber DSM 13855
MSDSFAPDLLADQHIVVTGGGTGLGRAMALRFADLGAAVTINGRRPDPLAETVRDIEAAGGAAEGIQCNVRDYEAVQAFFEEAEDRQGPVTRLVNNAAANFLAPTEDISPNGFDAIVQTNLYGSFYCTQACGQRWLERDAEGVVLSIATTYAETGSAYVVPSAMSKAGIVAMTRSLAAEWGSEGIRLNAVAPGPFPTEGAWDRLVPDDDLEQKMRERVPVRRFGEPEELATLASFLLSDLSAFMNGEVVTFDGGEALAAGGQFNTFTRMPRRQVKALMEQMRPE

SEQ ID NO: 42662 - protein, 275 aa, Pseudomonas sp.
MKLKGEVALVTGGGAGLGRAIVDRYVAEGARVAVLDKSAAGLEEIRKRHGDAVVGIEGDVRSLDSHREAVARCVETFGKLDCLIGNAGVWDYLTQLADIPDNGISEAFDEMFAINVKGYILAAKAALPALYKSKGSAIFTVSNAGFYPGGGGVLYTAGKHAVIGLVKQLAHEWGPRIRVNGIAPGGILGSDLRGLKTLGLQDQTIATMPLADMLGPVLPTGRMATAEEYAGAYVFFATRADTVPLTGSVLNIDGGMGVRGLFEASLGAQLDKHFA

SEQ ID NO: 42663 - protein, 563 aa, Oryza sativa
MESLALLHAKPGGLPPRAGLRLPLPRARSARVSLPSSPAAPVSLQSPLLLASRSGPTSRDAVVGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDISPRRRRPPQPPQGCSHPLLRVSFLLIQPWVRRRRTSTLWSLATSTPASRPPRAI

SEQ ID NO: 42664 - protein, 392 aa, Picrophilus torridus DSM 9790
MDRIMFENGSWIVPEKPVILYANGDGIGPEIMDATRKVVDAATAMEKKSIAWKEILLGDRAEELKGDRFPEESIKAINDYRVLLKAPLNTPVGKGFKSINVRIRMLLDLYANIRPVKFMPGLESPLKNPEKVNLTIFRENTDDLYLGYEWSYDTDEAKRIRKFLKDEFNIDISDDSGIGIKPMSRYKTQRITRLAVKYAMDNNLKKITIMHKGNVMKYTEGAFREWAYETALNEFSDYVSRDDDKKIIINDIIADNMFQQIITRPDEYQLILAPNVDGDYISDAAGALIGNIGTLGGANIGDNGAMFEAVHGTAPKYAGKNVADPLGLIRGAQLMLRYMGWNRAADAIEKAIQASINEKKVTNDLARFFNVEPLGTREYGDYLVDKIKVLVS

SEQ ID NO: 42665 - protein, 429 aa, Microcystis aeruginosa PCC 7806
MKKVLAIILGGGAGTRLYPLTKLRAKPAVPLAGKYRLIDIPVSNCINSQIDKIYVLTQFNSASLNRHLNRTYNFTGFSDGFVEVLAAQQTMENPQWFQGTADAVRQYIWTMKDWDIDEYLILSGDHLYRMDYSKFIERHRETNADITLSVVPIDERRASAFGVMKINDSGRIVDFYEKPKGPELERMRVDTTILGLSPDQARQSPYIASMGIYVFKKNVLIDLLDANKEQTDFGKEIIPSAAKDYNLQAYLFKGYWEDIGTIEAFYESNLALTQQPNPAFSFYDEKAPIYTRSRYLPPTKMLNCTVTESMISEGCILKESRIHHSILGIRSRVGKDCTIEDTMLMGADFYESFPERESLIGNAKVPVGIGPGSTIRRAIVDKNARIGSNVLIVNKDRVEEANREDLGFYVRSGIVVIFKNATIPDGMVI

SEQ ID NO: 42666 - protein, 874 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 42667 - protein, 139 aa, Triticum aestivum
  misc_feature (109)..(109): Xaa can be any naturally occurring amino acid
  misc_feature (122)..(123): Xaa can be any naturally occurring amino acid
  misc_feature (125)..(125): Xaa can be any naturally occurring amino acid
  misc_feature (129)..(129): Xaa can be any naturally occurring amino acid
MESLEALVAHIQGLSGSPEELAHLHSLLKQADGEPLRAHAAALVPFLAHLSPETHSLGYLYLLEACATSSSNLSDFGGGDFLVTIGGFLTACSADQIRLAPDKFLNVCXVLKDQVMQLNMPXXGXSPLXAAVPKINPPN

SEQ ID NO: 42668 - protein, 2047 aa, Oryza sativa Japonica Group
MADPFVADDQTDADFFDKLVDDDDDLSPAPAPAPVPAQQSAEAALLPALSDLSLADDDTDPSPAPPPVEAPPEGASPESGKGAVHTTVKQVQWASFGGAADDGADPFSDLSGGAADDGFLGTMAGNQSFQTSVIGSVGASAHGIFGGSQSLTAEVTDQDFFGGTSDQNTDTQQQQLEQSGSSAFDSTDPKYLESIYPGWKYDEATQQWYQVDNSDTHGNATQVDTSTENIQQQQLAASYMHNPTQSSLETIAEEGTTTGSVSTWGQGGTSEYPPNMVFYAEYPGWYFDTNTQQWQSLESYQQAVTASAVQDGANNGVVASSAETNYSVKQTEDLPAHNQVAQHNSFSNNYSYQSQWQTNSFSNSMQPESATASLPDSFQSLGQHAISESFNSSTNSQVSFNTAETATSHYGNVNLDSSSTQGGYTASGGQQTGYKGFEPFTGHQAGYKGFEPSTGHQTSHKLFDPSAGNQNSYKPFEPSTGHHQHKGFEPSTNHQGDYKAFEPSTHNQGGYKGFSPSTVQQPGYKGFEASTGLQTNFKGFEPYSGQQAGYTGSLPSTGHQSSYMGFETSSNQGYGDANNVANSQGFVPMESMYGSHNQAHTNPQVPLSNSYLSVDNSKNFSQQQFLGPNASHLQFGQSPHEERSSAGRPPHALVAFGFGGKLILMKETNSMATNYDSGNQGNSSGTVSVLNLSEVVTDKADALSASNGSALSYFHALCRQPVPGPLVGGSAASKDVNKWLDDMIALYESSTSEFQRGDPRKLLISLLKILCHHYGKLRSPFASDPSHEDTDGPEMAVTKLFSSCKRSSFQMGDFGSHVRCMKNIPSENQMQAVAQEVQNLLVSGRRKEALQCAQEGQLWGPAIILALQLGDKFYVDTVKKMAHCHFLSGSPLRTLCLLIAGQPADVFNADNNISSNYGSQQPMEPSPNGMLDDWEENLAIITANRTKGDDLVITHLGDCLWKEKNEVAAAHSCYLVAELNIDPYSESARLCLLGADHLKCPRTFASPEAIQRTEIYEYAKVLGNSQYILLPFQPYKLIYAYMLAEVGRVADSLRYCQASMKVLKASGRAPELEAWKQLFSTLEDRIRTHQQGGYGTNLAPAKLVGKIFTSLDKSISRMMGTPSAPLPPLPQGAVSDRESYTAPGATKFANSQSVMTMSSLMPSASVQSMSEMSDSGRKIAHNRSVSEPDFGRTPKQGAGSDSTQSTAPGSGSSRFGWLGSTLQKTMGFVSKSHRQAKLGQQNKFYYDEKLKRWVEEGAEIPAEEPPLPPPPSKPSFQNGVVDYKLNGPMSASHTPNGFMEGKSSTSSEHGSGMPPIPPSQNQFSARGRMGVRSRYVDTFNKGGGGGAVPSYNKPAVASVTPPSGAKFFVPTAAVVAAEQMPNQTAETHGETFRPDERSSPAETSFSSPPPATQFSAPLMVPTIQRYPSMDNITTPNNGSGLSSGSNSSSFSRSRAASWSGTYSEQINAVAGARSPDQQTMPSPLMPGKQSHSRSNSNSSVQFNSLTEDLHELRTLRDALDYDRSALVRYFSAASASFPTKGGAAAGVEKRIGGARFPQCKQPGKELETFKVSLGGLNGRYACRRAPNNCIPTTITGLNGSLSCGQVSSARSFSSSADLPPHQEIGMPSLSPTMTEGNIARWLKKEGDKVSPGEVLCEVETDKATVEMECMEEGYLAKIIHGDGAKEIKVGEIIAVTVEEEGDLEKFKDYKPSTSAAPAAPSEPKAQPEPAEPKVKETEPSRTPEPKAPKTEEASQPGGRIFSSPLARKLAEDNNVPLSSVMGTGPDGRILKADIEDYLASVAKGGKREALAAPGLSYTDVPNTQIRKVTANRLLSSKQTIPHYYLTVDARVDNLIKLRGELNPLQESSGGKKISINDLVIKAAALALRKVPQCNSSWMSDFIRQYHNVNINVAVQTEHGLFVPVIRDADKKGLGTIAEEVKQVAQRARDNSLKPEDYEGGTFTISNLGGPFGIKQFCAIINPPQSAILAIGTAEKRVIPGSVDGQYEFGSFMSATMSCDHRVIDGAIGAEFLKAFKGYIENPNSMLL

SEQ ID NO: 42669 - protein, 260 aa, Burkholderia xenovorans LB400
MAARLQDKVAILTGAASGIGEAVARRYLDEGAKCVLVDVKPADSFGDALRAAYGDRVLTVSADVTRRDDIERIVASTLERFGQIDILFNNAALFDMRPILDESWDVFDRLFAVNVKGMFFLMQAVARKMVEQGRGGKIINMSSQAGRRGEALVSHYCATKAAVLSYTQSAALALAPHKINVNGIAPGVVDTPMWNEVDALFARYENRPLGEKKRLVGEAVPLGRMGVPDDLTGAALFLASADADYITAQTLNVDGGNWMS

SEQ ID NO: 42670 - protein, 441 aa, Triticum aestivum
MLPQMRPLPSRPAIHAVHRRTSPAPPSIGGLGQHGRVALVRTTKAVVCRSVASPAANQGAPAVERPWKLSDARLVLEDGSVWNAKSFGASGTQVGEVVFNTSLTGYQEILTDPSYAGQFVLMTNPHIGNTGVNSGDEESIKCFLGGLIIRNLSICTSNWRCTETLDEYLRKRNIMGIYDVDTRAITRRLREDGSLIGVLSTDQSLKDEGLLEMAKNWKIVGVDLISDVTCDAPYEWVDKTGSGWEFNDNQSSETFHVVVYDFGVKHNILRRLASYGCKITVVPASWPASDVLNLKPDGVLFSNGPGDPAAVPYAVKTVQEIVGKVPVFGICMGHQLIGQALGGKTFKMKFGHHGGNHPVRDNRTGRVDISAQNHNYAVDPKSLPEGVQVTHINLNDQSCAGLVFPKMKLMSLQYHPESSPGPHDSDLAFGEFVELMKNNRL

SEQ ID NO: 42671 - protein, 368 aa, Burkholderia xenovorans LB400
MKTKAAIAWKAGAPLTIEEVDLEGPRAGEVLIEVKATGICHTDYYTLSGADPEGIFPAILGHEGAGVIVDTGPGVGTLKKGDHVIPLYTPECRQCKFCLSRKTNLCQAIRSTQGKGLMPDSTSRFSIDGKPLFHYMGTSTFSNYIVVPEIAVAKVREDAPFDKICYIGCGVTTGVGAVVYSAKVEAGANVVVFGLGGIGLNVIQGAKMVGADRIIGVDINSGRVELAKKFGMTHFINPTEVENVVDHIVQLTDGGADYSFECIGNTKVMRQALECTHKGWGQSFIIGVAAAGEEISTRPFQLVTGREWKGSAFGGARGRTDVPKIVDWYMEGKINIDDLITHRLPLERINEGFDLMKKGESIRSVVLY

SEQ ID NO: 42672 - protein, 851 aa, Ashbya gossypii ATCC 10895
MIGSRVKQNNLKATIGASYNKLYGQFTASELREVGNYRIVKQVGEGSFGKVYLATHKLTHQKVVLKTGAKSDPNVVREVFYHRQFEYPFITKLYEVIVTETRVWMALEYCPGNELYDYLLLKQRIPLDETRRLFAQIVSAVFYAHSLQCVHRDLKLENILLDKNGYAMLTDFGFTRECATKTQLETVCGTTVYMAPELIKREAYDGYKVDTWSLGIILYTMLHGYMPFDEDDTVRTGLKIMHEEPAVLDEYTSPQAKDLIVRLLDKNAAQRPNLNEVLQHPFLQPYGALLLETVECLIKRQRRASLKFQSKTEKRLLKKLKQSGFDTNAIRAAVVKRSCDSLCSLWYLLLEKEKKRELSKYPRRSRSMLSVRKVFDSASGVSTQDVLDIDNTTSLRKIFSIRSEASSRGQLKEAEKEAAARRTRSASTSQNLNIPSEHSSPARAKTKSNIFQKVTKFFSRAKKTQLNNNDRGFGHRRSTSRHGRRYKPAFDTLKKPLHESQGAETSATAGGDYPTSLGDRHRLRGALTIEEPKLKFKSQSSSELSIQQSLLTSEGDSNVASMSRAASLGRPRPSSMLSQHSALSNDTFNSEYSDPQSVYKAPTGSSAKVSGSGNINGGSTGDSGSFSKSKVFAKRSVSIMSSASSASELSSKTDSFYDITTATSPTHLDIRATVNGTSRVESAFPRADSAAITPAWLTKRDKTSILRRRVNTRTLKRNKLIRGNSTGTQSVIQEESSFSDNDEQAPILAATEVVYARISNNPELDEDVPVQTDSSNSSHAELAIYPLTLNSDSKSGEFLAGRSLSDVSAWSQNGSSLAVTQSQATKKESHEDQLFDQDSSSLTEYQQEKPS

SEQ ID NO: 42673 - protein, 136 aa, Triticum aestivum
  misc_feature (58)..(58): Xaa can be any naturally occurring amino acid
  misc_feature (64)..(64): Xaa can be any naturally occurring amino acid
GGTGARAYHERVVDHYNNPRYVGSFDKDDPNVGTGLVGVPACGDVMKLQIRVDEGTGXIVDACXASSSVVTEWVKGKQMEEVVSIKNTEIAKHLSLPPVKLHCSMLAEDAIKAAVKDYESKKAKLGDSHAEKAAEA

SEQ ID NO: 42674 - protein, 474 aa, Xanthomonas oryzae pv. oryzae KACC10331
MERPRSDAPMPEPSSTTAPQFRRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVITILVFIVLGGAAVIGLLPLADGSPAPGLRHLRADGWFAHGTLPILMTMVAVNFAFSGTELIGVAAGETEQPARAIPLAIRTTLMRLVVFFVGTVLVLAALLPAEQAAVETSPFVRAFELLGIPYAADLLNVVILTAILSAANSGLYAAARMLWSLANEGTLPSGLTRLTGRGIPLRAVSLSMLGGLLALLTGVYAADTVFVAISAVSGFAVVVVWLSICASHYVFRRQLLRDGVAPETLAYRARWYPWTPILGFSLCLLACIGLAFDPQQRIALWCGVPFVALCYGAYALTQRLAARRLHA

SEQ ID NO: 42675 - protein, 220 aa, Synechococcus elongatus PCC 7942
MIPDGLRRCDLEVTTAEVQQDDHRWASNHKQCQRRQLKNDFEIDAAQETHISPRSRPGLCRFGNRFYRADANALSIVTKIHYQARARLEADLPSPDLSVMAQWQCVRQCGACCHLDPRDRPDLEQYLQPEEMALYLSMVGSDGWCIHFDHDSRLCSIYDDRPRFCRVQPETFESMFGVPKEDLNDFAIACCEEQIEGVYGDRSLEQIRFRQAVGLVLEDL

SEQ ID NO: 42676 - protein, 171 aa, Triticum aestivum
MAQRDKKVEEPTEVHLHAAEITLCANSCGFPGNPATKNLCQNCFLASSSSPSPSAASPQSPSSSPAAFPLFDKPRPAAAASPLQAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 42677 - protein, 502 aa, Propionibacterium acnes KPA171202
MTHTTQRSHEDNPQGPKVSVTRDDPRAATIEEIQPIVDRGDQGYAETLTNRQVQMMAIGGAIGVGLFLGAGSRLRSAGPAVLISYAFCAVIAFLVMRALGELVIHRPSSGSFVSYARELLGDRWAYAVGWMYMLNWMTSGIAELTAIGTYLQFWWPSLPMWVPSLVALMILVSVNLISVKAFGEFEFWAALLKVVALTAFIIVAIGLVASHVNVGGHRAAVSNLWRFDGGFAPQGVLPLILVIQGVIFAYATIELVGTASGETQNPRKVIPKAVHAVVFRLVVFYLGSLALLAMLLPYKEYSADESPFVTAFSAMGVGWIGDAMNIVVITAAFSSVNSGLYATGRVLKSLAAAGEAPKFAGTLNRFKTPAGGILMTASVFLLGVGLEYVVPERAFEISINTAAVGVIWTWATIFWCQLVLRRRVNEGRITDSGFHMPGYPITGIFGIVSLAGVTALMVLDPQNRIVLAAALVYIAVMLVAWPAVKRNKARHPELNAQEDITF

SEQ ID NO: 42678 - protein, 780 aa, Salinibacter ruber DSM 13855
MAQDDLRRELGFWDALTIGAGTMIGAGIFLLAGVALELTGPAAIFSYLAAGIVCMITAASAAELATGMPTSGGDYFFVSRSLGPALGAISGVGIWLSLTFAISFYLFGLGEYLSQFLPLTPFWGAFAGGLLLTAINVYGAKESGQMQVIVVLTLMGILGAFCGIGAFYIEWSNFTPFFPFGGAPVASTTALVFVSFLGFVKIAAVAEEIKNPAKNLPRTLIGSVALVTLLYVVILLVIGGIFEQETIGEVRDPLTQAARTLAGPIGAGAIIFAGLLATVSSANASIMASSRINLAMARDRMVPNWLSAIHETLLTPHRAILLTGVLALAFLFIESLEQLAKIASVLQLYSYAALNVGCVALRVAQPDWYEPSYRTPGFPFVQGLAALACIGIILYSGPFAQIAIVVLILASLGWYYVWGRSRVEIEHAVPEFREQWAAQGWSALAAPAPEFAVQVPEVLSAAERAVDADGPRRVSVALANPEHEHDLLQLGRYIATGRTEGGHVAGIHLVDVPLQTPLRSARAQFTERPSLERAIADLPQEAAARPSTNDLDHTPLEATDIESVIDVAHDVFGGLIDETQAQTSDMLLMGWQGGFNVGRIYNSPIQRIVSDLPADLGVLKDRGFDSVDQILLPWGGGLHAQLGLEIAVRVARITDATVHLLRVVREDVDVEDEKAALDDTVQGLVDTDRVEYLVRQSDSVTGGIDATLTEADYDFAIIGASREWSLRQVLFGSIPDVVADRADCSVLMVRRYVPNTLSVRAVEGVKRLKETVGLTTSPEE

SEQ ID NO: 42679 - protein, 454 aa, Vibrio sp. Ex25
MCKSYTLEGTQMSYVFHRHCHATLPIIDKGEGVYLFDKQGKQYLDACGGAAVSNLGHSHQAVKKAMLEQLERVPFAHTGFFTSDSGERLAELICQYMPEQFNHVYLVSGGSEAVESALKMARQHFVESGKPEKKQFIARQQSYHGNTLGALAVGGNEWRREPFKPILHPSHHIAPCYAYRYQQTHESELDYSLRTANELEAKILELGAENVMAFVAEPIVGATAGAVPATQGYFKRIREICDQYDVLLILDEVMCGVGRSGSFFAFEQEEAEPDLVCMAKGLGAGYQPIGAVVANDRVYQAIADGSGFFQHGHTFMAHPVACAAAVATIETIFQDDLLTAVNQHSVLLRNELTSALAHLPYIGDIRGKGLFVGIELVADKESKSPLSKATLADKRIKQRAMENGLMCYPMGGTIDGVNGHHILLAPPFIVQPHHIDELVGKLSLTLKEVAETWK

SEQ ID NO: 42680 - protein, 574 aa, Salinibacter ruber DSM 13855
MFFETKALGPTALSPVWGHERPVGTSPVRTTGGSRGLRPSFCSGRSPAWPVGRVTRGRVSGGPVVTTEAPSSTVHHPEVSSSSLVSMTTDYDVLVIGGGAGGLSAAGIATNLGAKTAMIERDALGGDCTWTGCVPSKTLLKAATVVHQARTASKYGLTDQSVDVDFGGVMDHVRQVRQEVYEEADAPEIFEDLDIDVREGDAHFIDAHTVGVERADGSTEQVTGRYVIVAAGARPLVPPIEGLGEVDVLTNESLFELEEQPERLAIVGGGPIGTEMAQAFARLGTEVVVLDMADRILSNDDAELAATLRETLEEEGVEYVLGAQVEKVAQSGGTITISAGEQGPVEADALLLATGRTANVDGLHLDAAGIDYTRQGITVDDRCRTSQGHVYAVGDVTGRYQFTHMSNHMAKVAVTNALLKVPSKIDADHVPWVTYTEPELAHVGAHAADLDEQGVSYETYRFPYDQLDRAITESETTGQIKVHATSLTGKILGASVLGERAGELITAFTIAMRNGVTLRNIGDTIHPYPAYGEGVRRVADQWYVQKQSPTVTKMLQTVFGYRGPVLKYGPDEIV

SEQ ID NO: 42681 - protein, 313 aa, Sulfolobus solfataricus P2
MVDVIALGEPLIQFNSFNPGPLRFVNYFEKHVAGSELNFCIAVVRNHLSCSLIARVGNDEFGKNIIEYSRAQGIDTSHIKVDNESFTGIYFIQRGYPIPMKSELVYYRKGSAGSRLSPEDINENYVRNSRLVHSTGITLAISDNAKEAVIKAFELAKSRSLDTNIRPKLWSSLEKAKETILSILKKYDIEVLITDPDDTKILLDVTDPDEAYRKYKELGVKVLLYKLGSKGAIAYKDNVKAFKDAYKVPVEDPTGAGDAMAGTFVSLYLQGKDIEYSLAHGIAASTLVITVRGDNELTPTLEDAERFLNEFKT

SEQ ID NO: 42682 - protein, 389 aa, Oryza sativa Japonica Group
MGAVTSTVAARFAFFPPSPPSYGAEAPPPPAAAGAGVGVEKDGGGGGVVVELTDVPRRGNVEARRLRTKRGTEVVAMYVRQAGARLTLLYSHGNAADLGQMFELFVELSAHLNVNLMGYDYSGYGQSSGKPSEHNTYADIEAVYRCLVETYGASEENIILYGQSVGSGPTLDLASRLPHLRAVVLHSPILSGLRVMYPVKHTYWFDIYKNIDKIPLVRCPVLVIHGTADEVVDCSHGRALWELSKVKYEPLWVKGGNHCNLELYPEYIKHLKKFVGAIEKSPPLYDESPESSGPSDNTQTNPEGTEESRKSTDCREKTRPSIDHRQSTDRRDKSRGSTDRRDKNRKSVDQPRASVDQPDRPRKSVDRFGGVMKSVRYIDCFRVTTASGS

SEQ ID NO: 42683 - protein, 232 aa, Synechococcus sp. WH 8102
MLGDLWSFQGRYRTLHLTWIAFFLTFVVWFNLAPLATTVKADLGLTVGQIRTVAICNVALTIPARVLIGMLLDKFGPRITYSSILVFSAIPCLLFASAQSFNQLVVARLLLSIVGAGFVIGIRMVAEWFPPKEIGLAEGIYGGWGNFGSAFSALTMVALAGFLSFSGGFELPTGTVLNWRGAISLTGIVSAVYGLFYFFNVTDTPPARPISALRKPQAWRSPPCATSGVCSA

SEQ ID NO: 42684 - protein, 290 aa, Synechococcus sp. WH 8102
MRDFWGLLGMNVPFAAILCVLCWRLGKVGFLTPSTYPLALGAVAVWFAFQTWGIIRTNRDLILGNKVYPKEDRYEFRQVAILELTYIVNFGSELAVVSMLPTFFETTFDLPKATAGILASCFAFVNLVARPAGGLISDSVGSRKNTMGFLTAGLGVGYLVMSMIKPGTFTGTTGIAVAVVITMLASFFVQSGEGATFALVPLVKRRVTGQVAGLVGAYGNVGAVTYLTIFSLLPMWMGGGGEPTPEVIAASNSAFFQILGVAGLIVAFFCFFFLKEPKGSFAELHEGETA

SEQ ID NO: 42685 - protein, 565 aa, Haloarcula marismortui ATCC 43049
MYKTPRGKHTVICAITVLLVLAAPLSVTSAAATPVDDGQTTAVTENVDVWERSLLPLRTSSTGPTAIAAPETYINIESAQTGDVPLNRDEYTIHETGESVDLTFESTTGAGTTGLAGDEAQLLAVRLSEGPESAGFSEGSVRTDLASIFTNDSNANSVELLDDAEGVDSIDDNGVLETSYTPDSGGAYGFILVTVDDGQGLSVSDNNVSTDGNVTVVGVEQTIVQESPSTVETTADDVAAGDNVSLDIETELEDDAVTHAVLLFDEDELQQRTSTVRVTGDIDENFSEDQVTVENSFDGVNGVSSMDDDATFSSGDSTTVGAMPSAGLIGLFGFVLSEASPDSTGDDMMQASATTVSDAADTTVDVETLDSWSNGTYTYVHVAVGEDSNEISSTTGTVTLSDSDDGSDSNDGNDDSDDNNDNNNDDSDDNNDNDDNDDNNNDGSDNSDDNNNNENDNSDDNNDNDNDDSDNGDSDEDSGDDDSDNESTEEDTADETTTDTDTEAGGGADPTEAATTAGGGAQQPDNTDTTGTEGTVETTSSSGPGFTVLVAVLALLGAGFLARRD

SEQ ID NO: 42686 - protein, 170 aa, Bacteroides fragilis YCH46
MALIKSVRGFTPEFGENCFLADNATIIGDVKMGQNCSIWFSTVLRGDVNSIRMGDGVNIQDGSVLHTLYEKSTIEIGNYVSVGHNVTIHGATVKDYALIGMGSTLLDHAVIGEGAIVAAGSLVLSNTIIEPGSIWGGVPAKFIKKVDPEQAKELNQKIAHNYLMYSDWYK

SEQ ID NO: 42687 - protein, 391 aa, Xylella fastidiosa Dixon
MSTEVKVPVLPESVSDATIASWHKKAGEIVKRDENIVDLETDKVVLEVPSPVDGVLKEIKFDTGSTVTSNQVLAIIEEESIVAAPSPAPSQVIDQKPVAVSAPAAKSNVDSLPPGARFTATTEGIDPAQIEGSGRRGAVTKEDIINFAKQNGAARASGTRLEERVPMTRIRQRIAERLMQSKNSTAMLTTFNEINLAKVSNIRKELQEEFQKAHGIKLGFMSFFVKAVANALQRFPLVNASIDGTDIIYHGYSDISIAVSTDKGLVTPVLRNVERMSFADIEHRIADYAKKARDGKLSLEELQGGTFTVTNGGTFGSLLSTPIVNPPQSAILGMHTIKERPIAENGHIVIAPMMYVALSYDHRIIDGKDSVQFLVDIKNQLEAPGRMLFGL

SEQ ID NO: 42688 - protein, 144 aa, Bacillus clausii KSM-K16
MTKPQKDELKKKLTPIQYFVTQENGTEPPFQNEYYETEEEGIYVDVVSGKPLFSSKDKYDAGCGWPSFTKPIDEAEIIEKEDRSHFMVRTEVRSKNADSHLGHVFPDGPGPNGLRYCINSAALRFIPKAKLKEAGYGAYEKLFD

SEQ ID NO: 42689 - protein, 359 aa, Ashbya gossypii ATCC 10895
MSDGAELKMAAQKRLLTGSDLDKWKASKTFEELLRFVSSLAQSVRGRENSEHAEPVSPAIEALEALLEEMQGIAAHHPVLQDAATSRFGKVEFRDFHKEVQARAEALVLQVDPSLTDEQAQELAVYLGNAWGDCKRIDYGSGHELNFVCFLYGLWKYGVLSEHDFTNAVLRVFVKYMDVMRVLETKYWLEPAGSHGVWGLDDYHFLPFLFGAFQLATHKHLKPKSIHNPEVVELFENRYLYFGCIAFINRVKTTASLRWHSPMLDDISGVRSWTKVSEGMVKMYKAEVLGKLPIMQHFFFSRFLPVPDGVSPPRTSEEELADCSEHAHSTWGDCCGIPIPSAVAASEATRKHSKPLPFD

SEQ ID NO: 42690 - protein, 478 aa, Xylella fastidiosa Dixon
MSEHYDVVVIGAGPAGYHAAIRAAQLGLKVACVDAALGKDGKPALGGTCLRVGCIPSKALLDSSRQYWNMGHLFNEHGISFKDAKMDVATMIARKDKIVKQFTGGIAMLFKANKITPYYGFAQLQPGNVVKVKQHEGKNIELKGANVILASGSDSVELPFATFDGETIVDNIGALDFTKVPKRLAVIGAGVIGLELGSVWKRLGAEVTILEAMPNFLAAVDADVAKTAAKEFKQQGLDIKLGAKVSRTEISSKNNKKEVIVTYTDASGKQTLTVDKLLVAVGRKAATKGLLADGTGVQLNERGQIVVDEHCHTGVDGVWAIGDCVRGPMLAHKGFEEGIAVAELIAGMPGHVNFETIPWVIYTEPEIAWVGKTEQELKADSIPYKAGSFPFAAVGRAVAMAEPSGFVKVLAHAETDRVLGLHLIGVNVSELVHEGVLAMEFSGSADDLARICHAHPTLSEAIHDAAMAVSKRAIHKAN

SEQ ID NO: 42691 - protein, 530 aa, Physcomitrella patens subsp. patens
MTMAIRLIKGASSTRGPFALLCAAAGARIRYSTAAAVSSTTTTVTSTTTTPAGHGAIAHGDPSFLESVDIYFDKAAAIASTTPDILAQIKACNNILKVQFPLKCANGTVELIEGYRAQHSHHRLPVKGGIRMAPNVDADETMALAALMTFKCAVVDVPFGGAKGGIKIDPTKYSMNEKEAIIRRYTSELVRKNFIGPSIDVPAPDYGTGPQEMAWIKDTFEHLQPNDINGSACVTGKPLEEGGIDGRTEATGLGVFFCLREFLNDETLVARLGMTKGIKGKTFIVQGFGNVGRHTVDYIHGAGGKIIAIAEADGGLVDESGDGLDIPAVKAYHKKKGTITGFPGAKTMKFAPSILELPCDVLIPAALESQIHSGNAGNIKAKIVAEAANGPVTPLAETILEDNDVVILPDLLLNAGGVTVSYFEWLKNLNHIHFGRMSKRMEERGKRVLIDALENEFGNGHRFSDTVRSQVVKGNTEVDFVWSGLEETMLSSWECVKKIAEERKCNFRTAAYLIAIERIATCYRVSGIFP

SEQ ID NO: 42692 - protein, 276 aa, Xylella fastidiosa Dixon
MVETQDKEIHDLRDEHWGERFSGIDRLYGLGTVARLSTCRVAVIGIGGVGSWIVEALARSAIGYMSLIDADDLCISNTNRQLPALIGQYGRNKAQAMAERCRAINPRINVSATELFLARSNMETLLGENFDLIIDACDSFRIKVETIVSCRLHKRPLITIGAAGGRTEPTLVRVRDISRTEHDTLLALIRKKLRSEFNFPKNPKRYFGVPAVYSLENVKYPQADGSVCGIRPSLISNAALNLDCSTGLGAATHVTGAFAFAATGKAIEMLLTPKKR

SEQ ID NO: 42693 - protein, 837 aa, Ashbya gossypii ATCC 10895
MFHACGSSAARGLVAYLGSEYLRRNVDMDYITQPTQQGTQATQKYVIEKFSQERIDDDVVCRVICTSGQLKIQDLKVDVREVVKKKEAIKQVWLFGRNRQSCDYHLGDISRLSNKHFQIMLGEDGNLLLKDLSTNGTWLNDVRIEKGQNMILGQGDEITVGKGVQQDVVNIVVFLNDNFQKKLETARLEGLRKPAKHTTLRTQSPRAPLTGIFKDFSINDEVVGQGAFATVKKAVERNTGKTFAVKIINKRKVMGNVDGVTRELEVLRRLNHPRIVSLKGFYEDDESYYLLMEFVSGGDLMDFVAAHGSVGEDAGREITRQILEAVRYIHEQGISHRDLKPDNILIEQDDPVLVKITDFGLAKIQDNTTFMKTFCGTLAYVAPEVIGGKNPEGNGANGNLYSSLVDMWSIGCLVYVILTGHLPFSGSTQEQLYKQIANGSYHEGPLKDYWISDEARDFIDSLLQINPVDRLTAERALQHPWLHPCTSIGAEIAVSLSQSLSQARALEGMDEAEYLVAQSEVASNRKAPTHEKRVILADHIAEENVGFRMPVHPPVRYTQKAQPVLGLEQDTRTHEEPVETHNERQLEDNTALLEGSVDSHTTYSTSNMQQKRKPTRAADGLFLTLHPLANSSVRKRIYVNQGINPFFIGRSDECHYKIPDNRLSRIHCFFLKKRHPVGNSIYESPAQGLDDIWYCHNGTNVSYVNDMKLLPGTKVLLQDGDQVKVIWDKAQNITIAFRVEINDSAGLFNSAAVTQNARHISQQTPDELALAVSFIELMRTQMHAIHNSETPPADTGSCSAVAAGNDAAASSILRKIHYSTLSQVPMKKAKTCQTRTS

SEQ ID NO: 42694 - protein, 117 aa, Arabidopsis thaliana
  misc_feature (80)..(80): Xaa can be any naturally occurring amino acid
MASSMLSSATMVASPAQVTMVAPFSGFKESVAFSVTRKVNNDITSIISNGGIVNCMQVGPPIGKKKFETLSYLPDLNDSXLAKEVDYFIREKRVPLGGTCRGGMEFEHREARVLTPE

SEQ ID NO: 42695 - protein, 501 aa, Magnaporthe grisea 70-15
MAATPTSPTPQPPLPRSVAPSYRTQEERKEIPTTTAEATLPLHNGDVESIHSPGHNSDMFRAERLQHRQQQQQELQDQQRHNLKRSRTLPPFIRPEGESGRNGFSPLHFLRICFRSSSAVSCAVNVLWPVVPAALVVRYSQPDWHLTIFALSYIAMVPCANLVGFAGQELARKVAHVYGVLVETTFGSIVEIILFIVLLVNGSLTPVIQAAILGSVLATMLLCLGLCFIAGGIRREETEHNEAISEAGSGLLLTAGVGLAIPAIFQKALKGSDLLTSQELSERTLSLSRATAILLILAYVVFVWFQAKTHHGIYDAIFEQDDQRDTDRRRDMSKEKLTLLECALALAVSLALVTIIAITLVEEIDFMVLERGISEAFMGLILVPLVEKAAEHLTAIDEAWDNQMNFALSHVLGATLQTALFNGPLVVIVGWILNKPMALDFHIFDIAVLLLAIITVGGFLRDGKTNYLEGSLCVIVYIAIAAAAYHYPNPAHLSGGSTGAH

SEQ ID NO: 42696 - protein, 141 aa, Ralstonia metallidurans CH34
MAIERTLSIIKPDAVAKNVIGQIYARFEAAGLKVVAAKMVHLSRGEAEQFYAVHKARPFFKDLVDFMVSGPVMIQALEGESAIAKNRDLMGATDPKKAEKGTIRADFADSIDANAVHGSDAPETAAVEVAFFFPGMNVYSR

SEQ ID NO: 42697 - protein, 476 aa, Pyrococcus furiosus DSM 3638
MPRLIKERVPTPERSVGERVRDFGEVNLGYSWELALREAERCLQCPVEYAPCIKGCPVHINIPGFIKALRENRDNPSKAVREALRIIWRDNTLPAITGRVCPQEEQCEGACVVGKVGDPINIGKLERFVADYAREHGIDDELLLEEIKGIKRNGKKVAIIGAGPAGLTCAADLAKMGYEVTIYEALHQPGGVLTYGIPEFRLPKEILRKELKKLSLLGVEIKTDHIVGKTITIQELLQEYDAVFIGTGAGTPKLPNIPGINLNGIYSANEFLTRINLMKAYKFPEYDTPIVVGKKVVVIGAGNTAMDAARSALRLGAEVTIAYRRGREDMTARIEEVKHAEEEGVKFMFFVNPVEFIGDENGNVKAVKFEKMKPLEERDSRGKRKIVGTGEYITVEADTVIIAIGQTPNKVLWRATPELKVDEWGRIVVDENLMTSIPGVFAGGDAIRGEATVILAMGDGRKAAKAIHQYLSKKGN

SEQ ID NO: 42698 - protein, 276 aa, Brucella melitensis 16M
MMVTYIEATSAPVKYTGQIRLYGPEAFEAMRKVCNLTARCLDALNDIVKPGVTTNEIDRFVFEFGMDHDAFPATLNYRGYTKSTCTSINHVVCHGIPNDKPLREGDIVNIDVTYLLDGWHGDSSRMYAVGEIKRASERLLEVTYESLLRGIAAVKPGAKTGAIGAAIQTYAESERCSVVRDFCGHGVGRLFHDAPNILHYGTPNEGVEIKEGMIFTIEPMINLGKPHVKVLADGWTAVTRDRSLTAQYEHTVGVTRDGCEIFTLSPANIFGPPSMR

SEQ ID NO: 42699 - protein, 247 aa, Synechococcus elongatus PCC 7942
MARAPAVGKLRSDRRFSPKAMTQKSVVIAPSILSADFSRLGDDVRAVDQAGADWIHVDVMDGRFVPNITIGPLIVEALRPVTQKPLDVHLMIVEPEKYVPDFAKAGADIISVQAEACPHLHRNLAQIKDLGKQAGVVLNPSTPVETLEYVLELCDLILIMSVNPGFGGQSFIPAVLPKIRKLRAMCDERGLDPWIEVDGGLKANNTWQVLEAGANAIVAGSAVFNAPDYAEAIAAIRNSKRPELVTA

SEQ ID NO: 42700 - protein, 76 aa, Triticum aestivum
MVNAIKGLFISCDIPMAQFIVNMNASMPASEKFIVHILDPTHMFIQPSMGDYIKSKMAEFRDHNSYEKPSVKGHHT

SEQ ID NO: 42701 - protein, 406 aa, Brucella melitensis 16M
MSEEFHKIRRLPHYVFEQVNRLKASARAAGADIIDLGMGNPDLPTPQNIVDKLCEAVQDPRAHRYSASKGIPGLRRAQAQYYARRFGVKLNPDTQVVATLGSKEGFANMAQAITAPGDVVLCPDPTYPIHSFGFIMSGGVIRSVQAKPDDNFIPTLERGVKHSIPKPIALILNFPSNPTAYVATLDFYKDVVAFARKHDIVILSDLAYSEIYFDGNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGVGFGEHGDDYVRIALVENEHRIRQAARNIKRFFSAKDENLQNVIPLEGHR

SEQ ID NO: 42702 - protein, 360 aa, Vitis vinifera
MGIYLSSPRKEKSSEDGENARVRYGLSSMQGWRTTMEDAHAAYPDLDSSTSFFAVYDGHGGKCVARFCAKYLHEQVLKNEACSAGDLGGSVRKAFLRMDEMMRGERGWRELAKFEDRVDRFSRINYDSMCSPMSDEFNDQNDDWTEEGPNYDFRGPNSGSTACVAIIRGDQLLVANAGDSRCVLSRAGEAYDLSTDHKPELQEEKERILKAGGCIQHGRVNGVLNLARAIGDNEFKMNKSLPAEKQMVTANPEINTASLCNDDDFMVLACDGIWDCMTSQELVEFVHEQLNSGCKLSAVCEKVLDKCLAPSSGGEGCDNMTMILVQFKKPIHSSASAGKQEPLPSDIPSGSNQAPTGTNS

SEQ ID NO: 42703 - protein, 286 aa, Salinibacter ruber DSM 13855
MAPHVAFQGEPGAFSEEAVRCVFDAAEVHPSATFEDVFEAVEEDAVGRAVVPIENAVFGSVRVNYDHLRTHAVTIIGELQLRIHHCLMAPEGATIDGLEVVRSHQQALGQCRDWLRAHVPGATPEATPDTAGAARVVAETGAPTTAAVASRRAAERYGLEVLAEGLQDNEQNFTRFLVLAPADTDAPPVGAGEPKTSITFVLQDNVPGALFKSLAVFALRELDLAKIESRPLVGQPGRYRFYLDVHGDLEDEAVARALDHLREITMELQVLGSYPRGATYPEGADR

SEQ ID NO: 42704 - protein, 365 aa, Parvularcula bermudensis HTCC2503
MGFQCGIVGLPNVGKSTLFNALTKTAAAQAANYPFCTIEPNVGDVAVPEPRIAKLAEIAGSAEIIPARIQFVDIAGLVKGASQGEGLGNQFLANIREVDVVVYVLRCFEDDDITHVEGRVDPIADFEIVETELMLADLESLEKRRSSLAKKATGGDKIAKDTLPLLDLALAELQEGRPARMAEVPKGSEKAWMGLQLLTQKPVLFVANVDEESAASGNAYADQVKARAAEAGAASVVISAKIEAELATLDEAETQEYLEELGLEEPGLNRLIRTGYELLGLQTYFTAGPKEARAWTIRQGTKAPDAAGVIHTDFARTFIRAETISFDDYVAAGGEQGAKDAGKQRIEGKEYVVQDGDVMHFRTGA

SEQ ID NO: 42705 - protein, 347 aa, Coprinopsis cinerea okayama7#130
MSGTSKSSQPRTLSTAEGFICGGIAACIAVTVSNPAEVAKTRLQLQGELAKGGGVRVYNNSLDVLKKTWRNEGIRGLQRGLGPAYVYQILLNGSRLGFYEPFRLAANSLLGWAPSDQVVMTSVFAGASSGAVGATLGNPLFLVKARMQAYSPSLPVGTQHKYRSSLHALSTIFKAEGPRGLVRGVDAAILRTSMGSSVQLPSYNFTKRTLVKNNILPENSTWTFLVSSAVSGACVLVVMQPADTALTRVYNQPTVIGPDGRVRGALYKNPLDCLWKTFKTEGVRGWYKGSTAHFMRIAPHTYEFIVVLTCAEADFGPCRIITLTANDIILNLYKKAKFGHLDQDADS

SEQ ID NO: 42706 - protein, 164 aa, Oryza sativa Japonica Group
MAQRDKKDQEPTELRAPEITLCANSCGFPGNPATQNLCQNCFLAATASTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 42707 - protein, 352 aa, Microcystis aeruginosa PCC 7806
MAGRLVILWGNPENVPISEKIKGKMGSILSVAPMMDYTDRHFRYFLRQISRRPLLYTEMITTMAIKHGDRYKLLGFSLAEKPLALQLGGDNPYLLAECAKIAEYMGYDEVNLNVGCPSSRVKEGNFGACLMANPELVARGISAMNQAVSIPVTVKQRIGIDDQDSYENMANFVRIVADAGCQRFTIHARKAWLQGLSPKENRTVPPLRYDDVYRLKNQFPHLFIEINGGIINLEQARQHLQLVDAVMIGRAAYDNPYLFATVDRDFYGESVTPPTREEIIKKMLPYIDEWVSKGYKLHQISKHLLQLFAGQPGTKAWKRYISENSHFPGADSGVIWQALQQVNSLNDLANSH

SEQ ID NO: 42708 - protein, 302 aa, Haloarcula marismortui ATCC 43049
MKRPQQSADMAPEQNGTTTVPTLGFGTYRTGGYKCYNAVKNALDCGYTHIDTAMAYENEAAVGRAIEQSSVDREDIFLTTKIKGYPEMVEYERLIEAAKGCLERLGTEYLDLLLVHWWNPLADMEETFNALNTLVDDGLVGQIGVSNFSIKELKQAMRLSDAPIATNQIEYHPYWGDEELVRFCQDNDVTVTAYSPLAEGRAVEDDVLRSIGDRYGKSAAQVSIRWLIQQENVVTIPKAATPKHIEANIDVFDFELTDRDMRRIRKLKPPFWYRENREGGSIYEARSVLGNFVPDSLYNRIA

SEQ ID NO: 42709 - protein, 163 aa, Ralstonia metallidurans CH34
MRHIISVLLENEPGALSRVVGLFSARGYNIETLTVAPTEDASLSRMTIVTTGSDDVIEQITKHLNRLVEVVKVVDLTEGAHIERELMLVKVRAVGKEREEMKRTADIFRGRIIDVTEKTYTIELTGNGGKLDAFLDAIDRTAILETVRTGGSGIGRGERILKV

SEQ ID NO: 42710 - protein, 365 aa, Coffea arabica
MVVFHQSILLFASAIVLFAVQHANSSSVETVHYNVTGYRGRHLGGGCNLFQGKWVVDSSFPPYESSGCPFIDYEFDCQKYGRPDKQYLKYAWKPDSCNLPRFDGLDFLKRWKGKKIMFVGDSLSLNQWQSFLCLIHASVPSANTNLVRKEILSYATFQDYDVTIYLYHSTYLVDIAQENIGRVLKLDSIDRGNDAWKGMDALVFNTWHWWLHRGDSQPWDYVQDGSTVSKDMDRLVAFSKGLSTWAQWVNQNVDSSKTKVFFQGISPSHYDGKEWGSDSKSCYGEREPLQGSTYPAGLPPAVDVVKKTLSSMQKPVVLLDITTLSQLRKDAHPSGYGGSTSGNDCSHWCLPGVPDTWNQLLYALL

SEQ ID NO: 42711 - protein, 472 aa, Anabaena variabilis ATCC 29413
MLIDSSGLSKVKDSVRKQIFFGNEPSAELIAILSVYFVQGILGLARLAVSFFLKDELLLSPVQVSALMGIVALPWMVKPLFGFVSDGLPIFGYRRRPYLVLSGILGAISWISLATIVHTSWAATVAIALGSLSVAVSDVIVDSLVVERAREESVSHVGSLQALCWGASAFGGLITAYFSGLLLEHFTTRTVFLITASFPLIVSGVAWLIAESPVSKDGSDNTNLLSVKQQLQQLRQAFTQKSIWLPTAFVFIWQATPTADSAFFFFSTNELHFEPEFLGRVRLVTSLASLIGVWIFQRFLKSVSFRLIFGWSTVISAVLGMTMLLLVTHTNRALGIDDRWFSLGDSLILTVMGQIAYMPVLVLSARLCPPGVEATLFALLMSVFNLAGMVSYEVGAIIMHWLGITETNFDLLWLLVLITNLSTLLPLPFLNWLPADDAEIETQALAPASANSQVSNLVSELRLREAEPKIVE

SEQ ID NO: 42712 - protein, 145 aa, Physcomitrella patens subsp. patens
MAAAAMTSIVPVASIAPVSKVANVRPSSVSVAKAFGLKSRSMGRLTCMATYKVTFLDGETGAENVVECSDEEYVLDAAERAGMDLPYSCRAGACSSCAGIIKAGEVDQSDQSFLDDSQIDDGFVLTCVAYPVSDCTILTHQEENM

SEQ ID NO: 42713 - protein, 338 aa, Candidatus Kuenenia stuttgartiensis
MSGSKIITVQRHIIEQERDHPEATGELTGLLWDLTIAAKIISREVNRAGLADILGLTGQENIHGEEVKKLDEYANDVIIKSMDHGGHLCVMASEENEDIIPIPDQYPKGKYMLMFDPLDGSSNIDANVSVGTIFSIYRRKTTAGNGTLEDCLRKGVEQVAAGYIVYGSSTMLVYTAGHGSHGFTLDPGIGEFLLSHKNIQIPSRGKIYSINEGNTNTWDEGTRKYINDLKKVTPETGQKPYSLRYIGSLVADFHRTLLYGGIFLYPADYKDPNKPKSKLRLLYEAAPLAFIVEQAGGKASTGDTAIMEIKAEQLHQKTPLIIGSKEDVEKYEGYFKNK

SEQ ID NO: 42714 - protein, 535 aa, Mesorhizobium sp. BNC1
MPVIPSQLSTAAESFRANEARMKSLVSEMAEKAAAIERGGSDEARARHTARGKLLPRERLAQLLDVGAPLLEIGQFAAFGLYEGDIASAGLIAGIGRVEGREVMVVVNDATVKGGTYYPLTVKKHLRAQEIALENNLPCIYLVDSGGANLPNQDEVFPDRDHFGRIFYNQATMSARGIPQIACVMGSCTAGGAYVPAMSDETVMVKGNATIFLGGPPLVKAATGEVVTAEELGGAEVHTRLSGVADHYAVNDEHALAIVRRIVKNLNRKKTIGLDLQKVIPPLYDPREIYGIIPADVRQPYDVREVIARIVDGSELDEFKQNYGATLVTGFAHLHGMPVGIIANNGVLFSESALKGAHFIELCCQRKIPLLFLQNITGFMVGAKYEAGGIAKDGAKLVTAVATAQVPKITAIIGGSFGAGNYGMCGRAFSPRFLWMWPNARISVMGGEQAATVLAIVKREGIERKGGSWTAEEEAEFKKPILEKYEREGHPLYSSARLWDDGIIDPAKTRDVLALSLSAALNAPIGETRFGVFRM

SEQ ID NO: 42715 - protein, 315 aa, Hordeum vulgare
MASSSYTSLLVLVALVTAASAQLSPTFYDTSCPRALATIKSGVMAAVTSDPRMGASLLRLHFHDCFVQGCDASVLLSGMEQNAIPNAGSLRGFGVIDSIKTQIEAICKQTVSCADILTVAARDSVVALGGPSWTVPLGRRDSIDANENEANTDLPGFNSSRAELEAAFLKKGGLNTVDMVALSGAHTIGQAQCSTFRARIYGGDTNINAAYAASLRANCPQTVGSGDGSLANLDTTTANTFDNAYYTNLMSQKGLLHSDQVLFNNDTTDNTVRNFASNPAAFSSSFTTAMIKMGNIAPKTGTQGQIRLSCSRVNS

SEQ ID NO: 42716 - protein, 148 aa, Triticum aestivum
  misc_feature (105)..(105): Xaa can be any naturally occurring amino acid
MAAAEPSGSSQPGAPGRWSLHGKTALVTGGTRGIGRAVVEELAALGVAVHTCSRKEAELGERLKEWEARGFRVTTSVCDLSVREQRERLIADVAERFGGKLNILXIVFISSVCGLVAVFSGTLYAMTKGAINQLTKNLACEWAKDGIR

SEQ ID NO: 42717 - protein, 347 aa, Armoracia rusticana
MHSSSSLIKLGFLLLLLNVSLSHAQLSPSFYDKTCPQVFDIATNTIKTALRSDPRIAASILRLHFHDCFVNGCDASILLDNTTSFRTEKDAFGNARSARGFDVIDTMKAAVEKACPKTVSCADLLAIAAQKSVVLAGGPSWKVPSGRRDSLRGFMDLANDNLPGPSSTLQVLKDKFRNVGLDRPSDLVALSGGHTFGKNQCQFIMDRLYNFSNSGKPDPTLDKSYLSTLRKQCPRNGNLSVLVDFDLRTPTIFDNKYYVNLKENKGLIQSDQELFSSPDASDTIPLVRAYADGQGKFFDAFVEAMIRMGNLSPSTGKQGEIRLNCRVVNSKPKIMDVVDTNDFASSI

SEQ ID NO: 42718 - protein, 566 aa, Candidatus Kuenenia stuttgartiensis
MEYTLIKTDDHWFRQNINCQYACPVNTPAMNYIELIAEENFDASLNLNFMANLFPPILGRVCTHPCETACRRGAIDSPIAICTLKRSAADFALHPFPQKKVAVKKTGKRIAIIGSGPCGLAAAHDLAVKGHDVIIYEALPVAGGMLSVGIPPYRLPRSIIENTLQWIKGFGVEILINTPVNTPEKFEELLQTFDAVYIAAGAHKSSRMDIPGEDLEGVIHGVSFMKETNLGTIKNVPKSVVVIGGGFTAIDCARTSLRLDAGKASIVYRRTREEMPAGEMEVQMAEEEGIEMLCLTSPVRLIGKDGKVTHIECVRNEPGKPDESGRRRPEVIEGSNFTIPVDLVIPAIGQAPDIVFLSERLGVKVNKWGMPLIDETGMTSRKGVFAGGDCVTGPRNVIEVIADGRKAAGSIHTFLTGQEKGDYQFYYKHQSPSKRVSDYEVAPRQKQESLPLDKRGCLDAESELGFSMENTLKEANRCLLCHYNIFIDEKCILCGGCIDVCPYNCISMVSRENISLPDSLRNEENIPEEWDAAMIIDEEKCIRCGLCVKRCPTRAITMKRFAYSEG

SEQ ID NO: 42719 - protein, 452 aa, Bacillus clausii KSM-K16
MKVAKFGGSSVANAEQIKKVAAIIKADNKRKIVVVSAPGKRYADDAKMTDLLIALAEAKVADQPVEAAFNAVMNRYESIANDLELNRDVIAEIEADLKNRLEQTVTGKGRFLDIMKASGEDNNAKLIAAYLSKIGLKATYINPKDAGLLVSDEPGNAQVLPEAYEALAKLAEIDGIVVFPGFFGFSKLGNLVTFPRGGSDITGAILAAAVQAELYENFTDVDSVYAANPFIVEDPVEIKRMTYREMRELSYAGFSVFHDEALIPAFRNDIPVCVKNTNNPKCSGTLILAERERSLNPIIGIASDEGFATIYVRKYLMNREVGFGRHLLQILEDAGISYEHIPSGIDDTSVIIRQTQLSDQLENAIIERIKEELNVDDVHIEHDFAMVMLVGEGMHNTVGVTARASSALAKAGVNIEMINQGSSEVSLVFGIHSKDTKQAVRVLYEEFFGQKQ

SEQ ID NO: 42720 - protein, 169 aa, Brassica napus
QRSDALLLSGESAMGQFPDKALTVLRSVSLRIERWWREEKRYESTPLQPIGSGFSDRISEEICNSAAKMANNLGVDAVFVYTKDGHMASLVSRCRPDCPIFAFTTTTSVRRRLNLKWGLIPFRLSFSEDMESNLNKTFSLLKSRGMIKSGDLVIAVSDMLQSIQVMNVP

SEQ ID NO: 42721 - protein, 235 aa, Coccidioides immitis RS
MPSAITDEGLKFNTIEETIEAFRNGEFIVVLDSQNRENEGDLIIAADAVTPAKMAFMIRYTSGYICAPILPELAASLDLPQMVTDSTDPNRTAYTISIDSNDPSVSTGISARDRSLTCRNLASPDVKPTDFRRPGHILPLRARPGGVRERNGHTEATIDFCRLAGKREVGVICELVEDGDEVAPNVAERTDCSMMRRDGCLRFGKRWGLKVCTIEDLVDYLEKTEGSLPTLNGKH

SEQ ID NO: 42722 - protein, 363 aa, Mycobacterium avium 104
MLQRIGAPRPYARSRPISITDVELAPPGRDEVLVRIEAAGICHSDLSVVDGNRVRPVPMLLGHEAAGIVERVGPGVADLAVGARVVLVFLPRCGRCAACATEGLTPCEPGSAANGAGTLLGGDIRLSRAGRPVYHHLGVSGFATHAVVNRASAVEVPPDVPAEVAALLGCAVLTGGGAVLNVGRPAPGQTVAVVGLGGVGMAALLTALTYDGVPVVAVDQLPEKLAAARRLGAHQAYTPQQAVEARVKAAVVIEAVGHPAALQTAIDLTAPGGRTITVGLPPPDARITVSPLGFVAEGRSLIGSYLGSAVPSRDIPRFVELWRAGRLPVESLVSSTIRLEDINEAMDHLADGTAVRQLIRFDA

SEQ ID NO: 42723 - protein, 131 aa, Brassica napus
MYNNMGPQPGMPMPQAVPQPNPFGNAFSGPGSGLIRSGLGAYGEKIFGSSSEYVQSNITRYFSDPQYYFQVNDQYVRNKLKVVLLPFLHRGHWTRISEPVGGRLSYKPPIYDINAPDLYIPLMAFGTYLVL

SEQ ID NO: 42724 - protein, 283 aa, Zea mays
MAAAGSSPSFSSSSKRLEGKVALVTGGATGIGEAIVRLFMEHGAKVCIADIQDEAGQQLRDALGGDAQGAMFVHCDVTSEEDVSRAVDAAAERFGALDVMVNNAGVTGTKVTDIRNVDFAEARRVLDVNVHGVFLGMKHAARAMIPRKRGSIVSLASVASAFGGTGPHVYTASKHAVVGLTKSVAAELGRHGVRVNCVSPYAVPTALSMPHLPQGARADDALKDFLAFVGGEANLKGVDAMPEDVAQGVFYLARDEGRYVSAVNLMVEGGFTAVNNNLRGFED

SEQ ID NO: 42725 - protein, 296 aa, Brucella melitensis 16M
MRCDWRKFDFCRTCTMQNWSMDMSVRMSSKVNAGLDQVDPIWHSIRAEAEEATRNDPVLGAFLYATILNQPSLEEAVMHRIAERLGHPDVSADILRQTFDTMLEANPEWSHVLRVDIQAVYDRDPAYSRFMDPVLYLKGFHAIQTHRLAHWLYKQGRKDFAYYLQSRSSSIFQTDIHPAARLGSGLFLDHATGLVVGETAVVEDNVSILHGVTLGGTGKSSGDRHPKIRQGVLIGAGAKILGNIQVGQCSKIAAGSVVLKSVPHNVTVAGVPARIIGETGCTEPSRVMDQMLGDGI

SEQ ID NO: 42726 - protein, 518 aa, Coprinopsis cinerea okayama7#130
MRKASCLLRPARAASRRRYSTHQPSSNVQITTLPNKLRVATDTTPGHFSSVGLYIDAGARYETPDTTGASYFLDRMAFKSTKNRSDEDMAAAISSLGSQIMASSSRETMMYQSSHFHKGTPLALELIADTIQNPAFAPEEILAQQDATAYEIREFTAKPELILPEILHNVAYGKGGLGNPLLCPEEHISAMNEVLLRDTMRKWYTPDRMVIAGAGMRHEELVELADKYFSGLKAPTQPSAPRTSSQPSQSVPPHLLSPSGSSIGKTLTRAASYLFPNPALPSIPSLSPKSPTSTYTGGHRFIHDPNAEFNHVYIAYEGVGIHDDDIYTLATLQVLLGGGGSFSAGGPGKGMYSRLYSHILNHYPQVDHCASFHHIYIDSSLFGLFASFVPAANGQQGGNTSSQILPHLINQLSLLVYTAVPKQELQRAKNQLKSSLMMALESRVVEVEDLGRQILVHGRKVPVTEMTAKIDQVDQDAVKRVATRLFGINSGNKPTVVCMGHDDVSNPAEVFRHYGLSA

SEQ ID NO: 42727 - protein, 175 aa, Brucella melitensis 16M
MPIYAYNGHKPQFADRESNWIAPDATLIGKVVVGENAGFWFGAVLRGDNEPITIGADTNVQEQTIMHTDIGFPLTIGAGCTIGHRAILHGCTIGENTLIGMGAIVLNGAKVGKNCLIGAGTLVKEGMEIPDNSLVVGSPARVLRQLDDAAVEKLRASAKHYVERGHSFMRGMEPA

SEQ ID NO: 42728 - protein, 162 aa, Brassica napus
VDPRVRLLQPEFVDPLNQTAMACPAFPLCPLAITEAERGIPSILKRVRAMFEKVGLEYDESVVVRVTGCPNGCARPYMAEVGLVGDGPNSYQVWLGGTPNQTQIARAFMDKVKIQDLEKVFEPLFYNWKLGRQAKESFGEFTTRMGFEKLKELISAYEGSPQ

SEQ ID NO: 42729 - protein, 284 aa, Burkholderia xenovorans
PLTFGPTPIQPLTRLSRHLGGKVHLYAKREDCNSGLAFGGNKTRKLEYLIPEALAQGCDTLVSIGGIQSNQTRQVAAVAAHLGMKCVLVQENWVNYSDAVYDRVGNIQMSRILGADVRLVSDGFDIGFRKSWEDVLESVRAAGGKPYAIPAGCSDHPLGGLGFAGFAQEVRAQEAELGFRFDYVVVCSVTGSTQAGMVVGFAADGRADRVIGIDASAKPEQTREQITRIAKHTAEKVGLGRDITSRDVVLDERFAGPEYGLPNEGTLEAIRLCARMEGMLTDPV

SEQ ID NO: 42730 - protein, 250 aa, Nostoc sp. PCC 7120
MQQSLDGIENPPDSTHTSLVKNLLSGIFLEPLLSDFQIIFERDPAARNWLEVIFCYPGLHAICLHRFAHWLHRRGVVFFPRLISHLARFLTGIEIHPGAVIGKGVFIDHGMGVVIGETAIVGDYALIYQGVTLGGTGKESGKRHPTVGNHVVVGSGAKVLGNIQIGDRARIGAGSVVLRDVPHDCTVVGIPGRIITHKPKTDLSPLEHGKLPDVEADVIRSLLTRIEQLEQKLQTLTNQAKEPELLTKDK

SEQ ID NO: 42731 - protein, 287 aa, Burkholderia xenovorans
PLTFGPTPIQPLTRLSRHLGGKVHLYAKREDCNSGLAFGGNKTRKLEYLIPEALAQGCDTLVSIGGIQSNQTRQVAAVAAHLGMKCVLVQENWVNYSDAVYDRVGNIQMSRILGADVRLVSDGFDIGFRKSWEDALESVRAAGGKPYAIPAGCSDHPLGGLGFAGFAQEVRAQEAELGFRFDYVVVCSVTGSTQAGMVVGFAADGRADRVIGIDASAKPEQTREQITRIAKHTAEKVGLGRDITSRDVVLDERFAGPEYGLPNEGTLEAIRLCARMEGMLTDPVYEG

SEQ ID NO: 42732 - protein, 292 aa, Cucumis sativus
TFYDESCPDVSNIVRRVVQQALVSDERAGARLIRLHFHDCFVNGCDGSVLLEDQPGVVSELAAPGNANITGFNIVNNIKAAVEKACPGVVSCADILAIASVGSVNLAGGPCWEVQLGRRDSRRANLQGAIDGLPSPFENVTQLKRKFDRVDLDSTDLVALSGAHTFGKSRCQFFDRRLNVSNPDSTLNPRYAQQLRQACSSGRDTFVNLDPTTPNKFDKNYYTNLQSNTGPLTSDQVLHSTPGEDTVKIVNLFAASQNQFFESFGQSMINMGNIQPLTGNQGEIRSNCRRLN

SEQ ID NO: 42733 - protein, 128 aa, Haloarcula marismortui
PTVEYLNYEVVDDNGWDMYDDDVFGEASDMDLDDEDYGSLEVNEGEYILEAAEAQGYDWPFSCRAGACANCAAIVLEGDIDMDMQQILSDEEVEDKNVRLTCIGSPDADEVKIVYNAKHLDYLQNRVI

SEQ ID NO: 42734 - protein, 349 aa, Armoracia rusticana
MGFSPLISCSAMGALILSCLLLQASNSNAQLRPDFYFRTCPSVFNIIGDIIVDELRTDPRIAASLLRLHFHDCFVRGCDASILLDNSTSFRTEKDAAPNANSARGFGVIDRMKTSLERACPRTVSCADVLTIASQISVLLSGGPWWPVPLGRRDSVEAFFDLANTALPSPFFTLAQLKKAFADVGLNRPSDLVALSGGHTFGRAQCQFVTPRLYNFNGTNRPDPTLDPTYLVQLRALCPQNGNGTVLVNFDVVTPNTFDRQYYTNLRNGKGLIQSDQELFSTPGADTIPLVNLYSSNTFAFFGAFVDAMIRMGNLRPLTGTQGEIRQNCRVVNSRIRGMENDDGVVSSI

SEQ ID NO: 42735 - protein, 96 aa, Synechocystis sp.
  misc_feature (96)..(96): Xaa can be any naturally occurring amino acid
ASYTVKLITPDGESSIECSDDTYILDAAEEAGLDLPYSCRAGACSTCAGKITAGSVDQSDQSFLDDDQIEAGYVLTCVAYPTSDCTIETHKEEDLX

SEQ ID NO: 42736 - protein, 283 aa, Bacillus clausii KSM-K16
MTHQTTVAILGAGSMAEALIGGIAKTNGGKAPHITVLNANNRKRLNQLHAAYGVHAAQSYEEAVKGKDVIVLAIKPHNVQEVADSLVSLLDPQKQLVISVAAGIKLETLESWLPADTAVIRAMPNTSARVLASATTLSIGTYATEWQLAFAKTLFSSIGTVTVVDEQQMDAATGIAGSGPAYIYYVAEAMLNAAIAEGLSPAEARALINQTIGGAAKQLSNSSKSPKDLYKEIMSPNGTTEAAIAHLDHSSAQELFQQAIHQAVKRSAAIGASFERDPIHKHQ

SEQ ID NO: 42737 - protein, 478 aa, Burkholderia xenovorans LB400
MHRATKIVATIGPASNTPEILLQMIQAGLDVVRLNFSHGTADDHRQRAGFVREAARQAGREVAIMADLQGPKIRVGKFENGKIMLVAGEPFVLDADCELGNEQRAGLDYKDLPRDLKPGDVLLLNDGLIVLNVSRVIGNEIHTVVKIGGELSNNKGINRQGGGLSAPALTAKDMEDIRTAMSLGVDYVAVSFPKNATDMEMARQLANIAGAPFGVKPKMIAKIERAEAIPALQGILDASDGIMVARGDLAVEVGNAAVPALQKRMIRMARESNKFVITATQMMESMIHAPVPTRAEVSDVANAVLDGTDAVMLSAESAAGKYPVQTIETMAAICIEAEKSEQSELDKDFLDRTFTRIDQSIAMGALFTAFHLGAKAIVALTESGSTALWMSRHWTHVPIFALTPRVGSERAMALYRNVTSLHLDTNTDRDTALQQALETVVSKGYASRGDMVVLTVGEPMGQAGGTNTLKIVRVGEPY

SEQ ID NO: 42738 - protein, 397 aa, Burkholderia xenovorans LB400
MNKVLRLSDLIAEGKLSGKRVFIRADLNVPQDDQGNITEDTRIRASVPAIKAALDAGAAVMVTSHLGRPTEGDFKPEDSLAPVAKRLAELLGREVPLVANWVENGVNVAPGSVVLLENCRVNKGEKKDSDELAQKMAKLCDIYVNDAFGTAHRAEATTHGIARYAPVACAGPLLAAELEALGKALGAPKRPLVAIVAGSKVSTKLTILKSLADKVDQLIVGGGIANTFMLAAGLKIGKSLAEADLVNEAKAIIDAAKARGASVPIPTDVVTAKEFSPTAKAEVKAVADVQDDDLILDIGPETAKVLAAQLEKAGTIVWNGPVGVFEFDQFGNGTKTLAEAIAKSSAFSIAGGGDTLAAIAKYGIHDKVSYISTGGGAFLEFLEGKKLPAVEVLESRA

SEQ ID NO: 42739 - protein, 458 aa, Listeria monocytogenes str. 1/2a F6854
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQILKASNRKTKIRHN

SEQ ID NO: 42740 - protein, 243 aa, Azotobacter vinelandii
IPPIPPVDFAKYGEIEEVPMTRLMQIGATNLHRSWLNVPHVTQFESADITELEAFRVAQKAVAEKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTISSLGHIGGTAFTPIVNAPEVAILGVSKASMQPVWDGKAFQPRLMLPLSLSYDCRVINGAAAARFTKRLGDLLADIRAILL

SEQ ID NO: 42741 - protein, 489 aa, Rubia tinctorum
  misc_feature (1)..(2): Xaa can be any naturally occurring amino acid
XXVSPLEQKNLGRIVQIIGPVLDVAFPPGKMPNIYDALVVKGKDTVGQPINVTCEVQQLLGNNRVRAVAMSATDGLTRGMEVIGTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLIVARARKIERFLSQPFFVAEVFTGSPGKYVGLAETIRGFQLILSGELDALPEQAFYLVGNIDEATAKAMNLEMESNLKK

SEQ ID NO: 42742 - protein, 243 aa, Azotobacter vinelandii
IPPIPPVDFAKYGEIEEVPMTRLMQIGATNLHRSWLNVPHVTQFESADITELEAFRVAQKAVAEKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTISSLGHIGGTAFTPIVNAPEVAILGVSKASMQPVWDGKAFQPRLMLPLSLSYDHRVIDGAAAARFTKRLGDLLADIRAILL

SEQ ID NO: 42743 - protein, 430 aa, Candidatus Kuenenia stuttgartiensis
MTIIYSIKAREILDSRGNPTVEVDVILKNGIMGRAAVPSGASTGKREALELRDTDKPSRFMGKGVQTAVKNVNEIISHKLEGMDATRQVEIDNLLIQLDGTKNKEKLGANAILGVSLATAKAAANALGVPLYRYIGGTNAKVLPVPMMNILNGGKHADNNLDIQEFMIVPVNADSFANALRTGAEIFHTLRSVLKSNGYNTNVGDEGGFAPNLKTNEEAIDLILQAIKDAGYSAGKDVYLALDSAASEFYQEGKYVLRTEGCKKKTSDEIIALYTEFLNKYPICSIEDGLAEDDWDGWVKLTNQLGKKVQIVGDDIFVTNTEILAKGIERGVANSILIKVNQIGTLTETLDAIELAKTNGYSVVISHRSGETEDYTIADIAVATNAGQIKTGSLSRTDRICKYNQLLRIEEDLSDNAIYGGKLCRLQKQV

SEQ ID NO: 42744 - protein, 282 aa, Listeria monocytogenes str. 1/2a F6854
MDISVYVASAFSKNNKGGNKAGVVLNEPTLATAQKMAIAKQLGYAETVFLTESNCADYKLEYFTPKEEVALCGHATIGTFAILMHLNKIHKSRYTIETNSGVLTITIKEDTIFMEQNQPTFYEVIPPNNLTGCFDLNLLNANYPIQIVSTGLKDILIPIKSEADLYALEPNFEKVKEISKQYEVVGMHLYTFSDDRIICRNFAPLFDINEEAATGTSNGALACYLYKNHYLRKENYVFEQGYSLHSPSEIFVNLVISNKDEIEKVYVGGKGYYCEMQELSLN

SEQ ID NO: 42745 - protein, 483 aa, Saintpaulia ionantha
  misc_feature (4)..(4): Xaa can be any naturally occurring amino acid
GVSXLEKKNLGRIVQIIGPVLDVAFPPGKMPNIYNALVVKGRDTVGQPINVTCEVQQLLGNNRVRAVAMSATDGLMRGMEVIDTGAPLSVPVGGATLGRIFNVLGEPVDNLGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSSGKYVDLAETIRGFQSILSGELDGLPEQAFYLVGNIDEVTTKAMNLEME

SEQ ID NO: 42746 - protein, 70 aa, Ashbya gossypii ATCC 10895
MIVPVRCFSCGKVVGDKWEAYLNMLQEEELDEGTALSRLGLKRYCCRRMILTHVDLIEKFLRYNPLEKRD

SEQ ID NO: 42747 - protein, 192 aa, Zea mays
  misc_feature (85)..(85): Xaa can be any naturally occurring amino acid
MGDSGGPHHHRPSPPPLLDAGKRRRIPNVRLAGSVPLPSHLPHPRRVPIAPATRSRKPLQLQHNSNQHDHPLRGATQYPPKTLRXSGDDVVLAAAFPRKVRAPKSTAWEDSEMETETEMEEQEEVVDVPSWLWGMGMGRYAAAFEAHEVDAEVLPWLTMDDLRDMGIGAVGARRKLFCAIQRLNLQPPPSRR

SEQ ID NO: 42748 - protein, 795 aa, Ralstonia metallidurans CH34
MSYQVLARKWRPRDFTTLVGQEHVVRALTHALEQQRLHHAYLFTGTRGVGKTTLSRILAKALNCTGPDGNGGITAQPCGQCKACTEIDSGRFVDYIEMDAASNRGVDEMAQLLDKAIYAPTAGRFKVYMIDEVHMLTNHAFNAMLKTLEEPPEHVKFILATTDPQKIPVTVLSRCLQFNLKQMPPGHIVSHLDHILAQEGISHDGSALRLLAQAAHGSMRDALSLTDQAIAYSAGQVSEEAVRGMLGAIDQSYLVQLLDALAAEDGATMLGIADSMADRSLSFAGALQDLGSLLHKVALAQAVPASVQDEWPEAEDVRRLARQFDAQETQLFYQIANLGRSELALAPDEYAGFTMTLLRMLAFRPSTAPASSVGGQGGGGQQVVRPRPAGTTSAAPSPRAMASAVAEPVAAEPVKVAPVVAPAAPTAPITAAAPAASAAPAMPAVPAKSAEPAPPQADVDTSMSPARAALAAARQASAGRAGRPMSAAPNAGAAAAASSRPAAQPLRPPSASRPATTAAPAPAPAVAPAAAPVVTPVVTQAVAPSKAAAAPVAAARPAPVAKPAPQPEAKSVPPWEAAGASDVPPWEEMPPDLPVIGPYDSDPGYDPSFGGFDNGFDSDSADRAPRAARKPAPTQSAAKPISKPEPEPAAQLAPAVPQVAPSAGEDGTPPVFTGDWPEFAATLPLKGLAQQLAHQSELHRVVGRTLHLRVPVAAIAEANVAERLQAALVEHFRVDVRVQCVVGGVTHTAAAVDAAARAERQREAEAEIDRDPFVQGLLREFGGQIVPGSIQPRAA

SEQ ID NO: 42749 - protein, 172 aa, Oryza sativa Japonica Group
MAGGVVIGVAPPAAAEEPEPHVERLPADLLAHVLSLLPSFHDLSMAGGVSRRWRRAVERSLAGRRRMSFAGQRTGDDSTARFVRAAVNLRDLDISRSCWGCQITDQGLIRISTADCVKNLTSISLWGLAGITDNGVIQLVSRAHSLQHLNIGGTFITDESLYAVAKSCINLK

SEQ ID NO: 42750 - protein, 398 aa, Propionibacterium acnes KPA171202
MAEQQTNGNWQERYHNALLGVFGNPQLCLDHGQGCVVVDNDGKEYLDLLAGIAVNALGYAHPAWVEAVSHQSETLAHVSNFFTTGPQLDLAEKLLALAKAPKGSAVFLSNSGTEANEAAIKICLARKNGRIIALDHAFHGRSLGALSLTHKIAYRQPFGPSAVDVTFIAPEDPDALASELDRGDVSGVFMEPIQGEAGVVPLSDEYLQQVRELTACHDVLMVVDEVQCGMGRTGRWFAHQSAHITPDVMTMAKALGGGFPIGVTMTFGSDVSGILAAGQHGTTFGGNPLACAAALAVISTIESDDLLTHVRQIGTLMSTALRQSHPRITEVRGTGALLGVQFDSDIAADLVAAARDAGFIVNAVNPSTLRLAPPYILTKAEAESFIAALPRLIDAVQA

SEQ ID NO: 42751 - protein, 126 aa, Mycobacterium avium 104
MFGGAAMLVLAVGCGGGHKGGPSTTSTTTPTTTPSTSVVPSTTPGGGGTVPGGPTGGGGPGGGGGSIPGGPTGGGGPGGGGGSIPGGPTGGGGPGGGGGSIPGVGGGGGGPGGGGGCVGNVCGAYP

SEQ ID NO: 42752 - protein, 310 aa, Propionibacterium acnes KPA171202
MTLALDIPLNDTQFSAQRKSEVLVEALPWIRRFQGRTVVVKYGGNAMVDPGLQQAFADDIVFMASVGIRPIVVHGGGPQINAMLAESATPVEFRNGLRVTSPEVMEVVRMVLVGQVGRQLVNRINAYAPLAAGMSGEDSGLLSARKSRVIVDGEQIDMGLVGDIVDVNIDLVISMLDRGQIPVIAPVSPEVDAAGRPTGQVLNVNADTAATAIAQALRAEKLVMLTNVAGIYGTWPDPHTLISEVSASDLRAMIPRLGEGMRPKAQALLDAIDGGVSSAAIVDGRIEHALLLEIFTTRGVGTMARSDDYV

SEQ ID NO: 42753 - protein, 172 aa, Picea abies
MSNPKVFFDMQVGGAPAGRIVMELYADVVPKTAENFRALCTGERGTGRSGKPLHFKSSTFHRVIPGFMCQGGDFTRGNGTGGESIYGEKFADENFARKHTGPGILSMANAGPNTNGSQFFICTAQTSWLDGKHVVFGQVVEGLDVVREIEKVGSGSGRTSKPVSIADCGQLS

SEQ ID NO: 42754 - protein, 270 aa, Triticum aestivum
MAATPLDSAWEWLITNFSEFQLATVVTFVLHESVFFLSGFPSLLFERLGLFAKYKIQKKSNTSAYQNRCVMRLILYHVCVNLPVMIFSYPAFKFMGLRSSLPLPHWGRSLYLEHPNRKFYFILEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFGTDKGYRKTKAIEGEEGKHL

SEQ ID NO: 42755 - protein, 438 aa, Coprinopsis cinerea okayama7#130
MNPILGRIAVGFVLCLISFIAYTSQIFVIWPWYGREWSIELLQLLVPFNILVAILFYNYYLCVTTDPGTVPPGWKPDTHSDGYEVKKLTGEPRYCRMCQCYKPPRTHHCRDCNRCVLRMDHHCPWINNCVGHHNYSHFLRFLFYVDVACSYHLAMVGKRTLDAMSGNYFWASVHIEPTATELVITIMNFVACVPVLLAVGGFSIYHLFNLLGNSTTIEGFEKDKVATMIRKGQIQEVKFPYDLGRMRNIKAVLGDNPLFWCWPQRMPGNGLKFELAHHADEHQVWPPRDPDSVGRPKIDLSASPFTYGNDTLNPELQPTNLRRRSFNGRGPPAHALPPYHPDYQEGYFVGEDGSWDESDEVCSEGDVPDGRVRVRRGSEGYEVKPQSREDMLRRYIEELGEDPYRYNRYEPEPFTESEEESDDDNIPLARVAATDKNV

SEQ ID NO: 42756 - protein, 157 aa, Brucella melitensis 16M
MPEAANAKPWRDFGMTVRSILETKGRDVVVIASADTLSQAVAMLNKHKIGALVVCDEAGHIEGILSECDVVRALAAQESQAMSKSVAEVMTSKVQVCHEHHTINQVMKIMTRSRFRHMPVEEGGKLVGIISIGDVVKRRIEDVEREAEDIRTYIATA

SEQ ID NO: 42757 - protein, 287 aa, Burkholderia unamae
PLTFGPTPIQPLKRLSAHLGGKVELYAKREDCNSDLAFGGNKTRKLEYLVPDALAQGADTLVSIGGVQSNQTRQVAAVAAHLGMKCVLVQEHWVNYEDPVYDRVGNIQLSRMMGADVRLVSDGFDIGIRRSWEEAMESVRQAGGKPYPIPAGCSEHPLGGLGFVGFAEEVRAQEAELGFKFDYVVVCSVTGSTQAGMVVGFAADGRADRVIGIDASAKPEQTREQITRIARHTAELVSLGRDIVPQDVVLDTRYGGPEYGLPSDGTLEAIRLCARLEGMLTDPVYEG

SEQ ID NO: 42758 - protein, 315 aa, Vibrio sp. Ex25
MVIVLVRLKLNTIKPLTLEQKITTSLFTDLWYTRRRFHLFFNIRWEIRMHPMLNIAIRAARKAGNHIAKSLENTDKVESTLKGTNDFVTNVDKEAEYIIIDTIKQSYPEHCIVAEEQGLIEGKDKDVQWIIDPLDGTTNFVKGYPHFAVSIAVRIKGKTEVACVYDPMQNELFTAQRGAGAQLNSARIRVAQLKDLQGTVLATGFPFKQKQHAESYIKIVGALFTECADFRRSGSAALDLCYVAAGRVDGYFELGLKPWDMAAGELIAREAGAILTDFAGGTEYMKSGNIVASSARGVKSILKHIRENGNSAILK

SEQ ID NO: 42759 - protein, 298 aa, Desulfitobacterium hafniense Y51
MTPLDKGLDKARVLIEALPYIQKFTGKTVVIKYGGHAMLDQDLKEKVMLDILLLHSVGIRPVVVHGGGPEINSMLTRVGKESHFVRGLRVTDKETMEIASMVLVGKLNTEIISLLNRFGGKAVGLSGKDAQLLQAVKKPMKFENSQGELEDVDLGFVGEIEQVRPEIVISLVEQGYIPVISPVAGGEDGESYNINADTAAGEIAKALKADKFLLLTDVPGVLRDVEDKDSLLSVIKEDEISGLIDLGVISGGMIPKVECARAALQGGVGSVHILDGRIPHAILLELFTDGGIGTMFNA

SEQ ID NO: 42760 - protein, 399 aa, Desulfitobacterium hafniense Y51
MCEKTHTMVQRGQKVVINTYGRLPMAIVKGKGTTVWDIEGKQYLDFVTGLAVSSLGHSHPAVVEAIQKQAEEILHTSNLYWIPNQIALAEKLVEHSFADQVFFCNSGAEANEAAIKIARKYAKEHYSEDKYEILTLVNSFHGRTLATLTATGQTKYQKGYAPLPEGFTYVPINDLAQLEEKMSPQVAAVMLEPIQGEGGVFPLEVEFLAKARQLCDDYGALLIFDEIQVGLGRTGKLFAYEWSNVAPDIMTLAKALGGGVPIGVMLAKENVAATFKPGDHASTFGGNPLATAVGCAVMDVLTEEGFLENVQKRAQYFKQELQKLADKYQTGTEIRGQGFILGWPLDRLGAEIVEGAREKGLLINFVGGKALRFLPPLNVSYQEIDEAITILDQIFAECW

SEQ ID NO: 42761 - protein, 245 aa, Ralstonia metallidurans CH34
MRQKLVIGNWKMHGSLAANAALLEGIKAAPARAKLAVCAPFPYLAQCQTLLSGSQVAWGAQDVSSEARGAFTGEVAASMLGEFGCGYALVGHSERRTYHGETDAVVAAKALRALEFDIVPVVCVGETLAEREAGQTEAVVGRQLQAVLDALSIEQLGRIVLAYEPVWAIGTGKTATSAQAQEVHAALRARVTAKDAGVAARMAILYGGSVKPDNAAELFSMSDIDGGLIGGASLKADDFLAIGNA

SEQ ID NO: 42762 - protein, 243 aa, Azotobacter vinelandii
IPPIPPVDFAKYGEIEEVPMTRLMQIGATNLHRSWLNVPHVTQFESADITELEAFRVAQKAVAEKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTIASLGHIGGTAFTPIVNAPEVAILGVSKASMQPVWDGKAFQPRLMLPLSLSYDHRVINGAAAARFTKRLGDLLADIRAILL

SEQ ID NO: 42763 - protein, 564 aa, Candida albicans SC5314
MSFSSGKFLFVFLFFFFFKNTSCSNQRKYITKQQTMSKDKKEHKDKKRKHDNEDVEIADSKKQRKLEKQEKKDKKDKKDKKEKKEKKEKKHKKEKKHKDSESSPVEPAANDSSSSTNYTQSSKLSSVSQSDIDKFLSDNEITVEDPSSSSLRPILSFDQVQLTSAITSKLSKFDKPTPIQSVSWPFLLSGKDVIGVAETGSGKTFAFGVPAINNIITTGNTKTLSVLCISPTRELALQIYDNLIELTADSGVNCVAVYGGVSKDDQIRKLKTANVVVATPGRLVDLINDGAINLGKVNYLVLDEADRMLEKGFEEDIKTIISNTSNSERQTLMFTATWPKEVRELANNFMNSPVKVTVGDRDELSANKRITQVVEVINKFDKEKKLIQLLRKYNANESSDNKILIFALYKKEASRIENFLKRNRFSVAAIHGDLSQQQRTAALSAFKSGQSNLLLATDVAARGLDIPNVKVVINLTFPLTIEDYVHRIGRTGRAGAKGTAHTLFTEDEKHLSGALCNILRGANQPVPEELLKFGGHTKKKAHSVYGAFYKDVDMTKTAKKIKFD

SEQ ID NO: 42764 - protein, 99 aa, Triticum aestivum
  misc_feature (70)..(70): Xaa can be any naturally occurring amino acid
LAELLVIAVVHLTYGFYLFTIAVCRDLSRLAGAPKDAVVGDGQAEAVLDGAVPPIVLVHGVLGFGKGRMXGMSYFAGAEEKDDRVLVPDLGSLTSVHDR

SEQ ID NO: 42765 - protein, 401 aa, Sinorhizobium meliloti 1021
MTATPAWTIQKPTALLVLADGTVIEGKGIGATGTVQAEVCFNTALTGYQEILTDPSYLGQIVTFTFPHIGNIGANDEDIEDLTPAARHGAVGVIFKADITEPSNYRAAKHLDAWLKARGIIGLCGIDTRALTAWIRENGMPNAVIAHDPAGVFDVEALKAEAKAWSGLEGLDLAKVATSGQSYRWNEKPWVWNEGYSTLGETDAAYHVVALDYGVKRNILRLFAGLNCRVTVVPAQTSAEEVLALKPDGIFLSNGPGDPAATGEYAVPVIQDLLKTDIPVFGICLGHQMLALALGARTEKMHQGHHGANHPVKDHTTGKVEIVSMNHGFAVDANSLPQGVEQTHISLFDGTNCGLRVDGRPVFSVQHHPEASPGPQDSHYLFRRFLNLIREKKGEPALAER

SEQ ID NO: 42766 - protein, 482 aa, Physcomitrella patens subsp. patens
MAAPRPRSVSNVGVLGKPLVDIRQTYSLGKELGRGQFGVTYLCTHKETGEKLACKSIAKRKLIAKEDIEDVKREVQIMHHLSGTPNIVDLKGVYEDRHSVHLVMELCAGGELFDRIIAKGHYSERAAADLCRVIVNVVHRCHSLGVFHRDLKPENFLFASKDEDAPLQATDFGLSTFFKLGEVFRDIVGSAYYVAPEVLKRNYGPEADVWSAGVIVYILLCGVPPFWAESEQGIFDAVLKGHIDFESEPWPRISSGAVDLVRNMLNPNVKERLTAYQVLNHPWMQEGGDASDEPLDNAVLDRLKNFSAANKMKKLALKVIANSLSEEEIVGLRELFKSMDTDNSGMVTFEELKQGLIRQGTGLKEADIRKLMEAADVDGNGKIDFHEFISATMHMNKTEKEDHLWAAFKHFDTDNSGYITHEELQEALENSGMGDPQAIQEIIREVDTDNDGKIDYDEFVAMMRKGNPDTEDGVMVVPPRHR

SEQ ID NO: 42767 - protein, 178 aa, Physcomitrella patens subsp. patens
MGFTAWWYAWTHALLYMSPYTYSAIGIAISIGVSVLGASWGIYITGSSLIGASIKAPRITSKNLISVIFCEAVAIYGVIVAIILQTKLEATKQPFHPDSMRAGYSLFASGIIVGFANLLCGLCVGIIGSSCALSDAQNSTLFVKILVIEIFGSALGLFGVIVGIIMSSQATWPAAVVA

SEQ ID NO: 42768 - protein, 400 aa, Sinorhizobium meliloti 1021
MAFLADALSRVKPSATIAVSQKARELKAKGRDVIGLGAGEPDFDTPDNIKKAAIDAIDRGETKYTPVSGIPELREAIAKKFKRENNLDYTAAQTIVGTGGKQILFNAFMATLNPGDEVVIPAPYWVSYPEMVALCGGTPVFVPTRQENNFKLKAEDLDRAITPKTKWFVFNSPSNPSGAAYSHEELKALTDVLMKHPHVWVLTDDMYEHLTYGDFRFATPVEVEPGLYERTLTMNGVSKAYAMTGWRIGYAAGPLHLIKAMDMIQGQQTSGAASIAQWAAVEALNGPQDFIGRNKEIFQGRRDLVVSMLNQAKGISCPTPEGAFYVYPSCAGLIGKTAPSGKVIETDEDFVSELLETEGVAVVHGSAFGLGPNFRISYATSEALLEEACRRIQRFCAACR

SEQ ID NO: 42769 - protein, 293 aa, Oryza sativa Japonica Group
MAASALDSAWEGLTGSFTEFQLATVVTFLLHETVFFLSGLPSLLFERFGLFAKYKIQKKSNTPSYQNRCVLRLILYHVCVNLPVMVLSYPAFKFMGLRSSLPLPHWTVIVSQVLFYFVLEDFIFYWGHRALHTKWLYKHVHSVHHEYVMLHLGLILLHFVIVPVLLNNNFLGRYATPFGLTSEYAHPAEILFLGFATIVGPALTGPHLFTLWLWMVLRVLETVEAHSGYHFPWSPSNFLPLYGGSDFHDYHHRVLYTKSGNYASTFVYMDWLFGTDKDYRNAKAIEEKDGKHL

SEQ ID NO: 42770 - protein, 249 aa, Solanum tuberosum
MKFNIANPTTGCQKKLEIDDDQKLRAFYDKRISQEVSGDALGEEFKGYVFKIMGGCDKQGFPMKQGVLTPGRVRLLLYRGTPCFRGHGRRNGERRRKSVRGCIVSPDLSVLNLVIVKKGENDLPGLTDTEKPRMRGPKRASKIRKLFNLGKDDDVRKYVNTYRRTFTNKKGKEVSKAPKIQRLVTPLTLQRKRARIADKKKRIAKAKSEAADYQKLLASRLKEQRERRSESLAKKRSRLSAASKPSIAA

SEQ ID NO: 42771 - protein, 222 aa, Phanerochaete chrysosporium
TLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEGGMWVKMREAQAMGQVA

SEQ ID NO: 42772 - protein, 200 aa, Glycine max
MAKGRKFPTTTGSERFLGLGMGTTTTTYSSQGSAAADRSEFWEEDVWSTAEHRDGDVNACPGEWEACAPPRRRNNRENCNVGGLSLAFEDGSGGGTRIVHHQYRAQHDAVSRQRQMATSAPVNVPDWSKILRADSVESLHGMDDGFDENNESEMVPPHEYLARSRKMAANSVFEGVGRTLKGRDMRRVRDAVWSQTGFDG

SEQ ID NO: 42773 - protein, 425 aa, Photorhabdus luminescens subsp. laumondii TTO1
MTESMLAKRRSAAIARGVGVTTQVYAERAENAEIWDVHGQRYIDFAAGIAVVNTGHCHPRVIAAAREQMEQFTHTCHQVVPYENYVALAERLNRLVPGNFAKKTVFVTTGAEAVENAVKIARAATGRSGVVAFSGAFHGRTFLGMSLTGKVAPYKMGFGPLVSDVYRVPFPVGLHGISVEQTLNALENLFKADIEPTRVAAIIIEPIQGEGGFYPAPPELLKALREIADCHGIVLIADEIQTGFARTGKLFAMEHHEVVADLTTMAKSLAGGLPLAAVTGRAELMDAVVPGGLGGTYGGNPVAIAAAHAVLDVIEEEKLNVRATQLGEQLKQRLHELRPHVPQIADVRGLGLMIAVEFNHADSQEPDANFTNAVRQKALECGLILLMCGVHGNVIRFLPPLTIQNDVFNEALNILESVLLDLTKQ

SEQ ID NO: 42774 - protein, 260 aa, Vibrio sp. Ex25
MIELRVLLLSFFSINSIYLFRFFQYYNLYYSLSRTNTDQTDTTEFGLELTILFRSKKMVLVGRQAPDFTAAAVLGNGEIVENFNFAEFTKGKKAVVFFYPLDFTFVCPSELIAFDNRLADFQAKGVEVIGVSIDSQFSHNAWRNTAIEDGGIGQVKYPLVADVKHEICKAYDVEHPEAGVAFRGSFLIDEEGVVRHQVVNDLPLGRNIDEMLRMVDALNFHQKHGEVCPAQWEEGKAGMDASPKGVAAFLSEHAADLGKK

SEQ ID NO: 42775 - protein, 133 aa, Arabidopsis thaliana
  misc_feature (72)..(72): Xaa can be any naturally occurring amino acid
  misc_feature (111)..(111): Xaa can be any naturally occurring amino acid
  misc_feature (122)..(122): Xaa can be any naturally occurring amino acid
KSVSKGAKEEEKQKEVVRASSMLSSAVGVTSRAQATRVASINGLEVIGGIRVTGKTKKEIISMESKGGRVAXMKGGPPMGKKKLETLFYLPDLRDVEWAKEVDYLLGKQGXSCVEFELEHGXVYREQGNTPGY

SEQ ID NO: 42776 - protein, 457 aa, Acinetobacter sp. ADP1
MPKEANMASQDYATQRSSLDAQALINDAPLSRYQWLIAIVCFLIVFVDGIDTAAMGFIAPALAQDWGVDRSQLGPVMSAALGGMIIGALVSGPTADRFGRKIVLSMSMLVFGGFTLACAYSTNLDSLVIFRFLTGIGLGAAMPNATTLFSEYCPARIRSLLVTCMFCGYNLGMAIGGFISSWLIPAFGWHSLFLLGGWAPLILMLLVIFFLPESYRFLIVKGKNTKKVRQILSRIAPQKVQGVTEFHVPEEKVEAGTKKGVFGMLFSAKYVKGTVLLWVTYFMGLVMIYLLTSWLPTLMRETGASLERAAFLGGLFQFGGVLSALFIGWAMDRFNPNRIIAGFYLAAGIFAVIVGQSLSNPTLLALFILCAGIAVNGAQSSMPVLSARFYPTQCRATGVAWMSGIGRFGAVFGAWIGAVLLGNNWSFTMILSMLIIPARAAAIAIFVKSLVAHTDAT

SEQ ID NO: 42777 - protein, 301 aa, Vitis vinifera
MATASVSATTSSLLLSPSKPTPPIKFRFRFRVRASSAMATQVAPAVIVGGGRVGRALQGMGSGDDLLVKRGDSVPLDFAGPILVCTRNDDLDAVLESTPKSRWSDLVFFQNGMLEPWLQSKGLSDADQVLAYFAVSKLGEPPIDGKTDTNPEGLTAAYGKWASAVAGRLHAGGLSCKVLDKEAFQKQMLEKLIWISAFMLVGARHPGATVGVVEKEFRSEVSSLIGELASAAAVEKGIVFDEGMEDRLCAYSRAVSHFPTAAKEFKWRNGWFYSLSQKAIAEGKPDPCPLHTEWLKELKIV

SEQ ID NO: 42778 - protein, 197 aa, Ralstonia solanacearum
MTDASISPSSPVPASTELGDVTRYLRERIRTVPDWPQLGVMFRDITPLLQDPKSLRVLVDVFVHRYMGQGLNLVAGIDARGFILGSIVAYELNLGFVPIRKKGKLPFTTVAEEYMLEYGSATVEIHADACKPGDRVLLIDDLIATGGTMMAGKRLLERLGATVVEGAAIVDLPELGGSRLLMDGGLPLFTVCRFDGH

SEQ ID NO: 42779 - protein, 801 aa, Aspergillus oryzae
MQHIIKRTNTEKSIPLKLLGRASYEAEAGGTDGPPEQGPIRGDAALHRKPSKEKKKGVSFLSRIIGGKKKDQILDDDDDDVSEPDTARMDTAQQIGFFPRFPRPPKYIRVRAHYKKEKTFSRIFVAQELEGADNVSNSSEKDGSSVAGARSSKTTGKAVWALVFSNDGKYLAAAGQDGKVRVWAVITSPEERHESEPEEDGSQDGEELPQLKAPVFKVKPVQVYEGHTGSVLDLSWSKNNFLLSSSMDKTVRLWHVSRPECLCIFQHSDFVTSIQFHPRDDRFFLAGSLDTKLRLWSIPDKSVAFVVTVPDMITSVAFTPDGRHSIAGCLNGMCNIYETDGLKPITQFHVRSARGRNAKGSKITGIDTAIFPKGDPQGEVKLLITSNDSRIRMYNFRDRTLEAKFRGNENTCSQIRASFSDDGKHVICGSEDRRAYLWPTAPIERDSDKRAVEVVEPQSAMVTAAIMAPSKTKQILGFSEDPIYDLCNPPPVTLGSSKENGPHRNSVASKQAQESPGYLARSNHPGGNIIIVADYSGKIKVLRQDCAYLKRRFESWDTHSTISRRLLRRTNSARHSIASSIGKESSHKTPSERIISWRNSVIGHTERKDGNHPGTRTRSPSPQRLANRSQYSSPRRGGSRSGYTISPPPSAYKTSTEYKTSLDSAGSSTEVPGRNGAANAPKTLQPAPSLVANKRQDQDNPLWLQGDHSYAFYKRIARDALAARNRDSPHHLDPNRLSVPGRRQPSVGSVLSSDYASSNGEGEESEDVLRCDNCEGTNFRATKGRNGKQKLICVRCSQPID

SEQ ID NO: 42780 - protein, 166 aa, Pelargonium x hortorum
MASADVEYRCFVGGLAWATDDHALEQAFSQYGEVVESKIINDRETGRSRGFGFVTFSNEKSMNDAIEGMNGQNLDGRNITVNEAQSRGSGGGGGRREGGGGGGYGRREGGGGYSRGGGGGGYGGGGGGYGGGNGGGYGGGREQRGYGDSGGGSRYSRDSDGGNWRS

SEQ ID NO: 42781 - protein, 310 aa, Aspergillus oryzae
MSTTTGAFIAGGIAACGAVTVTHSFETVKIRLQLQGELQAKSEAVKKYKGVFHGVKVILQNEGPRGLFRGIGSAYIYQVLLNGCRLGFYEPLRKTLTTTIYQDPQVQSLGINVFAGAASGIIGAAAGSPFFLVKTRLQSFSPFLPVGTQHNYHNSFDGLRKIYTSEGVGGLYRGVNAAMVRTGFGSSVQLPTYFFAKRRLVKHLGMEDGPALHLASSTASGFVVCCVMHPPDTIMSRMYNQTGNLYKGALDCLYQTVRKEGLLAIYKGYFAHLARILPHTILTLSLAEQTNKLMRRVEDRFLSDSMKEAL

SEQ ID NO: 42782 - protein, 460 aa, Triticum aestivum
MNSLQSFLAVAPVKPAAAAARLPSSRRARVSACLATPAPAPTTPAAAASARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTKKGEYFKQLLKTKLSGNPHVKEIRGAGLIVGIELDVPAGPLVDACLNAGVFLLTAGKGNVVRLVPALIVSEKELEQAAEVIRECLPALEASTS

SEQ ID NO: 42783 - protein, 466 aa, Escherichia coli CFT073
MSSVGGEPWGFSKTCFLLLIRCRLVNLNLFNLVYKSIMTTDDLTFDQRHIWHPYTSMTSPLPVYPVASAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEHAEIAPDILCLGKALTGGTMTLSATLTTREVAETISNGEAGCFMHGPTFMGNPLACAAANASLAILESGDWQHQVAAIEAQLREQLAPACDAEMVADVRVLGAIGVVETTRPVNMAALQKFFVEQGVWIRPFGKLIYLMPPYIILPQQLQRLTAAVNRAVQDETFFCQ

SEQ ID NO: 42784 - protein, 376 aa, Aspergillus oryzae
MAEAQQQQQPPPPPPPQSQSQQQTPSLCQKVSDILRSFRPTKAFKPSKQDSSNYVTSLDFDDQGDYLVSSGDDETIQIFDIKEGKTTKSVPSKKYGAHLARFTHHSRQVLHASTKVDDSLRLLDLHNEGYVRYFSGHTDKVTCLAVSPGSDSFVSCSKDNTVAIWDLSSRNAQGKLKLATPYLAAFDPSASVIAIASQSTSSVLLYDFRNYDKSPFSTFDLAPYEERYTPSTRGRAWTRLEFSNDGKHLLVGTDYHGHFVLDAFEGTMKAFLVGKNGSPGRAAPVSTTGKPLGQGDACFTPDGRFVLGGSGDHPDILAWDLQQQPDSNNVLQPMCKLPHRGRTALIEYNPRYNVVATADKDIVFWLPEEGSRAPEK

SEQ ID NO: 42785 - protein, 382 aa, Microcystis aeruginosa PCC 7806
MISSAANQKALLVLADGTVYEGYSFGAKGTTVGEVVFNTGMTGYQEVLTDPSYAGQIVTFTYPELGNTGVNPEDEESIRPQVKGAIAKNICHRPSNWRSSQSLPDYLAAHHVIGIYGIDTRSLTRKIRSVGAMNGAISTEILDYHDLLRLVQAAPSMAGLNLVKEVTTKEVYEWTTPTPSAWEFAPIDSDQEPLTVVAIDFGIKRNILRRLASYGCRVIVVPADTPPEKIAAYNPDGIFFSNGPGDPAAVTEGIALAKQLLQGEKPTFGICMGHQILGLSLGAETFKLKFGHRGLNQPCGLQQQVEITSQNHGFAVQEASLNPQVEITHLNLNDRTVAGLKHKSLPFFSVQYHPEASPGPHDADYLFGQFVDLMRQAKKDRA

SEQ ID NO: 42786 - protein, 464 aa, Listeria monocytogenes str. 1/2a F6854
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKNDANVKWTLYDLADRLQMRGWQVPAYPLPKSLENIIIQRYVCRADLGFNMAEEFIQDFQASIQELNNAHILFHNTQQSGVHGFTH

SEQ ID NO: 42787 - protein, 353 aa, Vibrio sp. Ex25
MVDQILFYEPDEPHGFLSNFCHAPVNISSQTWPTSEHYYQAQKFLDAQLQSKIQHASTPDEAFALSRKYEHFVRSDWEDMKLAVMAFIVREKFLQNPPLAQQLMRTGNACLTEHSHKDAFWGDGGDGKGENHLGEILMNVRAELRHVEPYNLVKFIDKAKLPTQWGTFMMYGFVETATNKEHLALVYGEPANSAAPLIRLHSECLTGDALFSTRCDCGFQLNRALQNIVEEGCGVLLYLRQEGRGIGLINKIRAYHLQDDGADTVEANERLGFAADMRDYAFCKGMLEHLGIDAVRLMTNNPRKLAALKAVDINVIERVPLQEGNNPSNQHYLQTKASKLGHMFDPKFVNHTK

SEQ ID NO: 42788 - protein, 273 aa, Trichodesmium erythraeum IMS101
MKIAIIGCGYVGSAVAKLWSQKGHKMIITTTTPERVSELQNITQQVVVMKGNDFNAMKDVLQNQEVVLLSVGDRYRTGYKQTYLETAETLLTALKKTPTVKQIIYTGSYSVYGDKNGEWVDENSSVTPATEGGKILHETEQVLLSASTPQQRVCILRLGGIYGPGRELVKIFSRWEGQTRPGSGNDVTNWIHLDDIVEALEFAKKKQLQGIYNLVNNVPMISRELLDGLHKYQGLGQIYWDDSTFSTRPFNARVSNQKLRNEGFELVHPEIVF

SEQ ID NO: 42789 - protein, 229 aa, Listeria monocytogenes str. 1/2a F6854
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNDDLKPVNKYYLDK

SEQ ID NO: 42790 - protein, 547 aa, Medicago truncatula
MGQAASTVTGTNRRESAGNRSTKTTRSTALVSPMISTDDGDDVADPVDGDGNDGIGNSDYISDLPDECLAIVFQSLNPSDRNQCSLVCRRWLHVEGQSRQRLSLNAKLDLLPVIPSLFNRFDSVTKLALKCDRRSVSIRDEALVIISERCPNLTRLKLRACRELTDAGMEAFAKNCKGLRKLSCGSCTFGSKGMNAVLENCAALEELSVKRLRGIAETAVAEPIGPGVAAASLKTICLKELYNGQCFGSLILGAKNLKTLKLFRCSGDWDTLFTLMAERVASMIVEVHFERLQISDIGLQAISNCSNLEILHLVKTPECTDMGLVAIAERCKLLRKLHIDGWKANRIGDEGLIAVAKFCPNLQELVLIGVNPTRVSLEMLASNCPNLERLALCASDTVGDPEISCIAAKCLALKKLCIKSCPVSDLGMEALANGCPNLVKVKVKKCKGVTPEGGDWLRHTRVSVAVNLDAVEAELQDASASDGGAQDNGIEFPSMPGSAASTSANIASRSTVRSSSFKQRLGLLSGRKIVASTLRRWSGGSTSARHG

SEQ ID NO: 42791 - protein, 93 aa, Anabaena variabilis ATCC 29413
MSVETIEKRSTSRKLAPRYRVLLHNDDYNSMEYVVQVLITTVPSLTQPQAVSIMMEAHTNGLALVITCAQEHAEFYCETLKDHGLSSTIEPDE

SEQ ID NO: 42792 - protein, 226 aa, Trichodesmium erythraeum IMS101
MVESIAERITNIKSNLPKSVRLIAVTKQVSVDTIRTAYAAGIRDFGENKVQEAEAKQAQLQDLPDITWHLIGHLQSNKVVKALKQFQWIHSVDNLKLAKRLNALAEQFCYSPNICLQVKILPDPNKYGWTITELMSDLEELNQCQHLKIKGLMTIPPQGLDDLQTLSVFQKTKELALEIREKNFSHLKTQELSMGMSEDYNLAISAGTTIVRLGRILFGERKNKKD

SEQ ID NO: 42793 - protein, 249 aa, Xanthomonas axonopodis pv. citri str. 306
MTRKLVLLRHGQSQWNLDNRFTGWVDVELTDQGRQEAVAAGRLMKDEGLQFDVAHTSVLKRAIHTLQGALKELDQDWLPVSKSWRLNERHYGGLQGLDKAETAAKHGEEQVKIWRRSYDIPPPAMDVNDPGHPCHDRRYATLDRNALPGTESLATTLVRVLPYWHDAIAPQLKAGQTVLVTAHGNSLRALYKYLNDVSNEQILELNIPTGIPLLFELDDSLQVRSFRYLGDPEAAKRAAEAVANQGKAK

SEQ ID NO: 42794 - protein, 237 aa, Thermoplasma acidophilum
MFIIGNTHTDAEIIEMILSLSAVRDYQVKSVNIIAPYYGYARQHQRYRRGEPISSQIFTEIFASYSTSIATVDIHDEQTLSYSKVRFTDLHADRSIIDFYRHVDIDYVVSPDDGGLQRVKHVAEALGKKYFYIEKKRIDDRTVEMKAPDIDLNGKKVLILDDIISTGGTIAKSSSILRQKGASKIYVSAIHGLFVNSSESKILENADEIHVTDTVAGKFSDISVYQVVCDYIAGKHA

SEQ ID NO: 42795 - protein, 330 aa, Moritella sp. PE36
MTKPVTTSVHAPGRFSIAPMLDWTDRHCRYFHRLLTKNTLLYTEMVTTGAIIHGRGDYLAYNKEEHPVSLQLGGSNPIDLAQSAKLAQERGYDEINLNVGCPSDRVQSGKFGACLMAEPTLVADCVKAMQDVVDIPITVKTRIGIDDQDSYEFLQTFIDTVAATGCKDFTLHARKAWLSGLSPKENREIPELNYQRVYDIKQDFPALFIAINGGVKTLAETQLHLGNVDGVMMGREAYHNPFLLSQIDELVYGGEKSIHSRHDYAEMMLPYIDNHIRNGGSLTHIYRHMLGLFLGLPGARAWKRHLSEQGHKKGAGVEVVEAALLLVPKS

SEQ ID NO: 42796 - protein, 321 aa, Medicago truncatula
MESGLPLLHSLLQHTLRNLCSFPTSSTSSKWVYAVFWRVVPRIFPPPRWEFGGTSLDRSKGNKRNWIIVWEDGFCDFNECEQRKSGCLNERFGADVFFKMSHEVYSYGEGLVGKVAADNGHKWVYSDTQNGCEANYVGPWNASIDHQPRAWEFQLNSGIQTIAVIAVKEGLVQLGSFDKIAEDLDLVLNIQRKFSYLQTIPGLLSFQRPQHIPFQHPCITKPNFQMMESNEISKNQVTKLNNMQDERSNYFSMIAINLGRNHPQNGTSMPPLWSPPLSLPNNHIQLHETNRINNTSHKVKIEEGTFHIANYGDQKGKAGWS

SEQ ID NO: 42797 - protein, 476 aa, Photorhabdus luminescens subsp. laumondii TTO1
MPVPTLRHFINSQYVESKSSEYFDLISPVTGETYARSPNATIADVNEAYASAKEAFKIWGRSTPSARQQALLALADAVEKNSERLIEAQSRNTGQLKHLIASEEVAASVDHIRFFAGAARFLEGKATAEYLPDMTTSIRREPLGVVGQVTPWNYPLMMAVWKIAPALAAGNTVVLKPSDTTPESTLLLAELAAPFFPTGAFNVVLGNASAGALVVSHKTPAMVSITGSVRAGLQVASSAAANLTRAHLELGGKAPVVVFADADMDKAVETIATAGYFNAGQDCTAASRVLVHESVYDTFVAKLVAAAKATRFGYPEDEEALYGPLNNARQLEQVKGFIARLPAHACIETGGRQAERSGYYFEPTVITGLEQHDEAIQTEIFGPVITVQKFRDEQDAIEKANDVKYGLASSVWTRDHGRALRLSRELDFGTVWINTHIPLTAEAPHGGFKSSGYGKDLSAYGFDEYTRIKHVMSSND

SEQ ID NO: 42798 - protein, 182 aa, Escherichia coli O157:H7 EDL933
MQFNIPTLLTLFRVILIPFFVLVFYLPVTWSPFAAALIFCVAAVTDWFDGFLARRWNQSTRFGAFLDPVADKVLVAIAMVLVTEHYHSWWVTLPAATMIAREIIISALREWMAELGKRSSVAVSWIGKVKTTAQMVALAWLLWRPNIWVEYAGIALFFVAAVLTLWSMLQYLSAARADLLDQ

SEQ ID NO: 42799 - protein, 372 aa, Zea mays
  misc_feature (101)..(101): Xaa can be any naturally occurring amino acid
MVKVIQGRPAEMGFRMPAEWEPHEQCWMGWPERPDNWRENAGPAQEVFARTAIAISKFEPVTLCASAKQYPKVHELMEHQTNIRVVEMSMNDSWFRDMGPXFVTHKGDSGIAEQTIAGIDWQFNAWGGIYDDWSLDSDVAKKIVEIERIPRFPQKIILEGGSIHVDGEGTCITTEECLLNPNRNPNMTKLEIENELKDFLGVSKVIWIPRGLYGDEDTNGHIDNMCCFIKPGVILLSWTDDEKDHQYERSVEALSVLSQSVDAKGRQLQVVKIHVPGPLYMTEEEAQGVVSSGHSVPRPAGTRLAASYVNFYIANGGIIAPSFGDRWDEEAYAVLQKAFPDHEVVMVEGGREIALGGGNIHCITQQQPVRLS

SEQ ID NO: 42800 - protein, 116 aa, Arabidopsis thaliana
MQDSKIPPFSEAKRMKIPTPKQPLTQLPPRIGKKVSNRSKSNQVHAISHQLEMSRNSDSSPGNEYRALRRKYLLLEEDSFALERELKEAEDEVKALEDEKLELLDKLVVMEGLVDP

SEQ ID NO: 42801 - protein, 334 aa, Corynebacterium amycolatum
DVHNVAFSKPPIGKRGYNEDEVDQFLDLVEDALGELQDENAELRQRVEDLEGQLEQGGDADYAASGAVAATPAVDEDKLRKEIEQELRAEYNERLNAQQQEIEARYQDRLDALEKRASEAEASAQQASSASAAQSQTVAASTGTESQEVSLRAARILQAAQDTADRVTTDADAEANKLVTEARENADRTVAEANEEAERTVTNARNEADATLADAKERSEQLLADARNESESTLTDARQRSEQMISDADARSNATITAAQQKATALQEDAERKHHEIMTTVKEQQTALEGRIEELHIFEREYRTRPEDLPGVSAGRPELSRVGCPGRRLQQLIT

SEQ ID NO: 42802 - protein, 692 aa, Arabidopsis thaliana
MSFKIKGHPHRVSLVKNHDGLECDACDQSYGDAYSCGECKFTVHKKCTFLFEVVPEIFEHPSHVGHCLKLLTTGAPDHTVPKCHLCGKNTKRLLYHCRDCKLNVDIDCIIDPMCAQADLNMPWHHHPLFMGNFATNMTCDVCYDNHVDGYICLCCRLFVGWVCAALVIDSPEITHPCHTKHPLKLLTEGAPTYTDPKCHLCGEDTGKFIYHCDICKFNLDLVCAKTKTPPVALSNLKVHEHTLNLMPRLISFVCDACGTKGDRAPYVCHQCDFMVHKKCAHLPRVINVNHHDHRVSFKYPLGLGEWRCGVCFEEIDWSCGAYSCSLCPQYAIHSLCATRKDVWNGKELDGVPEEVEDIEPFKRNDDNTITHFAHEHNLMSLSKDGEESSLCGACVLPIGSYTFYKCSKSNCSFILHEKCANISKKKRHFLSSEPLILCFESIIDDDFLCRACYQMFCEGFFYSSKGVNFDLICSSITMPFIHGSHDHHLLYVKQEEGNKKTCHNCDNERAKVLLGCIKCNYFLDFRCATMPLTIMLPRYDDHPLTLCYGEEKASGKYWCDICERETNPETWFYTCNDCGVTLHTFCVLGDIRNAKAGGSFRHHGELELLPNNRSTRPLCNSCHSRCPGSFIMKSYDGGEVYCSCYCVSSQLGYTYKGADTCPPWAIYELELIVVIHVNYLSTYILHYLTAIK

SEQ ID NO: 42803 - protein, 70 aa, Chlamydomonas reinhardtii
MTVSKRVANAKSGKFHKGVHKRGLVDEAKQKKTSKLPVGPLMLGFFIFVVIGSAVLQIIRTATNPRELPA

SEQ ID NO: 42804 - protein, 214 aa, Thellungiella halophila
MGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 42805 - protein, 501 aa, Ralstonia eutropha JMP134
MSRLIEHFIAGASYVDPNTRTGPVFNPSTGEEAARCAYGSFATVDHAVTVAAEAGRRWGRLSHAARQAVIFKMRELVIANMDVLADAIGREHGKTISDAKGELGRAVEGIEFACNAPHVTKGEYAFNVGGDIDVFSVRRPIGVVGCITPFNFPIMVPAVMMTMAISVGNAIVWKPSEKVPTAALEFARLWKEAGLPDGVLNIVQGDKEVVDAILEHPEVAGVSFVGSTAVGEYVYQKGTSHNKRVASFTGGKNHMVVLPDADLDAAATAFVSAGYGSASQRCMAISLLLPVGQETADRLRDLIIPKIEALKVGAYDDASADFGAVVSKESKQFVEQSISRCLEEGGELVLDGRKLQVAGHPHGYYLGPTLFDRVTTDMHLYKEEVFGPVRAIMRPTTFDEAIEITNKHEYGNGSVLFTRDGKSAHRFMLEIESGMVGINVPVPLPSAYFNFGGLRRSKFGESHLYGPDAARFYTKLKTVSQRWPEPDERALPVSLAFNPSA

SEQ ID NO: 42806 - protein, 198 aa, Zea mays
  misc_feature (78)..(78): Xaa can be any naturally occurring amino acid
  misc_feature (136)..(136): Xaa can be any naturally occurring amino acid
MLLMLHETLPFVRPSSCRDPKLSEKSASALHGKLGCSAVCSSAEGHRVQKPHIVHSYKVSFTRTSHHLCKSLNERTTXHRFHVNASPDDDDFRSSRNISLGCTDEGLRKELMDIEDSGLEIEGLGSLGGTSLKFKXHSFEIRECILWLSIVFVTILCTPQLTVIRWSPNPPVSADVLHQWKGFCALIANAYYVKGMAW

SEQ ID NO: 42807 - protein, 641 aa, Bacillus licheniformis ATCC 14580
MMILQVNQLSKSFGADTILTNIKLEVRSRDRIAVVGRNGAGKSTLLKIIAGKLSYEKGDIIKPKDLTMGYLDQHSGLDSKLTLKEELLSVFDFLKKMEKEMRAIEEKMAQAGPDKLESLMKTYDRLQQEFKDKGGYQYEAEVRSVMHGLGFAGFDDSVRVQDLSGGQKTRLALGKMLLTKPDLLILDEPTNHLDIDTLTWLEQYLQSYSGAILIVSHDRYFLDKVVTQVYEITRSQSKKYIGNYSSYLQLKAEQLERETKLYEKQQDEIAKLQDFVDRNLARASTTKRAQSRRKQLERMEIMDKPLGDEKSASFRFEITRQSGNDVLRVEDLTVSYQDQPPLLRSLDFRITRGESVALVGPNGIGKSTLLKALIQKLQPVSGTIATGSHVSIGYYDQEQAELTSSKRVLDELWDDYPEMNEKDIRTCLGNFLFSGEDVLKPVHALSGGEKARLALAKLMLQKANFLILDEPTNHLDLDSKEVLENALIDYPGTILFVSHDRYFINRIATKVLELSRDKAEEYLGDYDYYTEKKAQQLELKELEKQTEERQKAASEKPGAKKSYEEEKELKRKERQRQRRIEDIETRITAIEEQIEKNEELLCNPDVFQDHEKVQEIHSENEQLNEELEQLLSEWETLSTNE

SEQ ID NO: 42808 - protein, 91 aa, Zea mays
MASGQESRKELDRKAREGETVVPGGTGGKSVEAQEHLAEGRSRGGQTRREQLGQQGYSEMGKKGGLSTTDESGGERAAREGVTIDESKFTK

SEQ ID NO: 42809 - protein, 272 aa, Sinorhizobium meliloti 1021
MSIAVSGPIVLVGAGNMGGAMLAGWLKSGVRGSDVLVIDPGPSPAMAKLLADSGVQHATSAPAGGKAGAIFLAVKPQVMETVLPPLKGLVGPQTVIVSVAAGKTLGFIERHLGEAATVRAMPNTPAMIGRGVTGAFANARVSEAQRALVHDLLKVSGPVEWVGSEADIDAVTAVSGSGPAYVFYLVECMAEAGRKAGLEADLAMRLARETVAGAGELLHQSPDDAARLRQNVTSPGGTTAAALAVLMADDGMQPLFDRAIAAARKRAEELAG

SEQ ID NO: 42810 - protein, 275 aa, Trichodesmium erythraeum IMS101
MAITKLGLIGGGVMGEALLSRLIKQNVYLPSEILVSDPQQQRRNLLTQEYGVQVTTDNSLVVTSTTEVLLLAVKPQIFDSVVSQLGDWQVAGKTTTLPLLISIMAGVPLQKLEAFFCGQPVVRVMPNTPATVGVGMSAIALGKNVQPSHRELATCILASIGQVVEVSESLMDAVTAVSGSGPGYVTIFIESLTDGGVRAGLPRAIAYQLALQTVLGTAVLLQESGMHPAQLKDRVTSPGGTTIAGIAELESAGFRSAIIEAVLAAKEKAEELGNS

SEQ ID NO: 42811 - protein, 96 aa, Zea mays
  misc_feature (68)..(68): Xaa can be any naturally occurring amino acid
KLVVDNYALSQIYDRDGLTLHEFVKGDMYIRDLKNTKGHISELTGGEWNPKSKETILTSSEDGSIRLXDVSDFKKKQIISAVAGGITDLSFHAGGY

SEQ ID NO: 42812 - protein, 275 aa, Vibrio vulnificus CMCP6
MPTSQDLSALLPQVIDIARTAGQLILDIYQSKQYQEYTKSDETPVTSADLAAHKLINQRLSELTPDIPVLSEEAADISLEQRAQWNRYWLVDPLDGTQEFIARSGDFATIIALVENNKPVMGVVYGPVSGVTYYAYQGKGAWKIPEMNESLKIQTHKHELPGQNIAIAISRRQDINRITNRMSSSWNYDLVPLGSAALKACLVAEGAVDCYLRLGPTGEWDTAATQCIVEEAGGRILSTYLEPLSYNERDTLENPNFIVLGDADLPWNDILQVKG

SEQ ID NO: 42813 - protein, 329 aa, Synechococcus elongatus PCC 7942
MPKILNRLTEWIGNTPLVRLQETAQQYGAIAEVLLKLEYLNPLGSVKDRTALSLIQSARSQGLITAGTTLIEPTTGNTGIGLAFAAAAEQLRLILVMPDRVSAERIRLAKLLGAKVVLTPAAEAMLGCIAKAQALQQQIPDSVILQQFQNPANPSIHQATTGPEIWRDTDGEVDIVVAGVGTGGTLMGISRYLKPLRPRLQSIAVQPARSPVLSGGAAGSHQLTGMGPNFVSPLVDRSLIDEILSAYEEDAIAVIRTCAAREGIPLGVSSGAIVWAALQVAKRPENAGKRIVAVCPSGSERYLSSTLLADISLESDDVSDWVAIPQGQA

SEQ ID NO: 42814 - protein, 508 aa, Synechococcus elongatus PCC 7942
MTSVARQLGRSPVYAQNVVATSHPLATAAGIEALRAGGNAIDAAIAAAITLTVVEPTGNGVGGDTLAQIWTGDRLYGLNASGRSPKAWTPERFAHIPQMPKRGWDSVTVPGAVSAWVALSDRWGQLPFAQLFKEAIRHAEEGFAIAPHVAYWWRFYAPKTAPTVGHWQRNPELAQSLRQIADSHGEAFYRGDLAQQAIAAAQAAGGSQTLADWAEHQVEWVEPFSVSYSGAEVWALPPNSQGMITLIALELLKRWHGPESASESGANQHRLLEVVRAALDLGYRELGDLAWMPLTPAELLDSKRLDRLAATLKPTTAAIYRPQVTPTGGTVYLCTADAQGRMVSLIQSNYQGFGARVEVPGTGLTFNNRGACFVLTPEHPNQVGPQKRPFHTLTPGFLTRNGQALAAFGIMGGPLQSQAQVQLLHRLLDRGENVQAAIEAPRWEAQSHGRVRIEPGFPATTYASLTRRGHRLERLTEPRLGGGQIIWRQPQGYVAASDPRKDGQASGF

SEQ ID NO: 42815 - protein, 281 aa, Oryza sativa Japonica Group
VRLARTASAMAHLATVVLLLVAAARQAPLAAGDHSANPRLPTCAAAPDVAAPQEHGDGGGVGGGRRILDITHAVRAELPVLGSCDGVGALVRLKKSMANGSRSNLSELRMSVHTGTHVDAPGHMWQPHFDAGLDVDTLDLGLLNGPALLVDVPRHSNVTAEVMESLNIPRGVRRVLFRTMNTDKRLMWQKESDLSFVGFTEDGAQWLVGYTDIKLVGVDYLSVASYEHMIPAHVVFLKSKEIVIVEALKLDDVEPGMYMLHCLPLRLAGAEGSPVRCILIK

SEQ ID NO: 42816 - protein, 677 aa, Zea mays
MAPHTTADDDGEGNALSVERAFADQAVPSWREQLTVRAFVVSFFLAIMFSVIVMKLNLTTGIIPSLNVSAGLLGFFFVRLWTAAIERVGLLRQPFTRQENTVIQTCVVAAYDIAFSGGFGTYLFGMSETIAKQATEADNPQNVKNPHIGWMIGFLFLVSFIGLFALVPLRKVMIVDYKLTYPSGTATAYLINGFHTPEGAKLAKKQVKTLGKFFLMSFLWGFFQWFYTGGDNCGFQNFPTLGLQAYKNKFYFDFSPTYVGVGMICPHIVNVSVLLGGILSWGIMWPLIGNQKGSWYDASLPESSLHGLQGYRVFISIAIILGDGLYNFVKVLIRTTAGFISMMKKNSTLPVSNNGSPITEGVSFDDERRRDLFLKDQIPRSVAYGGYVAVAAISIGTLPQVFPQLKWYYILVAYIFAPVLAFCNAYGTGLTDWSLASTYGKLAIFIFGAWAGASNGGVLVGLAACGVMMSIVSTAADLMQDLKTGYLTLASPRSMFISQVIGTAMGCVIAPCVFWLFYKAFADIGLSGSEYPAPYAIVYRNMAILGVDGFSSLPKNCLTLCYIFFAAAIVVNLVRDLVPKNVARFIPLPMAMAIPFYLGSFFAIDMFIGTVILFAWETINKAKANAFAPAVASGLICGDGIWTLPQSILALAKVKPPICMKFLSRSVNAQVDGFLGS

SEQ ID NO: 42817 - protein, 144 aa, Bacillus clausii KSM-K16
MKKGSIEFENGEKIVIEFYEDAAPGTVENFETLANKGFYNGLTFHRVIPGFVAQGGDPNGNGTGGPGYTIKCETEGNPHKHVPGALSMAHAGRDTGGSQFFIVHEPQPHLDGVHTVFGQVVEGLDSVYRIKQGDVMLEVKVWEE

SEQ ID NO: 42818 - protein, 200 aa, Moritella sp. PE36
MVLVGRQAPDFTAAAVLGNGEIVDNFNFAEFTKGKSAVVFFYPLDFTFVCPSELIAFDHRLEEFQKRGVEVIGVSIDSQFSHNAWRNTSIEDGGIGPVKYPLVADVKHDICQAYGVEHPEAGVAFRGSFLIDTNGVVRHQVVNDLPLGRNIDEMLRMVDALNFHEKNGEVCPAQWEAGKEAMEASPEGVAKYLSKNAKGL

SEQ ID NO: 42819 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPPKDDVFKTHPMNFLNEKTLKGTFFGNYKPRTDLPNVVELYMKKELELEKFITHSVPFSEINTAFDLMLKGESLRCVMRMDE

SEQ ID NO: 42820 - protein, 1420 aa, Yarrowia lipolytica CLIB122
MKSNEQLNKENAPTNTNEYQRTPANTHSNPVLHTASNAADQTFEVVRKLTPEASTIQIRESADPLAHIVNSPAAADSLLAVVASSHVLVKGLAHLSAFKNRAVVFHVETGSDYNDIAAIRHSQYVMLQSFGLEDVQEVAIKAYEVSKATGQPVIHFYAPVEGEVSLIPGNEIVSKVEKVETDSEKQLEQPIIAPQYIGSSSAPSALIVFGSSTQLFIDNVKAHSQTGLVLVRQYRPWSVQAILNVLPKSVKTLGLAEQIKSRTTAWSPLVLDYVADIHASGIDRDSAPKPVAFHLGQVTEATVNHVFAAISSNLTSASPVQNLTVGSGVTPNETKEEVKAEALTLETAYTKILHELFKEVNIINASDKKDAGLTSPEYGYGAYLAYQEKRKELSERVRTAIRKNELGEELHKLLTMWAINREVDVTDIISKLEAKGAKDLLELKEYFENKSSWLIGSDAWSHDLGNSGVHHVVSSGENLNMLIIDSTPYDTAQSKLPSLRKKDIGLYAMGFGNVYVASTAVYASYTQVLQSLIEAAAFEGPSVVLAYLPYHSESDDPVSILKETKRAVDSGYWPLYRYDPSLEAKGQEPFQLESSRIRQDLQKFLDRENKLTMLSKKDPVLARNLAQGYGSGLRELQQRKAKDAYLQLLDGLSGAPITILFASDGGVAENVAKRLGRRAKGRGLKPLVMAMDDFPLEDLSSETNVVFITATAGQGEFPQNGRNFWEGLKGATDVDLTNTRVSVFALGDSLYWPRKADKHYYNKPGKDLHAKLVLFGAQDLAPLGLGDDQDADGWSTGYNEWEPAVWTALGVDGIGAIDEPPPITNEDIKAASNYLRGTIAEGLKDESTGAISAHDQQLTKFHGIYMQDDRDIRDERKAAGLEPAYSFMARVRLPGCRATPEQWLKIDELSDSRGNGTFKITTRATFQLHGVVKHDLKPAIRGMNAVLIDTVAACGDVNRNVVTAALPENAKVHDQVVKLGTDISEHLLPMTTAYYEIWLEGADESDKQNIGAPEIFDKREGGPKKKPKKIQVGESTLKDMEEIKDTEELYGELYLPRKFKINVAVPPYNDVDVYAHDIGLIAIVENDVIIGCNVLVGGGMGVTHNNTKTYPRTGSNLGFMPYDKIVDTCEKVMLVQRDFGDRTNRKHARLKYTVDDLGVDVFKGKVEEYLGYKFEDARDFEFKSNTDYFGWVKDERGLNHFTSFIENGRVEDTPELQFKTGLREIAKAMTGKAEFRLTGNQHVLISNITDEELPKIKDLLKKFKLDNINFSGLRLSSAACVAFPTCGLAMAESERYLPVLITKLEAALEEYGLRHDSIVMRMTGCPNGCARPWLAEVALVGKAYGAYNLMLGGGYQGQRLNKLYRSSLKEDEILDILKPLFKRWSLERNDGEHFGDFLIRVGVIKETTAGKNFWEGVEEE

SEQ ID NO: 42821 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRDVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGAPRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42822 - protein, 288 aa, Eucommia ulmoides
MLGKADSVNKALEATVLLRYPIKIHESMRYSILAGGKRVRPLLCIAACELVGGQESTAMPAACAVEMIHTMSLMHDDLPCMDNDDLRRGKPTNHMVFGEDVAVLAGDSLLAFAFELIATSTTGVPADRIVRVIGELAKSIGSEGLVAGQVIDICSEGMTDVGLEHLEFIHVHKTAALLEGSVVLGAILGGATDPEVEKLRKFARCIGFLFQVVDDILDVTKSSQELGKTAGKDLVADKTTYPKLIGLEKSREFAEKLNREAQDQLAAFDIEKAAPLIALANYIAYRNN

SEQ ID NO: 42823 - protein, 315 aa, Desulfitobacterium hafniense Y51
MHMPVLHKEHFTGRDFICLQDFTPDEILYMLKVAKELKEEKKGGTPHPILQGKSLAMIFTKSSTRTRVAFEAGMLQLGGHALFLSNRDIQIGRGEPIKDTARVLSRMVDGIMIRTHSHQDVIELAKYADIPVINGLSDFLHPTQVLADLLTIQEHKHCLEGLKLTYIGDGNNMAHSLMFAGKMGMHVVIATPAGYKPDAQVVAQAQAQAKQYGGLVEWVEDPLAAAEGADVLYTDVWASMGQEEEAAIRMKAFQSYRIDRETMERAQANAIVMHCLPAHRGEEITEEVLEGPQSVVFDEAENRLHAHKAIMALLI

SEQ ID NO: 42824 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42825 - protein, 400 aa, Micromonospora echinospora
MVHARRAPARVPTGTRTDSSRTQMDSVHSDLKVAIVVADIAIVLIVGSLLIMLFRRLKQPPVIGEITAGIVLGPSLLGLLPGDVTGFLFPVELRAHLSMISQVGLLLFMFLVGWEFNGQLLKRRSGAVATVSLSAIGLAFTLGIGAAALLYDRHDVVDGEKISFGYFAAFLGIAMSITAFPVLARLLTETGLARTRVGALSLAAAALDDVMAWTLLAFIVVIFGAGGDGTSTLVTVLGLFLLYVALMVFAVRPLLRRLVARLVRGGTASPFLVPLIAAGAFLSAYATSWIGVHAVFGAFAFGLVMPREPRALLAESLHMPLESATRLLLPIFFIVTGLNVNIGALGWTGLGELAIIMVAAIVGKLVAASLAARASGMNWQESYAVGLLMNTRGLTELVIH

SEQ ID NO: 42826 - protein, 298 aa, Micromonospora echinospora
MLTGHQEGVIGAVFHPDDHLVATSGEDGTVRLWDATTGEQVGRTLTGHTDTVWLVVFDPEGRLLASASEDRTARIWDVSTGEQVGEPLTGHTAGVYGVAFHPDGGLLATGSADHTVRLWKVPGGEPVGEPLTESTDEIDGVAFHPDGHLVASTGDAVRLYDTATGRPVGTPLVGHTKGAVSVAFSPDGRLLASGSDDLTVRIWDHAAGGAAVEPLVGHTDAVDGVVFHPNGRLLVSAAEDCTVRVWDVATGRQVGEVETGHTAPVWNIAFDRSGERIVTASQDGTARILPFPAYPAAG

SEQ ID NO: 42827 - protein, 139 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMI

SEQ ID NO: 42828 - protein, 188 aa, Neisseria meningitidis serogroup A
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 42829 - protein, 186 aa, Brucella melitensis 16M
MAQRERNREERGREERDSEFVDKLVHINRVAKVVKGGRRFGFAALVVVGDQKGRVGFGHGKAREVPEAIRKATEAAKRDMIFVPLRSGRTLHHDVEGRHGAGKVLLRAAPAGKGIIAGGPMRAVFETLGVQDVVAKSLGSSNPYNMVRATFDALKHQMHPKDIAAQRGIKYSTLQARRHDVVGSEE

SEQ ID NO: 42830 - protein, 367 aa, Oryza sativa Japonica Group
MPTLDARLRLPLAGLSPATTSFPGSTPKPGSLSFALRPPSASLSSSASAPAAAAPPIVVVGSANADIYVEVDRLPLVGETVAARAGRSLAGGKGANQAACGGRLAAGPTYLVARVGDDANGRLLEGALADAGGVRLDRVARAPGAPSGHAVVMLMPGGQNSIIIVGGANMEGWASGVGSDDLDLIRRAGVLLLQREIPDWVNVQVAQAAKGAGVPVILDAGGMDAPVPGELLSLVDIFSPNETELARLTGMPTETFEQISRAAGACHKMGVKEVLVKLGSQGSALFIEGGEPIRQPIIPATEVVDTTGAGDTFTSAFAVALVEGKPKEECMRFAAAAASLCVQVKGAIPSMPDRKSVMDLLESVQVE

SEQ ID NO: 42831 - protein, 459 aa, Rickettsia conorii str. Malish 7
MQEFDLVVIGSGPAGYTGSIRAAQLGMKVACIEKSDTLGGTCLNIGCIPSKVLLNSSEKYEVALKHFENIGIIADVKLDLQKMLANKDKVVLDLTQGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDSKSSVVTSNVVLMAVGRKAYTQNLGLESVGIITDKQGSIEINDRFQTAISNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINM

SEQ ID NO: 42832 - protein, 151 aa, Brassica napus
  misc_feature (140)..(140): Xaa can be any naturally occurring amino acid
MFFSKDLPSPTSFFTAYASMAGYMMMIRSMAHELIPAPIQDFIYSSLRSLFHRSSSTTLTLTIDDDNMGMSNEIYRAAQTYLSTKISPDAIRLRISKGHKDKHVNLYLSDGEIVNDVYQDVELKWIFVTDGGGDKKSGGXGGGGGKSGGKS

SEQ ID NO: 42833 - protein, 255 aa, Escherichia coli CFT073
MRSKYMAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 42834 - protein, 426 aa, Chlamydomonas reinhardtii
MEASLRDRALCLVAGAALGSAATYLSYSLVTRRPSAAAGLPTAALGSASAAARATATVADFLKDDVLKEQFTRNVQFFGEDGQSRIASAFVVVVGLGGVGSHAAHLLMRSGVGKLRLIDFDQVTLSSLNRHAVATREDVGTPKATCLEKHFKQILPEADLEAVVEMYTAEREEELLGGPVRPDYVIDAIDNIDTKVALVAACHRRGLPVLSVAGAGAKADPTRLKFVDVSESSVDPLARALRQKLRKQYDIPGGIPVLLSTEKPRCKLVSMTDMEAGNPLDYQIVPNFRVRTIPVLGTTPALFGMAAAGYVLCALAGGSHAIEGEPIIRLNCVQYERALERLRERERSRYGSDDGVAVDLDDITFLLREVWRGFSARAADRVVAPGGDKGLMRATAHLTFTRWDASRPAMADNLVLLTAAEADAHD

SEQ ID NO: 42835 - protein, 382 aa, Escherichia coli CFT073
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALFPEELVPAVQQAVAEQYEAKTGIKETFYVCKPSQGAGQC

SEQ ID NO: 42836 - protein, 530 aa, Ashbya gossypii ATCC 10895
MSQHIFQTKSLKRKNLKKLTLEAGGSEELEGAARGDILRATEDRLSGAPTLLKAGARPMRSPEPVWGLGSVPGPASVQGVLDMASSQRAAEPATQRPGLFHNGTPDNQLRGGKPCMTLRMKRMQKPLNLNIEPEGVKSKVVIAQPSPTNSDSSTSVSPIVPSKITSNKRDNRLSTKFSRLSIFQDDNNDIQLEDLVQLGKIGAGNSGTVVKTLHVPDSRIIAKKSIPVENSELVKNQLMRELTIMKNVKEQKNIVGFYGAYYTAIKNHEIIILMEYMDCGSLDKISSTYRRYCSRNKVPMNASTSWFTELSLSKISYAVLNGLSYLYQDYKIIHRDIKPSNILINSKGFVKICDFGVSKKMIDSIADTFVGTSTYMSPERIQGSCYNTKGDVWSLGLMIIELVTGEFPLGGHNDTPEGILDLLQRIVNEEPPSLPASGDFSADIMDFVNCCCVKDERKRSSLQELMTHRYITKYNDSDDYQRTFRHWCKKIKKRIKADKMIQREEMERARLVNRQLERSAQAAMAARSGR

SEQ ID NO: 42837 - protein, 304 aa, Gigaspora rosea
LVLRAAIEKDTVDVVAINDPFLDLSYMAYLFKHDSTHGRFHGTVDVSSGKLVVSYHGKSTHTITVFTEMKAENIKWGEAGAEYIVESTGVFTTLDKAKAHHMGGAKKVIISAPSADAPMFVMGVNHTSYDPSKHNIVSNASCTTNCLAPVAKVINDNFGIGEGLMTTAHSVTATTQKTGDGPSGKLWRDGRGAFQNIIPASTGAAKADGKVIPALNGKLTGMAFRVPTPDVSVVDLTCRIEKPATYDAIKECVKKASESPEYKGILGYTEEQVVSSDYIGCTISSIFDAGAGISLNPNFVKLIS

SEQ ID NO: 42838 - protein, 486 aa, Bacillus clausii KSM-K16
MTTTKVKTVKNWIDGAWVEASTADTEVVPNPATGEAIAYVPLSGERDVEQAVASAKRAYETWKTVPVPERTRYMFAYLEQLKKNREQLAQLITLENGKTIKDARGEVQRGIECVELATSTPTMMMGDALPDIASGIDGSIWRYPLGVVAGITPFNFPMMVPLWMFPLAIAAGNTFVLKTSERTPLLAEQLVSLMHEVGLPRGVLNLVNGGKAVVNGLLNHPDVEAISFVGSEPVARYVYETGTANGKRVQALAGAKNHAVVLADCELDKTVQGVIGAAFASSGERCMACSVVAVVEEVADAFIEKLTAETKKLTVGNGKNDEHFVGPLIRQSHKDKVVKYIEQGVEQGAELLVDGRNATSEEAGYYLGATLFDHVTPEMTIWQEELFAPVLSIVRVRDLEEAIALTNRSRFANGAVIYTSSGKAAQHFRNAIDAGMVGINVNVPAPMAFFSFAGNKASFFGDLGTNGRDGIQFYTRKKVVTERWFN

SEQ ID NO: 42839 - protein, 444 aa, Ashbya gossypii ATCC 10895
MSGVSGVPQIDLEKVRNESDGSMGGMAKGLFRQVVEGNPYFAAGGGLMVLGTTIAVLRKGVIRLSSLAYHQMLVDLEIPSKDKSYLWFLQWMAQHPSRSSRHLSVETNYMQHNNGSVTTNISFVPGPGTHLIRYKGAFMLVKRERSGQIANFSNGTPFETVKLTTLYRDRGLFTDLLQDAKRLAVKAQTGKTVVYTSWANEWRPFGQPKAKRMLSSVIFDRGVKEAILGDVQEFLKNGSWYHERGIPYRRGYLLYGPPGSGKTSFIQALAGELDYNICIMNLADSNLTDDRLNYLMNNLPERSIMLLEDIDAAFVKRKKNDDGYTNGVTFSGLLNALDGVASSEEMITFMTTNHPEVLDPAVLRPGRIDYKVLVGNATPHQIEQMFLRFYPDDSALCAEFVAKAVALGVPVSTAQLQGLFVLNKNDAASALSMVETLKYPNHAF

SEQ ID NO: 42840 - protein, 558 aa, Moritella sp. PE36
MSHVLASFNRAQRLSQLQQGADNTVWDMIVVGGGITGAGILLTASQAGLKVLLIEQQDFAWGASSKSSKMVHGGLRYLGSGQYNMTKDAVTEREKLLNELPGLVNPLQFLMGHYKYQFPGPLVFNSLLTIYDWIGGKRNHSYINHGIADFHAPGIEQNKLQGATQFADAVTDDARLVMRVLQEAQECGGTAINYLSAEHIILTADAVTGVNVADQVSGQKFNLQAKVVINATGPWTDKLRQQLHAKKAIRPLRGSHLIVPSWRLPLAYSVSYFHPEDKRPIFAFPWENSTVIGTTDLDHDSDLDQQPCISQNEVDYLLTGINKQFPQADITESDVISTYAGIRPVVSNDASNKKQLKKTKPSDEKREHSIWNEQGLISVAGGKLTTFRLIALDVLKVAQHYLPDMNLIDLQAAKLFQTIPDTPVDSILHPQQIQRLKSQYGKHYSHLINNAEHNELRPIGSTNTLLAELKWSLQHEMVVHLDDLLLRRTRIGLLLAAGGEQLFGQLQPLCQTALHWNEGQWQQELSRYQGIIQRYYSLPKHRQLLSTQDVSSANAVAN

SEQ ID NO: 42841 - protein, 397 aa, Bacillus clausii KSM-K16
MFESIDEAITQLKAGGMILVVDDEDRENEGDFLALAETASPETINFMATHGRGLICVPLTEEQAERLQLGQMVSHSTDPHGTAFTVSVDHSHTTTGISAFERAETVRALADANAQPSDFKRPGHVFPLVAKNGGVLRRAGHTEAAVDFAKLCGAKPAGVICEVMNEDGSMARVPELRIIADQHNLPLVTIKDLIAYRRKTEKVVTREVAISLPTEYGDFKAVGYTNTIDGKESVALVKGDVGNGEPVLVRVHSECLTGDVFGSKRCDCGPQLHAALKQIEAEGRGVLLYMKQEGRGIGLINKFRAYKLQEEGYDTVEANERLGFPADLREYGIGAQILRDLGIRDMRLLTNNPRKIAGLEGYDLNIVERVPLQMEAVAENERYLHTKREKLGHMLNL

SEQ ID NO: 42842 - protein, 156 aa, Bacillus clausii KSM-K16
MGKNYEGHLVASGLKVGIVVGRFNEFITSKLLGGAQDGLIRHGADEGDIDVAWVPGAFEIPFAAKKMAESGRYDAVITLGTVIRGSTPHFDYVCNEVAKGVSSLALTTGIPVIFGVLTTDTIEQAVERAGTKAGNKGWEAASAAIEMANLAKQFEE

SEQ ID NO: 42843 - protein, 607 aa, Glycine max
MQQDQLKKDIKEVEFFTEYGDANRYKILEVVGKGSYGVVCSAIDTHTGGKVAIKKIHDIFEHISDAIRILREVKLLRLLRHPDIVEIKRIMLPPSKREFKDIYVVFELMESDLHQVIKANDDLTREHHQFFLYQMLRAMKYMHTANVYHRDLKPKNILANANCKLKVCDFGLARVAFSDAPTTTFWTDYVATRWYRAPELCGSFFSKYTPAIDIWSIGCIFAEVLTGKPLFPGKSVVHQLDLITDLLGTPPPETIAGVRNDKARKYLMEMRKKSPVPFEQKFPNADPLALRLLQRLLAFDPKDRPTAQEALADPFFKGLAKVEREPSCQPISRLEFEFERRRVTKDDVRELIYREILEYHPQLLKDYMNGTEGTHFLYPSAIDQFRKHFAYLEENHGKSGPVIPPERKHVSLPRSTVHSSTIPPSTQPSFTSYENKHMAEEASKVTRSVESNSGSQLRSSRPPPRVPAAKPGRIVGPVLHYDNGRTLKDTYDQRIFYRNTLPQAVSPHCFHRVQQPTITKTTSETYKNIPQGKHQLPSQQCSMPARPTIDLNTNPYYQQGKSDHLNDPVASIDAKLLQAQSQFGGVGAAAVAVAAHRHSGSFQYGLS

SEQ ID NO: 42844 - protein, 473 aa, Synechococcus elongatus PCC 7942
MARLAARSLRLQQPTLLHLPASGGDRLYLCSVLLPLLLWQGPVVILAAPPLRDRLLHREIPLLQSHFNLAKSLLIADQLPRPDFQGVWLTDLDRWRSHQADYPHWPLAVMAAEDFEAQLITAASAVITPQDWEVLRCCQPAAQGQLQDWQARLTFQLFQRPINPTGTYRLEAADLEPLQIWLRSQLDLPAAWQTWLQVPVPAVEVAQLDRATGQFQLWRQPLAIAELAAPLWRDRPLLLAAEACDAAGQAPAWIRRLGLPDPVSAQFGSDRHAPGLRLFLPRQAVLPNTPHFQQALLHELRLLLLWLGNQSVVLIVDDRPLQQQVASALAAEWGSRVQVGATAKLADNSIHLCSMSTWLGLQSQRPTPTAIAIASLPFASAEQPLTAARIEFYKQQRWDWFREFLLPDALMQLQQAIAPLRKNSGLLAIYDGRLQRRSYGQAFLEAIAPSEHLRQLSFENQANPWLAPEDSSL

SEQ ID NO: 42845 - protein, 107 aa, Zea mays
LYTLFFRRLGDESAALAVARLRDGFLDLKGFDEWADLYKARVERDASGTEEQRRERMHGVNPLYILRNYLAQNAIQAAELGDYSEVRRLHEVLTKPFEEQPGMEQYA

SEQ ID NO: 42846 - protein, 276 aa, Dehalococcoides sp. CBDB1
MIKISIQGARGSFHDIVARHKFPGDSEIIESNTSHQVFEDVKKGLADYGVVAIENSLYGSFLENYDNLLKYESKIVGEIYLHVILNLITLPGVKLEQIREVYTHPIAMIQAESFLEKHPSVIRIESHDTAGSVRMIKEKGLKTAAAIGSNLAAQLYDMKILAKDIETEKQNYTRFLIIAKDPKYPPLANKTSLAIKAENNAGSLYKCLKCFYDQGINLSKIESRPIMGRTWGYYFYLDFERGLTTPETQRALKELEKVTESIQVLGSYEQGKVFEE

SEQ ID NO: 42847 - protein, 354 aa, Cryphonectria parasitica
MCFGSRKKEEADAMRSRELDKIIKADEKRMAKEVKLLLLGAGESGKSTVLKQMKLIYATGFSKTEKLEWKPVVFNNIVQSFRMIYDAMKEFDIPFEKPQSEKDMEQVLVDYELSPNDQFPEQYLQPLKDLWLDEGVKKAIAKGNEYALHDNLDYFCDDLDRFWDRTYIPTDQDLLRSRLRTTGITETIFDLSQLTYRMFDVGGQRSERKKWIHCFENVNCLLFLVAISGYDQCLVEDKDGNQMNEALMLWESIANSHWFLKSALILFLNKMDLFKEKLKKSPITQHGFTDYHGEPDDWKQASKYFMDKFRALNRNPEKEIYGHFTNATDTNLLKITMGSVQDMIIQRNLKQLIL

SEQ ID NO: 42848 - protein, 365 aa, Solibacter usitatus Ellin6076
MPTADTDVSAIPETMHAAVYRGSSVVNVEEIPTPSIGPGEILIRVEACGICHTDLKKIEYNLLEPPRIYGHETAGVVAAVGSGVTRFQIGDRVVAFHHIPCGKCFYCQRKIYAQCPIYKKVGITAGFEPAGGGFAQYVRVMDWIVEEGVERIPDDVSFELATLVEPLNTCLKAVVQCDPQPDDFVVVLGQGPIGLMFTMLTRRTGARVAATDTIDTRLELAARCGAEFAWDPRTIDVAAEVRNLTGGRGADLVIVAASVPGIVNQAIACSRPGSRILLFAQTSATERVETSGADICVGERTLFGCYSASIDLQKESARLVFGGEIPVEALISHRLPLVKIRSGFDLALHPGPKSLKIIVQPQRWS

SEQ ID NO: 42849 - protein, 143 aa, Zea mays
  misc_feature (67)..(67): Xaa can be any naturally occurring amino acid
  misc_feature (87)..(87): Xaa can be any naturally occurring amino acid
MSRRGDWVYENNGGTCVAIAGADYCVVAADTRLSVGYSILTRDHSKICDLADKCVLASSGFHVDSRXLQKNLAAKEMLYPHQHNKRXMSCPAMAQLLSNTLYYKAILPIYRLQGGSGGFDTGGEKGRRFPLWGGGRFLWRRTG

SEQ ID NO: 42850 - protein, 333 aa, Methylobacillus flagellatus KT
MTIKVGINGFGRIGRMAFRAAIKDFTDIEVVAINDLLEPDYLAYMLKYDSVHGRFDGDVSVSGGNLVVNGKTIRLTAERDPANLKWDEVDVDVVVECTGFFLTEETCQKHIDAGAKKVVQSAPSKDDTPMFVYGVNHDTYKGQSIVSAASCTTNGLAPVAKVLQDSFGIKRGLMTTVHAATATQKTVDGPSNKDWRGGRGILENIIPSSTGAAKAVGKVIPELNKKLTGMAFRIPTSDVSVVDLTVELNKETTYEQIVAAMKAASESGPLKGVLGFTDEKVVSTDFRGNAYPSIFDADAGIQLDPTFVKVVAWYDNEYGYTCNMLRLVRHIAS

SEQ ID NO: 42851 - protein, 452 aa, Desulfitobacterium hafniense Y51
MNFRFFPWTQPTNYGHLFLGLDTQVPLAAGGSVPGINFDNGATTPPFLSVLEEINRFAPLYGSVHRGAGYKSVVSSQIYEQARTEVLRFVGGDPRSDTVIFVKNTTEALNKLANRFQNKNKKEVILTTWMEHHSNLLPWRERFDVDYIEIDEQGRLRMDDLRAKLERYQGAVKLVTVTGASNVTGHRNPIHKIAELSHRYGARICVDGAQLVPHASVDMRPSHSIEHIDFLAFSAHKMYAPFGTGVLIGPRAFFDQGAPDYQGGGTAQMVTPDRVLWYDAPAKEEAGTPNLMGVVALVAAIRTLSAIGMKKVLQHEEGLLGYAYERLRWMEGITFYGGIPLNQQQLSQRIGVISFNVEGLFHEDVAEYLAKEGGISVRNGCFCAQPYVQRLLHISRQEMERHIANPSLPHPGMVRVSLALYNTKEEIDIFLDVLGRIAGSRLRFFRSLRIGN

SEQ ID NO: 42852 - protein, 372 aa, Glycine max
MASLMSTILMQRSSSTSLAAGRLFSTTTATIIDSPSLAQRIRDLPKDLPGTNIKKHVSQLIGRTPLVYLNKVTEGCGAYVAVKQEMMQPTASIKDRPAYAMITDAEEKNLITPGKTTLIEPTSGNMGISMAFMAAMKGYKMVLTMPSYTSLERRVTMRVFGAELILTDPAKGMGGTVKKAYELLENTPNAHMLQQFSNPANTQVHFETTGPEIWEDTNGQVDIFVMGIGSGGTVSGVGQYLKSKNPNVKIYGVEPSESNVLNGGKPGPHHITGNGVGFKPDILDMDVMEKVLEVSSEDAVNMARVLALKEGLMVGISSGANTVAALRLAQLPENKGKLIVTVHPSFGERYLSSVLFQELRQEAENMQPVAVD

SEQ ID NO: 42853 - protein, 406 aa, Pseudomonas syringae pv. tomato str. DC3000
MAIDIKAPSFPESVADGTISKWYKKEGDAVKRDEMLVDIETDKVVLEVLAEADGVMGAITKEEGAIVLSNEVLGTLNDGATASAAPAPAAAPASAPAAAPAAAGEEDPIAAPAARQLAEENGINLASVKGTGKDGRITKEDIVAAVEAKKSAPAAAPAAKPVAAAAPVVAAGDRTEKRVPMTRVRATVAKRLVEAQSNMAMLTTFNEVDMTEVMALRSKYKDLFEKSHNGVRLGFMSFFVKAATEALKRFPAVNASIDGSDIVYHGYADVGVAVSSDRGLVVPVLRNAEHMSLAEIEGGIATFGKKARDGKLSIDEMTGGTFTITNGGTFGSMMSTPIVNPPQAAILGMHNILQRPMAVNGQVVIRPMMYLALSYDHRLIDGKEAVTFLVTIKNLLEDPARLLLDI

SEQ ID NO: 42854 - protein, 478 aa, Pseudomonas syringae pv. tomato str. DC3000
MSQKFDVVVIGAGPGGYVAAIKAAQLGLKTACIEKYQDKEGKLALGGTCLNVGCIPSKALLDSSWKFYEAKNGFAVHGISTSEVAIDVPAMIGRKSTIVKGLTGGVASLFKANGVTTLQGHGKLLAGKKVELTAADGTVEIIEADHVILASGSRPIDIPPAPVDQKVIVDSTGALEFQQVPQRLGVIGAGVIGLELGSVWARLGAQVTVLEALDKFIPAADEAVSKEALKTFTKQGLDIKLGARVTGSKVNGEEVVVSYTDAAGEQSITFDRLIVAVGRRPVTTDLLASDSGVDLDERGFIYVDDYCTTSVPGVYAIGDVVRGLMLAHKASEEGIMVVERIKGHKAQMNYNLIPSVIYTHPEIAWVGKTEQTLKAEGVEVNVGTFPFAASGRAMAANDTGGFVKIIADAKTDRVLGVHVIGPSAAELVQQGAIAMEFGSSAEDIGMMVFSHPTLSEALHEAALAVNGGAIHIQNRKKR

SEQ ID NO: 42855 - protein, 388 aa, Pseudomonas syringae pv. tomato str. DC3000
MNLHEYQGKQLFAEYGLPVSKGYAVDTPEAAAEACDKIGGTEWVVKAQVHAGGRGKAGGVKLVRSKEDAAAFAQQWLGKRLVTYQTDANGQPVTKILVESCTDIAKELYLGAVVDRSSRRIVFMASTEGGVDIEKIAHDTPEKILKATIDPLVGAQPFQGRDLAFQLGLEGKQVTQFAKIFTGLAKLFQDHDLALLEVNPLVIKADGDLHCLDAKINIDANAMYRQPKLKGFHDPSQDDPREAHAAKFELNYVALEGNIGCMVNGAGLAMGTMDIVNLHGGKPANFLDVGGGATKERVTEAFKIILSDTNVAAVLVNIFGGIVRCDMIAEGIIGAVKEVGVKIPVVVRLEGNNAELGAKVLAESGLNIIAATSLTDAAQQVVKAAEGK

SEQ ID NO: 42856 - protein, 262 aa, Synechococcus elongatus PCC 6301
MATPLWQTIYNNAVLLPESPKAIVHFLGGAFIAAAPQVTYRRLLEGLGDRGFAVIATPFINTFDHTTLADEVGRSYRLAYERLLALGLISPELPIFGVGHSMGSKLHLLMGCAQTSDRRGNVLLAFNNYSARRSIPLLGQLAPALDVTVEFSPSPARTLRLIRDRYSVANNLLVKFRNDEIDQTRDLIGALRDRFPETSEWLRLSGNHLTPVGQSLPQQTGLAWLDGVSQLASRELGRDLEVVTTAIADWCDRQLTAPATVV

SEQ ID NO: 42857 - protein, 294 aa, Methylobacillus flagellatus KT
MLNQTTAAQKAQTLAEALPYIKRFFDKTIVIKYGGNAMTDPHLKECFASDVVLLKLVGMNPVVVHGGGPQINELLDKLGKKGEFIQGMRVTDEETMDIVEMVLGGQVNKEIVNLINRNGGKAVGLTGQDGNFIHARKLLVQDLQNPSNMIDIGQVGEISGIDPSLIQFLDSGDFIPVIAPIGVGIDGQTYNINADVVAGKLAEVLGAEKLILLTNTPGVLDKTGQLLTGLTPKQIDDLVADGTLSGGMLPKISSALDAARSGVKSVHIIDGRVEHALLLEVLTDAGVGTLITAK

SEQ ID NO: 42858 - protein, 415 aa, Chlamydomonas reinhardtii
MQATTRVPAKSGVSSSAKRVAASGRRVLVVPNAVKDVFMPALSSTMTEGKIVSWLKNVGDKVKKGEALVVVESDKADMDVESFADGILGAIVVQEGERAVVGAPIAFVAENANEAPAAAPAPAPAPVAAPAPPAPTPVPAAPVGRADGRIVATPYAKQLAKDLKVDLATVAGTGPNGRITAADATTVSELRGTTKPFSTLQAAVARNMNESLKVPEFRVSYAITTDKLDALYQQLKPKGVTMTALLAKACGVALAKHPLLYAACTPDGNGITYSSQINVALAVAMPDGGLITPVLKNADSTDLYQMSRNWADLVKRARSKQLQPDEYNSGNFTISNLGMYGVETFDAILPPGTAAIMAVGGSKPTVVASPDGMIGVKKVMNVNLTADHRIVYGADAAEFLQTLKAVIENPDQLLF

SEQ ID NO: 42859 - protein, 251 aa, Zea mays
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLAKDDDVRKYVNTYRRTFTTKNGKKVSKAPKIQRLVTPLTLQRKRARIADKKKRIAKKKSEAAEYQKLLAQRLKEQRDRRSESLAKRRSKLSAAAKASAATSA

SEQ ID NO: 42860 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKSRKRQLSNDSTDPIESKTVKKIKCHQWKNLDSMEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 42861 - protein, 380 aa, Triticum aestivum
  misc_feature (64)..(64): Xaa can be any naturally occurring amino acid
  misc_feature (69)..(69): Xaa can be any naturally occurring amino acid
  misc_feature (202)..(202): Xaa can be any naturally occurring amino acid
  misc_feature (325)..(325): Xaa can be any naturally occurring amino acid
  misc_feature (336)..(336): Xaa can be any naturally occurring amino acid
RPFLGSVRGCSRGGVGGGEAAVHGGGGGGAAAGHGGARQDPLHLPLPHRRLLLGGQGPDPHVPXDLRSXAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGXLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNXKPRTDLPNVVXEMYMRKELEVEKFITHSVPFSEINKAFDLMAKGEGIRCIIRMEN

SEQ ID NO: 42862 - protein, 252 aa, Burkholderia glumae
MPGAVRSAPFVQTLRKSPGHTSPLACLSMRAYLPNLRGRAMNQSDDHSGVSIRTRIKVPIRPRSSATAFETEMVTFNGLCDSAEHIALVFGKIGEAPLVRLHSECLTGDVFGSARCDCGEQLDESIALFGERGGILLYLRQEGRGIGLYNKLDAYRLQISQGLDTFAANRALNFPDDLRDFRVAAQMLKALGVGEVSLVTNNPDKTAQLTRHGIKVRQVKSTGVFANSVNFGYLHAKATQHRHAIKLNGEMQ

SEQ ID NO: 42863 - protein, 751 aa, Aspergillus oryzae
MAGTTLIEAICDDAYADSYFEKIWGQLDAALTAIFDGGKPEISLEELYKGAENVCRQGRASALARQLQERCRGHVSGKLRDTLVVKAAGGNNIDTLRAVVDSWTTWQSKLVTVRWIFYYLDQSFLLHSKEYPVIREMGLIQFRQHIFNDTVLQPQVLQGACDLVEADRDEGRSISADSSLLRNAIEFFHGLDVYTTGFEPLLVSESKKFFASWAQHEASGYLATFAENSHRLIEQEVDRCTLFSLNRSTKQKLSELLDQELVAEQENVLLNQNDILGLLRAGNKTALEKLYTLLQRRDLGAKLKTAFSSYIVEEGTSIVFDDDKEAEMVVRLLDFKQQLDETWNNSFHRHEELGHALREAFETFMNKGRKSGASGGTDNPKTGEMIAKYVDRLLKGGWKLPPGRKAEDVPLADEDAEINRQLDQVLDLFRFVHGKAVFEAFYKNDLARRLLMGRSASDDAEKSMLARLKTECGSSFTHNLESMFKDMDVARDEMAAYNSIQRERKHRLPVDLNVSVLSAAAWPSYPDVQVRIPPEIATAVSDFEKFYYSKYNGRKLNWKHQLAHCQLRARFPKGDKELVVSSFQAIVLLLFNDISEKGTLSYLQIQEATKLSDQELKRTLQSLACAKYRVLAKKPKGREVNTTDEFSYNEGFSDVKMRIKINQIQLKETKEENKTTHERVAADRHYETQAAIVRIMKSRKTITHPELVAEVIKATRSRGVLEPADIKKNIEKLIEKDYMEREEGNRYQYVA

SEQ ID NO: 42864 - protein, 506 aa, Bacillus clausii KSM-K16
MAYQQPNTEGALVHFKERYDNFIGGEWVAPVNGRYFENRSPVTGKPFCEVARSSAEDVELALDAAHNAKASWGKMPAAQRANLLNKVADRIEENLEMLAVAETWDNGKPIRETLNADIPLAVDHFRYFAGVIRAQEGTLSQIDENTVAYHFQEPLGVVGQIIPWNFPILMAVWKLAPALAAGNCVVLKPAEQTPASIFVLLELLSDLLPPGVVNVVSGFGLEAGKPLASSPRIAKIAFTGETTTGRLIMEYASANLIPVTLELGGKSPNIFFRDVMEKEDDFLDKAIEGFVLFALNQGEVCTCPSRALIDETIYDAFIEKALQRVAAIKQGNPLDPETMMGAQASEEQLEKILSYLAIGKEEGAEVLAGGNQRQLSGDYSGGYYVEPTVFKGTNNMRIFQEEIFGPVVSVATFKDADEALRIANDSLYGLGAGVWTRNINTAYRFGRQIEAGRVWVNCYHAYPAHAAFGGYKKSGVGRETHLMMLNHYQQTKNMLVSYNDDSQGFF

SEQ ID NO: 42865 - protein, 477 aa, Escherichia coli CFT073
MNKKSLWKLILILAIPCIIGFMPAPAGLSELAWVLFGIYLAAIVGLVIKPFPEPVVLLIAVAASMVVVGNLSGGEFKTTAVLSGYSSGTTWLVFSAFTLSAAFVTTGLGKRIAYLLIGKIGSTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 42866 - protein, 629 aa, Ashbya gossypii ATCC 10895
MKPIGLTGMGLQSAGDSGEELKSGWMPAEMPLGEYMFRRLMSAGTKTVFGVPGDFNMGLLEHMYGEAVCAEGLQWIGTCNELNAAYAADGYSRYCNKIGCVVTTLGVGELSALNGVAGAFAEHVKVLHIVGVSMRAAQTHPELHGNVHHLVPRLRNSNFKAPNHKVYSEMVSGRVSCCCEFLEDLETACDQIDHVIREIWRHGKPGYLFVPADMPNMKVSSRNLVQAPTIMLESAVLERTNLAACDRIGIEILQHLYQSSTPAILCDGLCDRFGLTGDVRRLVELTGMWNFSTIMGKSILDETQPHYKGVYYGAGSKERNALLQECDLILYLGPVKDEVNTWKYTFQFNPQSMIIELHPEYVSLTRNGEQTILNSGHLLPVLRSILAHLNVANLSFNYPTAKKRVPREHQYAADEPITQGMLQHMIPECLNPGDVMVVDTGTFQFSVFDMKFPTDLKCISQSFYLSIGMALPAALGVACAMREFPRLHLGPKLANEGYTPRLVLCEGDGAAQMTIQELSTFIRYELPVEVLLWNNDGYTVERVIKGPTRSYNDIMSWDWTKLLRVFGDFDGTRSESVRVKDFNSLIEHLSSWKSDKKRSKIRLMEVILDKMDISATLKELAKQFQHNAA

SEQ ID NO: 42867 - protein, 469 aa, Vibrio vulnificus CMCP6
MSVENVLSLIQENEVKFVDLRFTDTKGKEQHISIPSHQIDADFFEDGKMFDGSSVAGWKGINESDMVMMPDASSAVLDPFTEEATLNIRCDILEPATMQGYDRDPRSIAKRAEEYMRSTGLADTVLVGPEPEFFLFDDVKFATDMSGSFFKIDDVEAAWNTGSDYENGNKGHRPGVKGGYFPVAPVDSSQDLRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARALNALTNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLKQALEYLDNDREFLTAGGVFSDDFIDSYIELKTKEVERVNVAVHPLEFELYYSV

SEQ ID NO: 42868 - protein, 404 aa, Listeria monocytogenes str. 1/2a F6854
MGLVVLKFGGTSVSTVDKIGKTADQAIYEKKQGNKVIVVVSAMGKSTDKLVAMAEEISEAPDKREMDMLLSTGEQITIALLAMTLKEKGHDAISYTGWQAGIETEAVHSNARIADIDSACIESALDAGQIVVVAGFQGFTTDGEITTLGRGGSDTTAVAIASALNAEKCAICTDVVGVFTTDPRYVKKAQKLEQITYDEMLELANLGAGVLHPRSVEYAKNFRIPLEVRASHEQVPGTMIEEDLTMENTKVVRGIAFEDQITRVTIHWKQKEAMRVSKVFTKLAENNIDVDIIIQGITGLGHGNLSFTIKTSALLATLAVLEESKELLQIEKLESEQELAKVSIVGSGMVSNPGVAAQMFEALTENNIPIKMISTSEIKVSTVVPARKMVEAAQVLHDQFELDK

SEQ ID NO: 42869 - protein, 379 aa, Oryza rufipogon
MATAGKVIKCKAAVAWEAGKPLSIEEVEIAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42870 - protein, 512 aa, Oryza sativa Japonica Group
MGCFLSKPAGAGPLPPNDAAALPADNPADPEAAAANGGADSAAADGGGDDKDAAKRAVPVFREFGLAELRAATKGFSADLIVSESGEKAPNVVYRGRLDGGRLIAVKRFSRLSWPDPQQFLAEAAGVGKVRHKRLVNLIGCCAEGDERLLVAEYMPNDTLSKHLFHWDKQPLPWEMRLRVAYYIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATAVLPTILSPLGKACSGMDLTAVHDILLKTGYKDEEGAENELSFQEWTQQVQEMLNTKKFGDIAFRDKDFKTAIDYYSKLVGMMSVPSATVFARRSFSYLMNGQSELALRDAMQAQVCMPEWPTAFYLQALALSKLGMETDAQDMLNDGATFEAKKQNSWRG

SEQ ID NO: 42871 - protein, 267 aa, Escherichia coli K12
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRKNLESNLKAQNLQLDAEDKKAIAALDCNDRLVSPEGLAPEWD

SEQ ID NO: 42872 - protein, 128 aa, Triticum aestivum
  misc_feature (35)..(35): Xaa can be any naturally occurring amino acid
  misc_feature (74)..(74): Xaa can be any naturally occurring amino acid
  misc_feature (109)..(109): Xaa can be any naturally occurring amino acid
  misc_feature (116)..(116): Xaa can be any naturally occurring amino acid
MANGGDGDGDVPENANEHCPGTQSEAAGKAESCAXGCPNQQICATAPKGPDPDLLAIIERMNTVKHKILVLSGXGGVGKSTFSAQLSFALVEMDYQVGLLDIDICGPSXPKMLGLXEGQDIHQSNVWL

SEQ ID NO: 42873 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTEHAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42874 - protein, 309 aa, Picea abies
MTKEERRESEQQGFPPKDYTDPPPAALIETSEFKLWSFYRALIAEFVATLLFLYITIATVIGHSRTSTNCGSVGVLGIAWSFGGMIFVLVYCTAGISGGHINPAVTFGLFLARKVSLPRAILYMIAQCLGAICGTGLAICGTGLVKSFQKSFYDRYGGGANYVHHGYTKGVGLAAEIIGTFVLVYTVFSATDPKRSARDSHVPVLAPLPIGFAVFMVHLATIPITGTGINPARSFGAAVIYGHKQSWDDHWIFWVGPFAGAALAAAYHQYILRAAAIKALGSFRSNGNVELEELVARRSCLCLKYVGLQ

SEQ ID NO: 42875 - protein, 374 aa, Magnetospirillum magnetotacticum MS-1
MLATPRREVNVAVPLRRDDGRTVLFHGYRVQHNVSRGPGKGGLRYAPSVDIDEVRALAMWMTWKCALVDLPYGGAKGGVAIDPRSYSDAELERVTRRYTSEIMPVIGPERDIMAPDMGTSERTMAWVMDTYSVNQGYTIPAVVTGKPITVGGSLGRTTATSAGVVHVTAAALEEAGVPLSDVRVAVQGFGKVGSHAAAIFAARGARVVAVSDQYGGVHAPDGLDVRALVEHVAATGSVVGFDRADPVDNDALLALDVDVLVPAAVEGVLDGDTARTVRARWVVEGANGPTTAEGDRVLAKNGVTVVPDVLANAGGVVVSYFEWVQANQAYWWTADEIGDKLEHRMLHAYEEVAVSRAARTSACATRRSSSASRT

SEQ ID NO: 42876 - protein, 371 aa, Brassica napus
MASTGLLSSFSPSSSLQLRSSFNGDYVSPSSSFIGAAPFASSSLSLLSGQKNSYPPRKLHVSAKKVSGLEEAIRIRRMRELEKTSKVRRNPPLRRGRVSPRLLVPDHIPRPPYVESGVLPDISPEFQIPGPEGIVKMRAACELAARVLNFAGTLVKPSVTTNEIDKAVHDMIVEAGAYPSPLGYGGFPKSVCTSVNECMCHGIPDSRQLQSGDIINIDVTVYLDGYHGDTSRTFFCGEVDEGFKRRPTRPEECLERGIAVCKDGASFKKIGKRISEHAEKNGYNVVERFVGHGVGPVFHSEPLIYHYRNDGPGQMVEGQTFTIEPILTIGTTECVTWPDNWTTLTADGGVAAQCEHTILITRTGAEILTKC

SEQ ID NO: 42877 - protein, 154 aa, Triticum aestivum
  misc_feature (142)..(142): Xaa can be any naturally occurring amino acid
GTSQNQVTKKVPPARNSRDIVDPRVRVDVLPPNVFIGLLVGAMLPYWFSAMTMKSVGSAALKMVEEVRRQFNTIPGLMEGTAKPDYATCVKISTDASIFVMIPPGALVMLTPLIVPTFFGGETLSGVPAGALVSGAPIAISXSNTGGGPGTPLT

SEQ ID NO: 42878 - protein, 416 aa, Musa acuminata
MFLLLFLVIPNLAQSQILFQGFNWESWRQQGGWYNFLKDKVSDIANAGVTHVWLPPPSHSVGVQGYMPGRLYDLGASKYGNQDELKALIGAFHDKGVKCVADIVINHRCADKQDGRGIWCIFEGGTDDARLDWGPHMICRDDTQYSDGTGNLDTGEGFAAAPDIDHLNTQVQRELTDWLNWLKTDIGFDGWRLDFAEGYSSSIAKIYVEQTQPNFVVAEIWNSLAYGNDGKPAYDQNGNRQGLVNWVQQVGGPATAFDFTTKGILQAAVEGELWRMRDPQGKAPGMMGWWPEKAVTFVDNHDTGSTQRLWPFPSDKVMQGYAYILTHPGVPSIFYDHMFDWGLKEKITRLAKTRTRNGIHSGSALNILASDADLYMAMIDGKILTKLGSRYDVGNLVPSNFHVGSSGNDYCVWEKR

SEQ ID NO: 42879 - protein, 465 aa, Zea mays
  misc_feature (90)..(90): Xaa can be any naturally occurring amino acid
  misc_feature (105)..(105): Xaa can be any naturally occurring amino acid
  misc_feature (122)..(122): Xaa can be any naturally occurring amino acid
  misc_feature (384)..(384): Xaa can be any naturally occurring amino acid
MAKHLAAMCRCSLLVLVLLCLGSQLAQSQVLFQGFNWESWKKQGGWYNYLLGRVDDISATGATHVWLPPPSHSVAPQGYMPGRLYDLDAXKYGTHAELKSLTAAXHAKGVQCVADVVINHRXTGYVQKSRLDPVRNSRDIVINHRCADYKDARGIYCIFEGGTPDGRLDWGPHMICRDDTIYSDGTANLDTGADFAAAPDIDHLNDRVQRELTDWLLWLKSSDLGFDAWRLDFAKGYSPEVAKVYVDATAPTFAVAEVWNSMAYDGDNKPEYDQDPPRQALVDWVDRVGGAASPATVFDFTTKGILNAAVEGELWRLIDPQGKAPGVIGWWPAKAVTFVDNHDTGSTQAMWPFPSDKVMQGYAYILTHPGNPCIFYDHFFDWGXKDEIAALVAVRKRNGITPTSELTILEHDGDSYVAEIDGKVIVKIGSRYDVGHLIPAGFEVAAPGNDYAVWEKAGAEQVTRA

SEQ ID NO: 42880 - protein, 446 aa, Myxococcus xanthus DK 1622
MSEESASDFRAEYACSEGCDFRASLMDVVYRCPRCGGLLEVAHDVKALRTVSAAEWKRRFETRFGSARLPDGSGVWGKREWAYPQLPAEDIVSLGEGRVPLKPLPRMAAELGLAALDLKECGVSPTGSFKDWGMTVLVSAVKHMRARGVPLRAVACASTGDTSAALSAYCAAAGIPAVVFLPRDKVSLAQLVQPIANGARVLSLDTDFDGCMKLVQAVTADTGLYLANSMNSLRIEGQKMVAVELCQDLGWEPPDWVVIPGGNLGNASALGKGFELMLSLGLITRRPRIAVAQAQKANPLVRSFRGGFQELVPLQAEPTLASAIQIGNPVSFKRAVKVLKAFDGVVEDASESELANAAARADREGTFTCPHTGVALAALEKLVAQGVIARGSRVAVVSTAHGLKFADFKVGYHRGSLAEVTSQFANPPVELPATLDAVKGALADLG

SEQ ID NO: 42881 - protein, 341 aa, Pseudomonas syringae pv. tomato str. DC3000
MTTQQPVAVLGGGSFGTAIANLLAENGHQVRQWMRDPEQAEAIRVNRENPRYLKGIKVRPEVEPVTDLTAALEVSELIFVALPSSALRSVLSPHIERLSGKMLVSLTKGIEAQSFKLMSQILEEIVPQARIGVLSGPNLAREIAEHALTATVVASEDEDLCQQVQAALHGRTFRVYASNDRFGVELGGALKNVYAIIAGMAVALDMGENTKSMLITRALAEMTRFAVSQGANPMTFLGLAGVGDLIVTCSSPKSRNYQVGFALGQGLSLEEAVTRLGEVAEGVNTLKVLKVKAQEVQVYMPLVAGLHAILFEGRTLSQVIEALMRAEPKTDVDFISITGFN

SEQ ID NO: 42882 - protein, 1066 aa, Fusarium oxysporum
MAESVPIPEPPGYPLIGNLGEFTSNPLSDLNRLADTYGPIFRLRLGAKAPIFVSSNSLINEVCDEKRFKKTLKSVLSQVREGVHDGLFTAFEDEPNWGKAHRILVPAFGPLSIRGMFPEMHDIATQLCMKFARHGPRTPIDTSDNFTRLALDTLALCAMDFRFYSYYKEELHPFIEAMGDFLTESGNRNRRPPFAPNFLYRAANEKFYGDIALMKSVADEVVAARKASPSDRKDLLAAMLNGVDPQTGEKLSDENITNQLITFLIAGHETTSGTLSFAMYQLLKNPEAYSKVQKEVDEVVGRGPVLVEHLTKLPYISAVLRETLRLNSPITAFGLEAIDDTFLGGKYLVKKGEIVTALLSRGHVDPVVYGNDADKFIPERMLDDEFARLNKEYPNCWKPFGNGKRACIGRPFAWQESLLAMVVLFQNFNFTMTDPNYALEIKQTLTIKPDHFYINATLRHGMTPTELEHVLAGNGATSSSTHNIKAAANLDAKAGSGKPMAIFYGSNSGTCEALANRLASDAPSHGFSATTVGPLDQAKQNLPEDRPVVIVTASYEGQPPSNAAHFIKWMEDLDGNDMEKVSYAVFACGHHDWVETFHRIPKLVDSTLEKRGGTRLVPMGSADAATSDMFSDFEAWEDIVLWPGLKEKYKISDEESGGQKGLLVEVSTPRKTSLRQDVEEALVVAEKTLTKSGPAKKHIEIQLPSAMTYKAGDYLAILPLNPKSTVARVFRRFSLAWDSFLKIQSEGPTTLPTNVAISAFDVFSAYVELSQPATKRNILALAEATEDKDTIQELERLAGDAYQAEISPKRVSVLDLLEKFPAVALPISSYLAMLPPMRVRQYSISSSPFADPSKLTLTYSLLDAPSLSGQGRHVGVATNFLSHLTAGDKLHVSVRASSEAFHLPSDAEKTPIICVAAGTGLAPLRGFIQERAAMLAAGRTLAPALLFFGCRNPEIDDLYAEEFERWEKMGAVDVRRAYSRATDKSEGCKYVQDRVYHDRADVFKVWDQGAKVFICGSREIGKAVEDVCVRLAIEKAQQNGRDVTEEMARAWFERSRNERFATDVFD

SEQ ID NO: 42883 - protein, 438 aa, Oryza sativa
MEKERKMEGERRVEATRRRVIAVGFWVQGFRLFPWLGVNFFLKDRMGVAASSLQILQASANLPMVAKPLLGLLSDAVPIRGHRRLPYVAIGALLQAISWLAIALWPAISLPVLTIFLLLSNFGASICEVANDAIVAEAGKQATLSSGSGQLQSFAWMFGSSAGALGNLVGGIALSYFSPKIMFLFFAILLVLQFCTTVAIPESSLQLPKADTNLSAVSSVRKQIKELSYALCMPEIFWSVIWFSLSYAAIPFLLGTMFFYQTEVLRLDSSVIGLSKVFGQVTLLAWSVAYNKYFKTTPAQKVLSVLQFLTALVMLSDVLFVQGIYRNFGIPDSMYTIVFSGLLEGLMLFKVLPFSVLVAKLCPSGCEGSLMAFVMSALALATIISGYLGVALAEFMGVSGGDFSALPTCLLIEAACTMLPLFFSSLIKERREKEKKEE

SEQ ID NO: 42884 - protein, 234 aa, Zea mays
  misc_feature (50)..(50): Xaa can be any naturally occurring amino acid
MDPEKQRQHDGAVEADIERLPVDLLAHILSLLSPFRDLSMAGGVSRRWRXAVERSLASRRRLSFAGQRTGDDTAARLVRAAVNLRDLDICWGCRITDDGLIKISSADCVGNLTSISLWGLAGITDKGVVRLVSRAYSLQHLNIGGTFITDESLYAVANSCANLKSIILWSCRHVTEGGLVALVNKCRRLECINVGGMRVPPESLVGLLSISPALEIRSTARILNLNLNAGVQVS

SEQ ID NO: 42885 - protein, 326 aa, Vibrio parahaemolyticus RIMD 2210633
MTHSCRLSVAPMLDWTDRHCRYFHRLMTKETLLYTEMVTTGAIIHGKGDFLAYNEEEHPLALQLGGSNPEDLAKCAKLAQERGYDEINLNVGCPSDRVQNGRFGACLMAEPQLVADCVAAMKEVVDVPVTVKTRIGIDDQDSYEFLTDFVSIVSEKGGCEQFTIHARKAWLSGLSPKENREIPPLDYPRAYQLKQDFSHLTIAINGGVKSLEEAKVHLQHLDGVMIGREAYQSPYLLASVDQELFGSNAPVKKRSEIVEEMYPYIEAQLAKGAYLGHITRHMLGLFQNMPGARQWRRHISENAHKPGSGLEVLQDALAKIPKELNV

SEQ ID NO: 42886 - protein, 814 aa, Emericella nidulans
MLTTPITTPHFQSRVLSLLSSHLSNIQAVSHSDSGTLMTTENIRPLVMPQLGPADTHLTPNEAMSQLVGVTSSWIDLCSPDPLIADLSRQVFMLEVAYAAFCGIGYLLIPGPKLHHKGMHSDGVMYYARAIQDALSLGPYIQFHIWLDMVDNQDLELDEMGDLAPLAREEFFDTEIEQPKIDLFGTWDAWDAIRRTCKYHSRLFVALSLPKHLPPMAVQSRWHSEPVHLFTIDSNTFIKNQKGYPVLSKAHQALISRFMRLRTAPWILLCDVGPIPGVETDNASSLPGSEYPSLAQAAASIKKHHDPTPHLSYMRNLQSRQPPRTAIERFGTGYQDYLQAPLQPLTVNLESITYEVFEKDPIKYEWYERAIAKALSDWVEQKKPTSNPDGRVVVAVVGAGRGPLVTRALKASAQSGVEIDLWVVEKNPNAFVLLQRHNENLWGGKASLVHSDMRAWKGPRVRKSTTLSTEPVGQSLGIEGQFLYTPDPNQKTADSPSLDAIEFEDSKIDIVVSELLGSFGDNELSPECLDGVNHLLNPVHGISIPASYTAHLTPISAPKLHADVTNQSITNPAAPETPYVVMLHAIDYLSTNQSDASAGNPARSSVATVPYEPTTPFVQTAWSFSHPNRDIPPQPASTSMISNAHNVRRTRLTFPVPNRGVCHGLAGYFETVLYRDVELSTNPVTMDSKSANMISWFPIYFPLKTPLNVPDNGEIVATMYRQTDDRKVWYEWMVEVFALEGGSEPASASAPASERIAPVMSGARTISASADSAHNKDITADSYSRLAQKKARGPRRVRVGMSDLHSSIKDGCLM

SEQ ID NO: 42887 - protein, 220 aa, Vibrio vulnificus CMCP6
MELTVSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLLEDEEGSNSAE

SEQ ID NO: 42888 - protein, 291 aa, Arabidopsis thaliana
MSNTSYYRSPFGDTTHTKVFVGGLAWETPTDEMRRYFDQFGEILEAVIITDKATGKSKGYGFVTFRDSDSATRAVADPNPVIDGRKANCNIASFGRPRPSTPRGRGQGGSPSQYQGGGQSSYTGMAAPVQQAAAAQLMYPSYGYTYNSEYGYHQALYNAQLQQAQYYQQQMYGGGGATSPSSSNIMPSPYYYLQAPSPRPYLHHQQHYQYHHHQQQQQQQQQRLPSASSYLIYPSNVEAPTPSNVPTSQGPLSSSTESHAPQQVSEEGGEFDPTDAPESTTTNIRDLTSSS

SEQ ID NO: 42889 - protein, 308 aa, Prochlorococcus marinus str. MIT 9303
MESAKSAAALVEPCQTNSARRLTEDDSLRVSVLSEALPYIQRFSGRRIVIKYGGAAMAHANLQEAVFRDLALLVSVGVEPVVVHGGGPEINQWLERLEIPAKFRDGLRVTDADTMDVVEMVLVGRVNKQIVNGLNQLGAKAVGLSGSDGSLVEARPWGDGSHGLVGDVARVNTDVLEPILAKGYVPVISSVAATVEGCSHNINADTVAGEIAAALEAEKLILLTDTPGILLDRDDPSSLVHQLRLSEARQLIAEGVVAGGMTPKTECCIRALAQGVGAAHIIDGRVPHALLLEVFTDAGIGTMVVGRS

SEQ ID NO: 42890 - protein, 550 aa, Vibrio parahaemolyticus RIMD 2210633
MLKNINPTQTQAWKALTAHFESAQDMDLKELFAQDAARFDKYSARFGSDILVDYSKNLINEETLKHLFALANETELKSAIEAMFSGEAINQTEGRAVLHTALRNRTNTPVMVDGEDVMPAVNAVLEKMKSFTDRVIGGEWKGYTGKAITDIVNIGIGGSDLGPYMVTEALAPYKNHLNLHFVSNVDGTHIVETLKKVNPETTLFLIASKTFTTQETMTNAHTARDWFLESAGDQAHVAKHFAALSTNATAVSEFGIDTANMFEFWDWVGGRYSLWSAIGLSIALAVGYDNFVELLDGAHEMDKHFVSTDLESNIPVILALIGIWYNNFHGAESEAILPYDQYMHRFAAYFQQGNMESNGKYVDREGNAVTYQTGPIIWGEPGTNGQHAFYQLIHQGTKLIPCDFIAPAISHNPAGDHHQKLMSNFFAQTEALAFGKSEETVKEELVKAGKNAEEVAAIAPFKVFEGNRPTNSILVKQITPRTLGNLIAMYEHKIFVQGVIWNIFSFDQWGVELGKQLANQILPELADASQINSHDSSTNGLINAFKAFKA

SEQ ID NO: 42891 - protein, 293 aa, Xanthomonas axonopodis pv. citri str. 306
MTTRRFLQLDVFSARPGSGNPLAVVLDAQGLDDAAMQAIARWTKLPETTFVVPVENVHSSYRLRMFSPQKEVPFAGHPSVGTAHAVLEAGLAAPQDGVLVQDGIAGQLPLRVEQRDGHRSIAIRTPRARVAEQVGADDPRLRDALRGWPLGTLPPALMDGGRTWWVVELDSEAALRGLQPDWDAIAGLAESTGSMGVFAYARAGAPGAYDLAVRAFVGNGRRFEDAASGAANAVLAAWLDSRDALPGTDRRYVVSQGREIGFDALLELHIDADGDVWSGGQVQTVIRGTLDWA

SEQ ID NO: 42892 - protein, 777 aa, Neurospora crassa
MAQAYDDEELSISLSPSQIRSRNKRSGDGASGFGPSTGNLHEYGQHGQQLHPNINAVMADAPLRDKMRTEQRIGAYNIVKTLGEGSFGKVKLAVHRMTGQQVALKIIARKKLISRDMQGRVEREIEYLQLLRHPHIIKLYTVIKTPTEIIMVLEYAGGELFDYIVQHGKMKEDEARRFFQQMLCAVEYCHRHKIVHRDLKPENLLLDDNLNVKIADFGLSNIMTDGNFLKTSCGSPNYAAPEVIGGKLYAGPEVDVWSCGVILYVLLVGRLPFDDEHIPSLFAKIARGSYMVPTWMSPGAASLIKKMLVVNPVQRATIDEIRQDPWFLKDLPAYLHPPVEEFLNTGVDPNKAIKVSDIAPNAPPQEQEKLHNEVTEKISKTMGYGKRDVEEALEADEPSAIKDAYMIVRENKLMQSNLDFATSHPPSASILHLPSGEHRLTQKKSKSLSLRPSSFWSNTNEEYQDTLLKTDEEIPGLTTEESVPSPLHDPNMSSARSIASVSTATSPRPYVSKIGILPSSLPTYHRVFMEREKAKAEGLEPPDAIPTIVEPANQPRSQAEQEETIRRLKPHSRSQLRLDEANKRPQGLTPVHPPKKNKPARWQFGIRSRNAPWEALVCIYKALNKLGAGWIVDEDYERAHRDDDDTDDYDGPSIGSRKKSSSSMDPTKTYRLPADPWHIKIRWTTDKLKKHSVASGLSEAGENTHVSRDGSDSKYQVVAMRMEIQIYEMEHGVYLVDFKVDGYETPDGKLLEDKEVTSPFPFLDMAAKLIMQLADAD

SEQ ID NO: 42893 - protein, 308 aa, Synechococcus elongatus PCC 7942
MQEAKVAAILGAGAWGTTLAQLLRSNGLEVRQWSRRSETSLAATLAEADLWIMAVSMAGLASVADQVAALQLGDRAIWVSATKGLADLGWRTPSQVLSDRFPLQPITVLSGPNLSKEISQGLPAATVIASRDRHAAAVVQQAFASDRFRVYTNRDPLGTELGGALKNVIAIAVGVCDGLCLGANARSALVTRALAEILRVGAYFGARTETFFGLSGLGDLLATCTSPLSRNYQVGFRLAHGESLAATLTAIAATAEGVSTARVLAQLASREGLELPIAACVAELLDNRISPTTAIERLMARDLKAELV

SEQ ID NO: 42894 - protein, 505 aa, Glycine max
MYRVAASSFRRHLKGHGGNLGSTRFSTSAAVAARTSSGGLFSWLTGERSSALPPLDMPLGGVALPDSLPDYVEQSKTKITTLPNGLKIASETSPNPAASIGLYLDCGSIYETPLSSGVSHLLERMAFKSTTNRSHFRIVREVEAIGGNIGASASREQMGYTFDALKTYAPQMVELLVDCVRNPAFLDWEVNEELRKVKAELGELSNNPQGLLLEAIHSAGYSGALAFPLLAPEAALNRLDGPNLEEFVVENYTAPRMVLAASGVEHEELLSIAEPLLSDLPKVPRPEEPKSIYVGGDFRRHGEGGTHVAIAFEVPGGWQKEKDAIALTVLQMLMGGGGSFSAGGPGKGMHSRLYLNVLNEYQQIQSFSAFNSIFNNTGLFGIYASTSPDFVPKTVDIAAKELIAIASPGQVTQVQLDRAKKSTKSAVLMNLESRMIASEDIGRQILTYGERKPVEQFLKAVDEITLNDITKIAQKIISSPLTMASYGDVMNVPSYESVNSKFHAK

SEQ ID NO: 42895 - protein, 173 aa, Vibrio vulnificus YJ016
MLESGDSHLMNIVKGRLMKVIEGGFPAPNAKIAIVISRFNSFINESLLSGAIDTLKRHGQVSEDNITVVRCPGAVELPLVAQRVAKTGKFDAIVSLGSVIRGGTPHFDYVCSEMNKGLAQVSLEFSIPVAFGVLTVDTIDQAIERAGTKAGNKGAEAALSALEMINVLSEIDS

SEQ ID NO: 42896 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLGRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42897 - protein, 344 aa, Vitis vinifera
  misc_feature (5)..(5): Xaa can be any naturally occurring amino acid
  misc_feature (109)..(109): Xaa can be any naturally occurring amino acid
  misc_feature (136)..(136): Xaa can be any naturally occurring amino acid
  misc_feature (233)..(233): Xaa can be any naturally occurring amino acid
  misc_feature (269)..(269): Xaa can be any naturally occurring amino acid
MVGSXPVANVQALASSYSGDVPLRYLRPELLSEEVLVDESLQIPTIDMRKLLVDDDEMSKLHLACKEWGFFQLINHGAAEEVIEKMKADVQEFFKLPLKEKNAYAKLPXGVEGYGQNFVVSZDQKLDWADMHFLQXLPASERNMRFWPEEPTSFRETLEKYSAELVKVSNCLLKLMAKNLLINPEQLTNMFDDGRQAVRMNYYPPCVHASKVIGLTPHSDFGGLTLLVQVNEXQGLQIKRNGKWIPIRPVPGAFIVNIGDAIEIMSNGXYKSIEHRAVVDPEKERLSIATFCSPNAGAIIGPLPELTKEKGAIYKSVSREEYIKFVLGRKLDGKSTINHMKLEN

SEQ ID NO: 42898 - protein, 379 aa, Oryza rufipogon
MATAGKVIKCKAAVAWEAGKPLSIEEVEVAPPQAMEVRVKILYTALCHTDVYFWEAKGQTPVFPRILGHEAGGIVESVGEGVTELAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGRTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42899 - protein, 107 aa, Synechococcus elongatus PCC 7942
MSIYVGNLSYEVTEADLTAVFTEYGAVKRVQLPIDRETGRMRGFGFVEMSADAEEDAAIAALDGAEWMGRGLRVNKAKPREERSGGGSFGGGGGRRGGGGGGGYRNY

SEQ ID NO: 42900 - protein, 305 aa, Synechococcus elongatus PCC 7942
MGLAGRDLLTLADLSSAEVLEILELAATLKSGQTTVHCPKTLGLIFSKSSTRTRVSFSAAIMQMGGQVLDLNPNVTQVGRGEPIADTARVLSRYLDALAIRTFAQQDLEEYAHYADIPVINALTDDYHPCQILADLQTIQENFGQWQDLTLTYLGDGNNVAHSLLLGCAQVGMNVRIACPPDYQPQERIVAKAQQIAGDRAKVEILHDPIAASQGAHVLYTDVWASMGQEEEAQARVKAFTPYLLNQAMLEKADPAAIVLHCLPAHREEEITAEVLEGSQSRVWDQAENRLHAQKAVLALLLGAI

SEQ ID NO: 42901 - protein, 379 aa, Oryza sativa Indica Group
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILGCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42902 - protein, 217 aa, Synechococcus elongatus PCC 7942
MALPQVIFFDAVGTLFGVKASVGLAYRQLALEFGVDANARRLNDAFYAAFQEAPPLAFPEAPPEQVPALEYQWWQAIARRTFERSGDLVQFCDQSFADFFDNLYRHFQGPEPWFVYDDVWPLLDYWRDRGVALGIISNFDSRIYPVLDSLGLTNYFSSITISPEVGAAKPDRLIFAMALAQQQCQPHEAWHIGDSFREDVRGSQAAGLQPIWLKREA

SEQ ID NO: 42903 - protein, 257 aa, Zea mays
MAKLVNKLVDSFDHHEAPAPDVGCVRAVLAELVLTFLFVFTGVSASMAAGAGGKPGEAMPMATLAAVAIAHALAAGVLVTAGFHVSGGHLNPAVTVGILVRGHITKLRALLYVAAQLLASSLACILLRYLSGGMVTPVHALGAGISPMQGLVMEVILTFSLLFVTYAMILDPRSQVRTIGPLLTGLIVGANSLAGGNFTGASMNPARSFGPAMATGVWTNHWVYWIGPLLGGSLAGFVYESLFMVYKTHEPLLNGDI

SEQ ID NO: 42904 - protein, 510 aa, Brucella melitensis 16M
MQELLEQLEARRAAARLGGGQRRIDAQHGKGKLTARERIEVLLDEGSFEEFDMYVTHRCTDFGMAQQKVAGDGVVTGWGTINGRQVYVFSQDFTVLGGSLSETHAQKICKIMDMAVKNGAPVIGLNDSGGARIQEGVASLAGYADVFKRNVDASGVVPQISVIMGPCAGGAVYSPAMTDFIFMVRDSSYMFVTGPDVVKTVTNEIVTAEELGGASTHTKKSSVADGAYENDIEALEQVRILFDFLPLNNREKPPVRPIFDDPARLEMRLDTLVPDSATKPYDMKELILALADEGDFFEIQEAFAKNIITGFIRMDGQTVGVVANQPMVLAGCLDIDASRKAARFVRFCDAFNIPILTLVDVPGFLPGTAQEYGGVIKHGAKLLFAYSQATVPMVTLITRKAYGGAYDVMASKHIGADINYAWPTAEIAVMGAKGATEILYRSELGDPEKIAARTKEYEERFANPFVAAERGFIDEVIMPHSSRRRIARAFASLRNKQQSAPWKKHDTIPL

SEQ ID NO: 42905 - protein, 289 aa, Vibrio angustum S14
MWQAISHQLSDVLGRPFKIVERQTLEGGDVNECYCVSDGEQRFFLKLNDKEQLVVFETESESLRILNEANCVQVPQYIHVGTCRDKSFLTLNYLPTKKVDDNAGYQLGQQLAKLHLWGEQAEYGFDFDNYVGLTPQPNRWHRRWCRFFAEQRIAWQLQLCEEKGILFGNIDTITSNVIKRLVNHQPKPSLLHGDLWHGNTALTVSGPIIFDPATYWGDRECDIAMTELFGGFPNSFYEGYNSVYPLPPEYQERKELYNLYHILNHCILFGGEYMGQAEYIIAKLNLLDE

SEQ ID NO: 42906 - protein, 258 aa, Oryza sativa Japonica Group
MPTVRFQKLQPAGFTSSPACLRGGKTGSGMLSVRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQLGLGRDLRKKLFGHYRKPQRGRSRSPSPSPRHRRERHDRDDYRGRDDYSGGGGRRGGSSRHERHDDGGRRRHGGSPPRRARSPVRESSEERRAKIEQWNRERDEKQG

SEQ ID NO: 42907 - protein, 367 aa, Candida albicans SC5314
MELFLFVHFFFSLYPPTYTNFPNMTTFSKTNFKSLNYNSFRPHYPPSFYKILADYVTKVESPLPINLPIDKTIDLGCGTGVATYPLLNISTNVIGVDLSSKMIETANSLIEKNLQTLGINNPTSTSRIKFITGSVEEFVKQQQQNKDHSVASTLEPNSIDLITAAQCIHWFQDYNSFFQNCHQLLKNDTGVLAYFFYNDPKIVEFSGPAREDIPKEEILKLSYQVYNKYVYDDDNYIGQYWEQPGRNILKHFCQQVNEKIPRDLYTDIVINTFKPSIEKNNSGNTSIANEEVDLDLKKIGISIQDYIDYISTYSGFHNYKEVTGNDDLLTNEFVKEVIEVTGWDLAKTKIDLVWNTGYTFIRKRKST

SEQ ID NO: 42908 - protein, 501 aa, Rickettsia conorii str. Malish 7
MLPPKIFFEKVKEIMWPIERKELKLFIPMALMMLCILFNFGALRSIKDSLVVPSMGAEIISFLKLWLVLPSCVIFTVLYVKLSNNLNFEYIFYIIVGSFLLFFLLFAYIIYPNQDIYHPNDEMINKLIASYPNFKWFIKIGSQWSYALMYIFAELWSAVVINLMFWQFANHIFDTSKAKRFYPVLGMVGNIGLIIAGSVLVFFSSGQDVIDSELLPDSFNSSAGNAIMLQPIMSIIVTAGIIAMLLFRIINRFILTDSINVLDAKKVTAKMKTKLSVIESIKLVIHSKYIGRIALLIICYGLLINIVEGPWKAKIKELHPNTIDYVNFMGRFNIWMGISCVTFMIIGSNILRRLGWLISALLTPIMLSITGLMFFIFIIFIEEIGECFGDFNLLYAAIIVGAIQNILSKSSKYSLFDSTKEMAYIPLSLELRTKGKAAVEVIGTKFGKSLGAFIQSLIFIIIPTATFDSIIIYLLITFIVMMSLWIWNVIKLNKEYVELCK

SEQ ID NO: 42909 - protein, 94 aa, Zea mays
WRPPHKRSRCGLARRRPPRYKLQLLTQEPRLVVWVAHKESSWISTTIWIVLLICFGSITTCGYIVIQLFKVSYQDPIYHVLLNSHSKYGIPTSL

SEQ ID NO: 42910 - protein, 597 aa, Synechococcus elongatus PCC 6301
MALIVQKYGGTSVGSVERITAVAQRIAQTVAAGNQVVVVVSAMGHSTDELLKLANGISANPSRRELDMLLATGEQVSIALLSMALHEQGCDAISMTGAQVGIITEAHHSRARILEIDPQRLQSQLDAGRVVVVAGFQGIASSDRTALTEITTLGRGGSDTSAVALAAALNADRCEIYTDVPGILTTDPRLVPEAHLLEEITCDEMLELASLGASVLHPRAVKIARNYGVRLVVRSSWTQEPGTGVVAPPRRSDRSLQGLEIGRPVDGLALDTDQAKVALLHVPDRPGIAASLFGEMAQRGVNVDLIIQSIHEGNSNDISFTVSQADLEKAEAGTTQLLADLGGEQQSEAAVAKVSISGVGIVGRPGIAAQMFSALAQGGINIQMISTSEVKVSCVIAAADQQRAIAALQESFELEEAIAATATDACTTDLPAVRGVALDRDQARLAILNVPDLPGMAATIFQILADRQISVDMIIQSQRGRIHNGQPCRDIACTLPPADAELAAAALQAFADQHGCSLEIQTEIAKVSIVGSGMVQQPGVAAQMFAALANHGINIHMIATSEIKVSCIVDASQAVEALQTVHAAFGLASDRRIEVPA

SEQ ID NO: 42911 - protein, 184 aa, Physcomitrella patens subsp. patens
MASAVASTVVAPVSVTVASSSVAASRESSSVKAFSGLKSATLFTSKSQQLSSVQNGSRVQCMQVWNPIGQPKFETFSYLPPLSDDQIARQVDYMIQQNLIPCIEFDTVGAVSRTNFSGSGSSGYYDGRYWTMWKLPMFGCTDSSQVLREIQECKTSYPSCWVRVLGFDSKKQVQICGFLVARPN

SEQ ID NO: 42912 - protein, 446 aa, Oryza sativa
  misc_feature (421)..(421): Xaa can be any naturally occurring amino acid
TSNVILHLFWDNIKCSTILLLLIKFVVIAGTKKTGRKIILIVLTAAAAGLLLPCLYVLIWHRKGKKLRHLLCTKTSSTSERNIEALIESYGSIAPTRYKYSEVTKITSFLNYKLGEGGYGVVFKGRLQDGRMVAVKFLHDSKGNGEEFVNEVMSIGRTSHINIVSLFGFCLEGSKRALVYEYMPNGSLDNYIYSENPKEILGWEKLYGIAIRVARGLEYLHHSCNTRIIHFDIKPQNILLDQDFCPKIADFGLAKLCRTKESKLSMTGARGTIGFIAPEVIYRTFGVVSTKSDVYSYGMMLLEMVGGRKNAKQMVENSSEKYFPDWIYDHFALDDGLQACQVTSEVEQIAKKMTLIGLWCVQVLPMHRPTITQVLDMFERGLDELEMPPKQNFSELLDHSVHELNTESKSSTGNTKAAQAXGVLKVEETSLVNSKDPTVTTNYATR

SEQ ID NO: 42913 - protein, 156 aa, Oryza sativa Indica Group
MAALGSKLATLGSAAREAARVAARQGCAYNKAVVEGSRQLQSRACEATRSAAKQGRAFHEELMERNKRYVVDPPTIQTCQELSKQLFYTRLASIPGRYESFWKEVDGAKLLWKNRKNLNLKAEDIGVATLFGIELIAWFAGGEVVGRGFTFTGYHV

SEQ ID NO: 42914 - protein, 68 aa, Triticum aestivum
MTTSRRLADRKVEKFEKNITKRGFVPDTTTKKGKDYPVGPVLLGFFVFVVIGSSLFQIIRTATSGGMA

SEQ ID NO: 42915 - protein, 260 aa, Vibrio vulnificus CMCP6
MTDISVQSNTALESSETTHFGFTTVAKEEKVAKVAQVFHSVAAKYDIMNDLMSGGIHRLWKRFTIDCSGARPGQRVLDLGGGTGDLTAKFSRIVGEKGHVILADINNSMLNVGRDKLRDSGIVGNVHYVQANAEELPFPDDYFDIITISFCLRNVTDKDKALRSMFRVLKPGGRLLVLEFSKPVFDPLSKVYDAYSFHLLPKMGELVANDADSYRYLAESIRMHPDQETLKGMMQEAGFENTSYYNLTGGIVALHRGYKF

SEQ ID NO: 42916 - protein, 223 aa, Vibrio parahaemolyticus RIMD 2210633
MKDFLIAPSILSADFARLGEDVEKVLAAGADVVHFDVMDNHYVPNLTFGAPVCKALRDYGITAPIDVHLMVKPVDRIIPDFAKAGASMITFHVEASDHVDRTLQLIKEHGCKAGVVLNPATPLAHLEFIMDKVDLILLMSVNPGFGGQSFIPHTLDKLRAVRKMIDESGRDIRLEIDGGVKVDNIREIAEAGADMFVAGSAIFGQLDYKQVIDQMRTELAQVE

SEQ ID NO: 42917 - protein, 379 aa, Oryza sativa Japonica Group
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVVLYMKKELELEKFITHSVPFSEINTAFDLMLKGESLRCVMRMDE

SEQ ID NO: 42918 - protein, 302 aa, Synechococcus elongatus PCC 7942
MLPPRPWKQPRRKLQKKPLKHPKRRKARKKPKPLAHSRPVRRGIIVGSGTLSLPLLYPVPSSMFSSHASLPIHSRRLAAGLDSRWQQPQIQAIAGSQAIVPTVVEQSGRGERAFDIYSRLLRERIVFLGTGVDDAVADSIVAQLLFLEAEDPEKDIQLYINSPGGSVTAGMAIYDTMQQVAPDVATICFGLAASMGAFLLSGGAQGKRMALPSARIMIHQPLGGAQGQAVDIEIQAREILYHKSTLNDLLAQHTGQPLEKIEVDTDRDFFMSPEEAKAYGLIDQVLTRPTMAITDHNDAVLQ

SEQ ID NO: 42919 - protein, 174 aa, Prochlorococcus marinus str. MIT 9303
MDLSSLLPSPSPGLVNLLVEIPAGSRNKYEYFDEAGVMALDRVLHSSVRYPFDYGFIPNTLAEDGAPLDAMVIMEEPTFAGCLIRARPIGVLDMHDSGAYDGKLLCVPVADPRQRSISSIRQISASQLEDVAEFFRTYKNLEGRVVDIGGWRDSEAVEPLLETCTKAAQVKLKK

SEQ ID NO: 42920 - protein, 379 aa, Oryza glumipatula
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLSPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 42921 - protein, 230 aa, Xanthomonas axonopodis pv. citri str. 306
MPASSLQQILDAIHAAAAAHARADVRLLAVSKTKPADAVAALAAQGQRAFGENYVQEADAKIAQLRALDLEWHLIGHLQSNKAELASQCFDWVQTVDRAKLIPLLARHRPDDRAPLNVLIQVNIDDEDSKHGCAPDAIDSLAEAIALQPRLQLRGLMAIPAPFPDQARRQAAFSRMQALFRQLQARHRQVDTLSMGMSSDFAEAIAAGATMVRVGTALFGARGQAPDAAA

SEQ ID NO: 42922 - protein, 284 aa, Xanthomonas axonopodis pv. citri str. 306
MNTPASSSPSSSATTSIAFVGGGNMARSLIAGLIRQGTPAASIRVAEPVADLRAALARDFGVQVVEDARAAVDATTTWVLAVKPQVLPMVCAQLADLAQAQQPLLVSIAAGITATQLQRWSGGDIAVVRAMPNTPALLGAGVTGLYANARVSAAQRQQATQLLDSAGVTVWIDDEAQMDAVTAVSGSGPAYVFLLAEAMEAAAQAQGLPAAAARTLVLQTLLGAARMLTESGEAPEVLRRRVTSPNGTTHAAIETFQAGGFEALTAQAIAAATERGRSLSAAND

SEQ ID NO: 42923 - protein, 379 aa, Oryza barthii
MATAGKVIKCKAAVAWEAGKPLSIEEVEVAPPQAMEVRVKILYTALCHTDVYFWEAKGQTPVFPRILGHEAGGIVESVGEGVTELAPGDHVLPLFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHTVPFSEINTAFDLMLKGESLRCVMRMDE

SEQ ID NO: 42924 - protein, 379 aa, Oryza meridionalis
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHTVPFSEINTAFDLMLKGESLRCVMRMDE

SEQ ID NO: 42925 - protein, 230 aa, Dehalococcoides sp. CBDB1
MIKDIKNVFSKDPAARSVAEVLFCYPGLHALWFHRVANWLWRHKLHFWARWLSHGGRFCTGIEIHPGAKIGQRFFIDHGMGVVIGETSEIGNDVLMYQGVVLGGTSLSKGKRHPTICDNAVIGTGAIVLGGITVGEGAKVGAGSVVTKDVPAGATVVGIPGRVVEESRRMVIDLEHGKLPDPVADALKVVLTEQQKLMDRLAQLEKNSGLKVPQDELRGQIREIMKEFNL

SEQ ID NO: 42926 - protein, 381 aa, Medicago sativa
MSCSVAVSNSPVFSPSSSLFCNKSETLTLSLSHLKPSSTTTTTTTSSSSSSSSPSPCSSPSSPFCLRLPKLPLVFTSNKDSGSQNDAVLKRKRPTRLNIPVSEHAFCVPATPSAVARDVVEAEGDGYSVYCKRGRREYMEDRYTAGVNLRGENNLAFFGVFDGHGGAKAAEFARNNLEKNILDEVIMTDEDDVEEAVKRGYLNTDSEFMKKDLHGGSCCVTAFIRNGNLVVSNAGDCRAVISRGGVAEALTSDHRPSREDEKDRIETLGGYVDLCRGVWRIQGSLAVSRGIGDRHLKQWVTAEPETKVIRIEPEHDLLILASDGLWDKVSNQEAVDIARQFCVGNNNQQPLMACKKLAQLSVSRGSLDDTSVMIIKFKHYV

SEQ ID NO: 42927 - protein, 533 aa, Streptococcus oralis
VESALEKIGAKNIESSYRRGEAVFELSDDIEVESAIKAIADANYHPGEAEEIQVQSEKRTDVSLNDEGNYDYDYIIIGSGGAAFSSAIEAVTLNAKVAMIERGTVGGTCVNVGCVPSKTLLRAGEINHLAKNNPFVGLHTSASNVDLAPLVKQKNDLVTEMRNEKYVNLIDDYGFELIKGEAKFVNENTVEVNGNQITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHVEINGKKRIIEAEQLLIATGRKPNTESLNLHAAGVEVGSRGEIVIDDYLKTTNSRIYSAGDVTLGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMAPYLTMAEGLKLAVLTFDKDVSKLSCCAG

SEQ ID NO: 42928 - protein, 533 aa, Streptococcus mitis
VESALEKIGAKNIESSYRRGEAVFELSDDIEVESAIKAIADANYHPGEAEEIQVQSEKRTDVSLNDEGNYDYDYIIIGSGGAAFSSAIEAVTLNAKVAMIERGTVGGTCVNVGCVPSKTLLRAGEINHLAKNNPFVGLHTSASNVDLAPLVKQKNDLVTEMRNEKYVNLIDDYGFELIKGEAKFVNENTVEVNGNQITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHVEINGKKRIIEAEQLLIATGRKPNTESLNLHAAGVEVGSRGEIVIDDYLKTTNSRIYSAGDVTLGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMVPYLTMAEGLKLAVLTFDKDVSKLSCCAG

SEQ ID NO: 42929 - protein, 501 aa, Streptococcus parasanguinis
VESALEKIGAKNIESSYRRGEAVFELPDDIEVESAIKAIDEANYQAGEIEEVSSLENVALINEDNYDLLIIGSGAAAFSSAIKAIEYGAKVGMIERGTVGGTCVNIGCVPSKTLLRAGEINHLSKDNPFIGLQTSAGEVDLASLITQKDKLVSELRNQKYMDLIDEYNFDLIKGEAKFVDASTVEVNGTKLSAKRFLIATGASPSLPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLDAVPRAIVNRETTGVFKLVADAETLKVLGVHIVSENAGDVIYAASLAVKFGLTIEDLTETLAPY

SEQ ID NO: 42930 - protein, 542 aa, Oryza sativa
  misc_feature (58)..(58): Xaa can be any naturally occurring amino acid
  misc_feature (121)..(121): Xaa can be any naturally occurring amino acid
  misc_feature (146)..(146): Xaa can be any naturally occurring amino acid
MGQCPSAPRYHHHRHPPRNPPPPSPPPADHAPPQPLPTPDDDAPAAEDHTADLPDDLXAVVFGLLGSADRKRCSLVCRRWLSVDAASRLRLALDARAPLHAALPGILARFPAVSKLALKCXRRAESVADPTLALLADRLGPALRRXLKLRSIRLVTDDGVAALAAAATNLRKLSVGSCTFGAKGIEAVLRSCLHLEELSIKRLRGLAQSEPVAVSSLCLHSLCLKELYNGQCFSSLITNSPNLKTLKIIRCSGDWDPVLQDLPQDAMLAELHLEKLQVSDRGVSALSGLEVLYLAKAPEVTDVGLGKLATRSPRLRKLHVDGWKANRIGDRGLAAVAQKCAALQELVLIGVNLTSASLELIAANCPALERLALCGSDTFGDAEISCVATKCAALRKLCIKACPVSDAGMDKLAQGCPRLVKVKVKKCQGVTPECAERLRASRNGALAVNVDTPGGAGELQDARSVDESGVLENAGSDTLPDDLDDRIGGPDLSCGSSGRPSGWKARMGAFMSRSLSVSMFRRRPRGIFLLHSFKMSPYWDGN

SEQ ID NO: 42931 - protein, 131 aa, Rickettsia conorii str. Malish 7
MAYSKKVIDHYENPRNVGSLDKENKNVGTGLVGAPACGDVMKLQIAVDDDGIITDAKFKTFGCGSAIASSSLVTEWVKGRSVEDAETIKNTEIAKELSLPPVKLHCSLLAEDAIKAAIADYKQKKESKKDS

SEQ ID NO: 42932 - protein, 410 aa, Rickettsia conorii str. Malish 7
MNPQLNNLTLPIYMDYQATTPIDPRVMEAMLPYFTTKFGNPHSRSHSFGWEAENAVEEARSMVAKLIGADTKEIIFTSGATESNNLAIKGIAKFYSNKKNHIITVVSEHKCVLDACRHLEQEGIKITYLPIKPNGIIDLETLKNAITDQTMLVSVMVVNNEIGVVQPLKEIGKICREKGVFFHSDIAQGFGKIPIDVNAFNIDLASISGHKIYGPKGIGALYVRKKPRVRVTPLINGGGQERGMRSGTLPTPLIVGLGMAAEIAYSEMEKDTKHVNYLFDRFLNNIHKRISEVYLNGDKNQRYKGNLNLSFAGVEGESMILAIKDLAVSSGSACTSASLEPSYVLRSMGIGEELAHTAIRFGIGRFTTEQEVDYAVNLICSKIDKLRELSPLWEMMQEGIDLKKIKWAVH

SEQ ID NO: 42933 - protein, 514 aa, Zea mays
MAYPAAPHTSAAFLASFATPLPARRASPPTRRRAVSVAAIATTTTCVFADAPRGIKEEQADSGAQAAAAAAARRDVSPDTVASIILGGGAGTRLFPLTRTRAKPAVPVGGCYRLIDIPMSNCINSKINKIYVLTQFNSQSLNRHIARTYNFGEGVGFSGGSVEVLAATQTAGESGKKWFQGTADAVRQFLWLFEDARLKCIENILILSGDHLYRMDYMDFVQKHVDSGADISVACVPMDESRASDFGLMKADRNGHITDFLEKPKGADLESMQVDMGLFGLSPEFASTYKYMASMGIYVFKADVLRKLLRGHYPTANDFGLEVIPMAAKDYDVQAYLFDGYWEDIGTIKSFFEANLALTDQSPNFYFYDPVKPIFTSPRFLPPTKVENCKVLNSIVSHGCFLTECSVEHSVIGIRSRLEPGVQLKDTMMMGADYYQTEAERLSELSVGKVPVGVGENTKIRNCIIDKNARIGKNVVIMISENVQEADRPAEGYYIRSGITVVLKNAVILNGTKI

SEQ ID NO: 42934 - protein, 353 aa, Aspergillus oryzae
MLLSPTTSCDFLLFIRLYSSLRECLANICAIRNFLKVRNSYDVLPLSFRLIIFDTSLSVKESLNILIQNGMYLPYSVNSAVPVSRNGIVSAPLWDSKTSTFAGLLTTSDYINVIQYYFQNPAALGEIDQFRLDSLREVEKALGVAPPETISIDPERPLYEACRRMLDSRARRIPLVTNDSQTDRAHVLSVVTQYRILKFVAVNVSDTQKLRRPLGEILLGSYENVATASMDTPVIDVIHILVERSISSVPIVNSEGVVYNVFESVDVITLIKGGVYDDLSLTVGEALKKRSPDFPGIYTCSLNDGLDTIFDTIRKSRVHRLVVVDENFRLKGVLTLSDILQYILLEGENDESS

SEQ ID NO: 42935 - protein, 571 aa, Coprinopsis cinerea okayama7#130
MSSTDEKRDYSDEKGVVSTVSSDSLPSYEDAAVTTGAPTEKVSPLGYHVDAISVIFLNISKMIGTGVFTTPGSILKGVGSVGLSFIFWVIGYFFAGAQLAVYLEYVAYFPHRSGADVAYLEKAYPRPRFLLPTVFAVQSVLLSFSSSNAIVFARYVLVSAGVTETTWNLRGLAVGVYTVIVLIGIASTKWSLRISNAIGVVKVVTLLFIAITGFVVLGGHTSVADPKANFRNAFEGTSSNGNGLATSLVKVNFAYSGFENAFNVVNEVKNPIKTMKRYAPISLTAVFVLYMFANVAYFAAVPKEEIRESKELTASLFFRAVFGNTSSVRALGALVAVSSFGNMLAVVIGSSRIIRECARQGVIPYPQFWASTRPFNTPLGPYLIKWLLTVIVILAPPPGDAFNFIVNLQSYPANVFSFLLTLGLWFVRKRRAAIGAPRGEFVAWNAILVFTMAVNVYLLALPWVPPEGGIYAGDVSFFYATYCIVGLAILGVSGAVYALVIIILPKYGNYTIRQLLERLPDGAQTNRLVKVPNDQLAEWDATHDEHGDVIDPKTGKPIYQEGQASQPPASY

SEQ ID NO: 42936 - protein, 169 aa, Saccharomyces cerevisiae
  misc_feature (4)..(4): Xaa can be any naturally occurring amino acid
  misc_feature (39)..(39): Xaa can be any naturally occurring amino acid
  misc_feature (52)..(52): Xaa can be any naturally occurring amino acid
  misc_feature (105)..(105): Xaa can be any naturally occurring amino acid
  misc_feature (132)..(132): Xaa can be any naturally occurring amino acid
GAHXVTSNVVLVSGEGERFTVDKKIAERSLLLKNYLNDXGDDDDEDDDEIVXPVPNVRSSVLQKVIEWAEHHRDSNFPDEDDDDSRKSAPVDSWDREFLKVDQEXLYEIILAANYLNIKPLLDAGCKVVAEXIRGRSPEEIRRTFNIVNDFTPEEEAAIRRENEWAEDR

SEQ ID NO: 42937 - protein, 147 aa, Glycine max
APPPGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYL

SEQ ID NO: 42938 - protein, 490 aa, Brassica napus
RHHHSSILLQSLPLLLDRNTSQQPKHGTCSNRDPTASRHVAVIGAGAAGLVAARELRREGHSVVVLERGSQIGGVWTYTSQVEPDPLSLDPTRPVVHSSVYKSLRTNIPRECMGFTDFPFAARPHDGSRDPRRHPGHSEVLAYLRDFAKEFDIEEMIRFETEVVRAEPVADEENSGRWRVESRSSDAVSDEIYDAVVVCNGHYTEPRHALVSGIDSWPGKQIHSHNYRVPDPFKDQVVIVIGSSARGVDICRDIAKVAKEVHVSSRSTSLETYEKLPGYDNLWLHPTIETAREDGSVVFKNGKTVYADTIMHCTGYKYYFPFLDTKGEVTVDDNRVGPLYKHVFPPALAPGLSFIGLPWQITPFPMFELQSKWVAAVLSGRVSLPSQDEMMEDTKAFYDKLEASGIPKRYTHLLPDDSQFEYDNGLADQCDYPRIEKWREEMFYIGFKRIYAQSATYRDNWDDDHLIVEAYDDFVKFMSSYPELLPMLKT

SEQ ID NO: 42939 - protein, 547 aa, Prochlorococcus marinus str. MIT 9303
MEMVGVTDGLLKLSCNPTNQIKTANISDTKARPTFQSGSRVYRLIRLNRGSKLNDQASIEADSRWPQHSALTAVQHSLKGIAEDHPILRWQGAPYDGRVKTSLPVPLRLLLVRHGLSSFNRERRIQGRSDLSTLTSEGQEQARQTGQALKEIQINAVYSSPLKRAASTTTNLLASKGSDLRPCFDDGLLEIDLAPWSGLCSDEVKITFPDAYRTWKQQPQELVLKREDGNPYKPIGELMEQAREFLRKLIQRHPLEGDETVLVVSHNCILRCLILVLLGEPDQGLRRLRLDNASLSVFNLIPLSEQSHQAQIECLNSTVHLHQQLPSKGKGPRLILVRHGETDWNQQGRFQGQIDIPLNKNGFAQAAAAGAFLSDVLIDQAYSSSMTRPRQTAEAILKHHPDVQLEVTQGLVEIGHGLWEGKLESDIEAGWPELLEAWKQAPQTVQMPEGETIQDVSERSVACWNKIANSLAPEATALVVAHDAVNKTILCHLLGMTPADIWVVKQGNGGVTVVDIATDPGQPAVVTSLNLTSHLGGVLDRTAAGAL

SEQ ID NO: 42940 - protein, 320 aa, Oryza australiensis
MATTGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGT

SEQ ID NO: 42941 - protein, 340 aa, Volvox carteri f. nagariensis
MASTSTDPAPPVATPPLTAANVEAEMAAHVSGITPQLQNVVATVNLGTKLDLKEIAMHARNAEYNPKRFAAVIMRIREPKTTALIFASGKMVCTGAKSEDDSRTAARRYAKIVQKLGFPATFKEFKIQNIVGSCDVKFPIRLEGLAYAHSLFASYEPELFPGLIYRMKQPKIVLLIFVSGKVVLTGAKTRYEIYQAYMNIYPTLIQYKKGDAALPALPAANLMPPPRALPPARQAGQPDGSAEHMEQQQQQPQHHQQQQIPQPVQHPGSAAAAAAMMMPPPPTPSAAPTPSMTLQDLHAMNLPPPTPLHPNLPPPTPRHPGLAPTPSLGHHVLPPPSPRR

SEQ ID NO: 42942 - protein, 509 aa, Yarrowia lipolytica CLIB122
MTWIVQKFGGTSVGKFPKNICNDIVQQYSQSYDVAVVCSARSTGTKAEGTTTRLIAAADSALLGSDAYNPIIESIREDHLAAAKRDVKNPELLENLNADINGECDQLLRILAAAEIISEISPRTLDSIMAIGEKLSCMYMTAVMRDAGVNARYFDLSHAVTTTNAEDPKFYSDLGRVLGEIITLPGSPNTDSAPVKGNMVPVLTGFFGPVKGGLLSQIGRGYTDLCAALVAVGLDAKELQIWKEVDGVFTADPRKVSTARLLPIITPEEAAELTYYGSEVIHPFTMEQVIKAHIPIRIKNVENPLGGGTIIYPSADGSGNLKTKNNVQDLASSTDSLTSLSSGSFTPQVSAPVDDEKKPTAVTTKSNITVLNVHSNKRTKSHGFLNKIFATLDQQKLVVDLISTSEVHVSMAFHAPDSNLKQAVEELRKYGTVDVKRGMTIVSLIGTRMKAMVGCAGMFFSTLAQAGINIEMISQGANEINISCVIEEKDALKALNVIHQGLLCPRRKI

SEQ ID NO: 42943 - protein, 242 aa, Vibrio parahaemolyticus RIMD 2210633
MFVSKEGQNVPQVTFPTRQGDTWVNVTSDDLFKGKTVIVFSLPGAFTPTCSSSHLPRYNELFPVFKEHGVDEILCISVNDAFVMNAWKHDQEAEHITFIPDGNGEFTDGMGMLVDKNDIGFGKRSWRYSMLVKDGVIEKMFIEPNEPGDPFKVSDADTMLNYIAPEYRTQESITVFTKPGCPFCMKAKQNLIDHGLQYEEVILGKDATSVSLRAITGRTTVPQVFIGGKHIGGSEELETYLG

SEQ ID NO: 42944 - protein, 414 aa, Xanthomonas axonopodis pv. citri str. 306
MNVSAVPPSATPDWDRVRLDFPLLMRQVHGKPLIYFDNANTGQKPLQVIAATDEFYRRQNANVSRAVHALGSEATDAFEGARNKLARFLNVRADELVLCSGTTFAINLVAYSWALPRLGAGDVILISRMEHHANIVPWQLVAQRTGATIRVAEITPDGALDLDGLRKAMTPDVKLLAITHVSNVLGTVNPVREICREARKRGIVTMVDGSQAAPHRRIDVASIGCDFYAITGHKMCGPTGTGALWARREHLKAMPPFLGGGEMIKEVSFENTVFNDAPHKFEAGTPNIAGFVGLGAAVDYLESIGLAHVEAREAELLAHFTEELQRIDGLRIFGTTPDKAAVVSFLIDGAHAHDLATLLDLEGVAVRSGQHCAHPLLQYYGVAATCRASLAFYNTHDEIERFVAALVKVRRLLG

SEQ ID NO: 42945 - protein, 304 aa, Klebsiella pneumoniae subsp. pneumoniae MGH 78578
MRLPIILDTDPGIDDAAAIAAALFAPELDLQLMTTVAGNVSVEKTTRNALQLLHFWNADVPLAQGASMPLVRPLRDAASVHGESGMEGYDFVEHQRQPLAKPAFQAIRDALMHAAEPITLVAIGPLTNIALLLTQYPECVFNIRRLVIMGGSAGRGNFTPNAEFNIAIDPEAAAKVFHSGLEIVMCGLDVTNRALLAADYLATLPTLNQTGKMLHALFSHYRSGSMSSGLRMHDLCAIAWLARPELFTLQPCFVAVETQGTWTAGTTVVDIEGRLGQPANAQVALDIDVEGFQRWAAEVIALAP

SEQ ID NO: 42946 - protein, 241 aa, Aspergillus nidulans FGSC A4
MSTRQQALATAQVYIKRYYTKNEIRNTNPYLVLTTAFYLACKMEECPQHIRFVVSEARALWPEFIVPDVSKVGECEFSLISEMQAQLIVHHPYRTLSELQPELSLTSDEVALAWSVINDHYLTDLSLLYPPHIIAVMAIIVAVVFKPSSQTAFHGSAAPIAGAMRDGGMNILAALSDKGGAGPPPRIQKLIAWLAESEVDIKAVIESTQELVSLYEVWEQYSEKNCKELLGRMIRSKSLDK

SEQ ID NO: 42947 - protein, 655 aa, Oryza sativa Japonica Group
MADTFFPGAKLGWNKITGLNRRIISKKNLVDPATGMYCEELDPTGVNQVFLALVNSSTPYWSSGAWNGEYLSSIPKMASHNFFIPSFVNNDQEKYFTYNLANENIVSRQILDVGGQSKTFLWLEGSKDWVMVNAQPKAQCDVYSICGPFTVCTDNELPNCNCIKGFTITSLEDWVLEDRTGGCSRNTPIDCISNKTITRSSDKFYSMPCVRLPPNAQNVGSVDSSSECAQVCLNNCSCTAYSFSNGGCSVWHNELLNIRKNQCTGSSNTDGETFHIRLAAQELYSQEVNKRGMVIGVLSACFALFGLLLVILLLVKWRNKTKLSGGTRKDYQFCNGIIPFGYIDLQRATNNFTEKLGGGSFGSVFKGFLSDYTIVAVKRLDHACQGEKQFRAEVSSIGIIQHINLVKLIGFCCEGGRRLLVYEHMPNRSLDHQLFQTNTTLTWNIRYEIAIGIARGLAYLHENCQDCIIHCDIKPENILLDHSFSPKIADFGMAKLLGRDFSRVLTTTRGTAGYLAPEWISGVPITTKVDVYSYGMVLLEIISGKRNSYASCPCGGDHDVYFPVLVACKLLDGDMGGLVDYKLHGGIDKKEVEKAFKVACWCIQDDEFSRPTMGGVVQILEGLVEVDMPPMPRRLQAIAGSSNSTCSLYSLPANI

SEQ ID NO: 42948 - protein, 146 aa, Zea mays
MAKCSSKIRYIVWLRQTLRRWRSRAAARAAVPAGHVAVCVGGAARRFVVRAAHLNHPVFRELLRQAEEEYGFPSGACAGPIALPCDEGLFEHVLRHLSSPSKSARFVTLEDLESGALSCCCVAAAAAAAGDSLPLLRGISADKAVW

SEQ ID NO: 42949 - protein, 1491 aa, Aspergillus nidulans FGSC A4
MARQGFHLHAFTITSSNLPVRDAAKLGKRRASAESETRPEKKAMTDTKMQVDTPTQDTVEKIKQGDIDESLYSRQLYVLGHEAMKRMGSSNVLVVGLKGLGVEIAKNIALAGVKSLTLYDPAPVAISDLSSQFFLQPQDVGKPRAEVTAPRVAELNSYVPVTIHEGSSLVENLEQLKRYQAIVLTLTPLKEQLVIADFCHKNGIYLTIADTFGLFGYLFNDFGKNFTVGDSTGEDPVGGIVADISEDGLVSALDETRHGLEDGDFVTFTEVKGMEGLNNSAPRKVTVKGPYSFTIGDVSGLGTYQGGGLFTQVKMPKFIDFEPLSEQIKKPEFLISDFAKFDRPQQLHIGVQALHKFAETKGHFPRPHHESDAQELLQIANGLASSQEEKVELDEKLLKELSYQALGDLNPLAAFFGGIVAQEVLKAVSGKFGPVHQWLYFDSLESLPTSVTRSEETCKPLGTRYDGQIAVFGKEFQDKIANLTQFLVGAGAIGCETLKNWAMMGLGTGPKGKIYVTDMDQIEKSNLNRQFLFRSKDVGKLKSECASAAAVAMNPELEGKIVTLKDRVGPDTEHIFNEEFWEGLDGVTNALDNVEARTYVDRRCVFFRKPLLESGTLGTKGNTQVVLPRITESYSSSQDPPEKSFPMCTLKSFPNRIEHTIAWARDLFQTYFVGPPEAVNMYLSQPNYIEQTLKQAGNEKQTLEHLRDFLVTEKPANFDDCIVWARNQFEAQYNNAIQQLLYNFPRDSTTSTGQPFWSGPKRAPTPLKFDSTNPTHLGFIIAGANLHAYNYGIKNPGVDKGYYRKIVDNMIIPEFTPKSGVKIQASDNDPDPNAEASGSSFDDNDEIKRLVEILPSPKSLEGFRLNPVEFEKDDDTNHHIDFITAASNLRAENYEITPADRHKTKFIAGKIIPAIATTTALVTGLVALELLKIIDGKDDIEQYKNGFVNLALPFFGFSEPIASPKTKYQGKQGEVTIDQIWDRFEVDDIPLQDFLKHFSDLGLEISMVSSGVSLLYASFYGPSKVKDRLPMKMSELVEHISKKPIPDHQKNVIFEVTAEDQTEQDVEIPAKSGLVRLSDPSVINVISCEGLQAPPQSSASFTHINLVLFLALIFMFLVLRRANQLVQHLSPFSALFGPSNSNISRNLSPALLAKREMATDISKKITDWVNPGDKSGEFKRQASVFRNLISKEAGAEFPPEKDRYHLYVSYACPWAHRTLIVRKLKGLEDIISYTSVHWHLGEKGWRFATPDEDIPGANTTPDPVHSSYSHLRDIYFANEPNYTGRFTVPVLYDKKTKRIVSNESSEIIRMFYYEFDDLLPAQYQKVDLFPPHLREQIDATNDWVYNDVNNGVYKSGFATTQEAYERNVTTLFASLDRIEKHLADSKSAYFFGDDITEADIRLFTTIVRFDPVYVQHFKCNIRDIRSGYPAIHAWLRRLYWDVPAFRETTQFEHIKKHYTKSHSQINPFGITPVGPTPDILPKDKEVNAVKH

SEQ ID NO: 42950 - protein, 374 aa, Coprinopsis cinerea okayama7#130
MSFFGAGSSTTAGTSTTAPVEKDVEVADPPTDSISSLSFSPQAEYLAVASWDQSVRIYEVGPQGQTQGKAMYQHQGPVLDVCWNNDGTKIFSGGADNAGRMFDVTTGQATQVAQHDAPVKVVGWVNTPQAGILATGSWDKTIKVLPIGFVVHFEPSSTPLQYWDLRTPNPVATVTLPERCYTFDIQFPLMVVGTAERRIQIYNLSNPTTVYKELLSPLKWQTRVVSCITASEKSGFAVGSVEGRVAVHYVEDKDAANNFSFRCHRRDSTPNSKDQSQIFAVNSMAFHPVHGTLATCGSDGTMHFWDIEARTRLKSFDPAPGPISTGGFNRNGTLFAYAISYDWSKGHSGMTPGHPNKLMLHPCKEEEVRKRSRK

SEQ ID NO: 42951 - protein, 1581 aa, Coprinopsis cinerea okayama7#130
MSELDSWSDSDWLDIPSGNASEDNDSISSRDTHSRPLSRRSSFSLGSSREGDIEAWEGYAYDSHDEAAANLASGMYPLPNATLAGSTDLQRVPLDLIPNIETELDRAEDERVKEALEQSLIGTLSASRSSTTGAAGLATSGTTHSQSTNSAPNLRLSFPDPLTSSRNELTRSYDDVSPPQSPKDDGREQLPTESVSKAGEDAAAASPDQSPDPTQPSATITVREDEAQEVVPPKVDLEIHLYGSSTEYKWALVQDLLQKVADGSGQFLGKPLDPGAGLVQTVRLENDDEDSKGLINVVKIFDRTEDNKPPIDAYDDDAPSLGIVFLPALRLPPLALHDFYLPVMARNELLDLTYEGSIPAMRQAAEDDWELLCIPSFKAFPIKDGKYSVATHDGICGADSAQVREAMEVLVTGIPKKPVKSEPSTPVNAVTIFALVSLIVGFACNTSFHSNSPIPTKTVNLTTPNNTWIAISPGPNRSNSHPLHHTNVKTSAAITSLKDVALSVYIAGSTSLSLTSQIKSLVPTSSQSPAILPCIKCSTEAALAKPITRDVVVAPSSSVALAECPMPPSPSPSKALAVSEVDSNDDSEDVQEDGEEDILPEPTTKALGLKFVDSLSEALGVTKAAVIKSVNDETNDLFDSLDDLLSSIRTQTDELIKNSKGKARAFGEQVQNMGETLQYRNDRARSRAKELKKKGEEFIWTASERVKQRTDIAKKRAYRIRRSLEESDAWKVYQARRMEWDDGYEDAWKDTGTWGIHSSRGCAKVHSGRAGRLRSFSSTNERPQASCYLIAMATAARRTGRPKIHGPEFSAEKTWNALSQNIREIQNHNAASLSFEENYRYAYNMVLYKEGDMLYRGVCNLIASNLDQLAEQHIIPRFPAGSINDRLQRSQAGELLLKALREVWDDHVSNMTKLGQLLKYMDRIYTKNANVPETWDKGVELFLKHVIRSPIKDHLVSGILDQVQCERDGHTINRSAVKGCVDVLLWLETGNSITVYKKELEPPFLKESEAFYKDESRHLLDTCDAPEYLQRVEARFESEDSRIHHYLSPQTSAAIKQILQDHLLTPNLSAVISMPNSGLDVMIDANKLDDLSRLYRLFMQVPTGLPVLRKSLRESIIRRGKELNDASLGAGTADAEGDGPREEKGKGKARPVNTVLPAVTWVQDVLALKDRFDQVWKEAFQSDRDLEAAINEAFESFVNAHGKAPEYTSLFIDDHLKRGLKGKSDDEVDVVLGKTITVFRYITDKDVFERYYKSHLAKRLLHGRSVNDDAERGMLAKLKLESGFQFTSKLEGMFNDIKLSNDAMVEYREYIQSRTVWSPSIIAVTGLIYFAKKAPAIELSVTVMTTTFWPISPPAVPCAVPDILAEACKSFEGFYFSRHSGRRLTWSMALGNADVRTRFKTRTHDLNVSTYALIILLLFENLAESDFLTYEEIKEGTGIEEHELKRNLQSLACAKFRILKKHPPGRDIHEEDSFSFNHDFSEKMQRIKISTISSKPETTRERQETNERIDEERKFQIEACIVRVMKDRKHLAHNALVNEVTKQLSSRFHPDPLAIKRRIEGLIEKEYLERCEDRKSYNYLA

SEQ ID NO: 42952 - protein, 494 aa, Staphylococcus epidermidis RP62A
MSTKQKHIPCLITIFGATGDLSHRKLFPSIFHLYQQDNLDEHIAIIGIGRRDYNNEQFRDQVKASIQTYVKDTDRIDEFMTHVFYHKTDVSDKESYQSLLQFSERLDSEFALGGNRLFYLAMAPQFFGVISDYLKSSGLTQTTGFKRLVIEKPFGSDLKSAESLNNQIRRSFKEEEIYRIDHYLGKDMVQNIEVLRFANAMFEPLWNNKYISNIQVTSSEVLGVEDRGGYYESSGALKDMVQNHMLQMVALLAMEAPISLNSEDIRAEKVKVLKSLRQLKPEEVKKNFVRGQYDQGNIDGKQVKSYREEDRVAKDSVTPTFVSGKLTIDNFRWAGVPFYIRTGKRMKSKTIQVVVEFKEVPMNLYYETDNLLDSNLLVINIQPNEGISLHLNAKKNIQGIDTEPVQLSYAMSAQDKMNTVDAYENLLFDCLKGDATNFTHWEELKSTWKFVDAIQDQWTMVEPCFPNYEAGTNGPLESDLLLSRDGNHWWDDIH

SEQ ID NO: 42953 - protein, 56 aa, Zea mays
  misc_feature (17)..(17): Xaa can be any naturally occurring amino acid
  misc_feature (36)..(36): Xaa can be any naturally occurring amino acid
KKRGRKARPNLKVGICXKHGGKPSWVAFFAKNGVDXVFCSPLRVPMVRQTTVQVFV

SEQ ID NO: 42954 - protein, 307 aa, Myxococcus xanthus DK 1622
MQSNVFTAVLMPLALAVIMLGLGLTLTLADFKRVIVYPRAILVGLGSQMLVLPVACLLIAHAFRLPPELAVGLMLLAASPGGATANLFSHLARGDVALNITLTAVNSALSLVTLPLIINLSLAHFMDEGRAVPMQFAKIVQVVLIVLGPVSLGMFIRSRSAAVAQRMDKPIRILSTLFLVAVIAASVYTERANALSFFRQVGPAALAFNLVSLGVGYFVPILLRLPRRQAVAIGMEIGIHNGMLAIAIALSPTLLANSTMAIPPAIYSLIMYFTAAAFGFYVSRRYADEQDPAVHRTPTSLPEKVSR

SEQ ID NO: 42955 - protein, 453 aa, Escherichia coli CFT073
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGRGQGGGRGQQQPRRAESGAKSGNAKPAEKPSRRLGDAKPAGEQQRRRRPRKPAAAQ

SEQ ID NO: 42956 - protein, 216 aa, Rickettsia conorii str. Malish 7
MTKNYLINQFQEKILMSYVPIVIEPTSRGERAYDIYSRLLKERIIFVCSTVEDHMANLIVAQLLFLEAENPKKDIYMYINSPGGVVTAGLAIYDTMQYIKPKVATLCIGQACSMGSLLLCGGEKGMRYSLPHSRIMIHQPSGGYKGQATDIEIHAQETLKIKRLLNELYSKHTEQELKHIEKSMERDNFMSPEEAKKFGLVDNIMSSRDAMALLAK

SEQ ID NO: 42957 - protein, 69 aa, Glycine max
MADWGPVVIAVVLFVLLSPGLVFQLPGKSRVVEFGNMQTSAVSILVHTIIFFGLITIFLVAIGVHIYTG

SEQ ID NO: 42958 - protein, 459 aa, Synechococcus elongatus PCC 6301
MRVSVIGTGYVGLVTGTCLAHIGHEVLCIDNNTAKIEQIQAGQIPIYEPGLEDLIQRATAAGRLQFSTDLAAGVAHAEVIFIAVGTPPLPNGEADMRFVEAVARGIGEHLDGETYRVIVNKSTVPIGSGDWVRMLILDGMLARRQALVPVGAAIADSEDLPQGCFDVVSNPEFLREGTAIYDTFNPDRIVLGGSSDRAFAKMQELYEPIVQRQFAVDRDRPPVPVLRTDLGSAEMIKYAANAFLATKISFINEVANICDRVGADVVQVAKGMGLDARIGSRFLNAGLGWGGSCFPKDVSALVHIAQDYGYPAALLEATIAVNQRQRLILLEKLQQELKILKGKTIGLLGLTFKPDTDDLRDAPSLTLAEQLLRLGAKVKAYDPIVKTAPIAGLEITTSPLDLASGCDALALVTEWQEFQELDYLPLAARMRRPLIIDGRNCLDRDRLQMQGFRYIGIGR

SEQ ID NO: 42959 - protein, 338 aa, Haemophilus somnus 2336
MAILVTGGAGYIGSHTVVELLNHHFEIVVLDNLSNSSEVSLQRVQQITGKNITFYQGDILDREILQRIFSTHKIEAVIHFAGLKAVGESVKKPLHYYQNNVNGSITLLEEMLKAGIYNLVFSSSATVYGDPEIIPITETCKVGGTTNPYGTSKFMVERILQDAVSANPHLSVVILRYFNPVGAHESGLIGEDPNGIPNNLLPYISQVAVGKLPQLSVFGSDYDTHDGTGVRDYIHVVDLAIGHLKALEKHQNDPGCHIYNLGTGIGYSVLDMVKAFEKANDIQIPYKLVERRPGDIATCYSNPQKALEKLGWKTERDLTQMMKDTWNWQKNNPNGYKS

SEQ ID NO: 42960 - protein, 263 aa, Vibrio parahaemolyticus RIMD 2210633
MTQTNQAPLVIKLGGAALSCTQTLSQLFGAIAAYQKSAQRQIAIVHGGGYLVDELMAKLQLKTVKKHGLRVTPYDQIPVIAGALAGTANKLLQGQAIADGLNAVGLSLADGGLCHVEELDPELGAVGKATPGDSSLLQAILNTGALPIISSIGLTAEGQMMNVNADQAAVAVAGALDAELVLLSDVSGVLDGKGHLLKSLSKKEANALIEGQVITDGMIVKVKAALEAANDLGRPIEVATWRYPEKLTQLFAGESIGTQFLPQ

SEQ ID NO: 42961 - protein, 586 aa, Neurospora crassa
MMWSLLVSLALLCFGTVARAAVVTINWNVTWVWASPDGFGRPVIGINNQWPCPKLEANVGDTLIVNLHNGLGNQTTGIHWHGINQLQTPEMDGPSGVVQCPTPPGSSVQYKFVLDEPGTFWYHSHEKGQYPDGLRGPLIVQDPNDPYKGRYDEEIVLTVSDWYHSQSIPLVQNMLSPANTRFAPPFPDTILLNDKKDVKFNFVKGKTYRVRLINMSAFASAFLWIDSHPLTMIMSDSTYLQTETAYQLHASSAQRYDFLISAIDRDSGNYPILVALDINRDFRNQTLAPAFPHNQTAWLMMDENAPLTRPTNTIDVWRPADDTHFKPLDNLAMVPAYDHLVKLDFRFCLDANGYPRACLNGKPFISQKVPSLYTAATVGGNNTNPLVYGQINPVVVRKGDIVQLVINNQEAAGHPFHLHGHSFQILDRARPYAGDWPGRDVNYNPVPNRRDTVTVWSWSHAVLRFRADNPGVWLFHCHIEWHVEMGLTASFIEGPEQLRGKQFPADHLENCRVGGVPTRGNAAGNELDPLDTTGMLTISPTGYTGATWIPPPANTVSMTPGNSTSPLARRRAASRVQRRDTVFENS

SEQ ID NO: 42962 - protein, 134 aa, Brassica napus
  misc_feature (108)..(108): Xaa can be any naturally occurring amino acid
MVERGNKRTHNRTTRDDNNRNQKRRLSHQTEEKLNNKDDLVVYRILCPSGVIGSVIGKSGKVINTIRQETRARIKVVDPFPGCTERVLTIYCTVNDKKDIAEIENSDXSPLCSAQDALLKLHDAIVASLATAAE

SEQ ID NO: 42963 - protein, 420 aa, Vitis vinifera
MQHQRLKQQQQALMQQALLQQQSLYHPGLLAPPQIEPIPSGNLPPGFDSSTCRSVYVGNIHTQVSEPLLQEVFASTGPVEGCKLVRKEKSSYGFIHYFDRRSAALAILSLNGRHLFGQPIKVNWAYASGQREDTSGHFNIFVGDLSPEVTDATLFACFSVFPSCSDARVMWDQKTGRSRGFGFVSFRNQQDAQSAINDITGKWLGSRQIRCNWATKGAGSNDDKQSSDAKSVVELTNGSSEDGKETATNEAPDNNPQYTTVYVGNLAPEVTQLDLHRHFHTFGAGVIEEVRVQRDKGFGFVRYNTHAEAALAIQMGNTQSILCGKPIKCSWGSKPTPPGTSSNPLPPPAAAPLPGLSATDLLAYERQLAMSKMGHALMHPQGQHPLKQAAMGMGAAGASQAIYDGGFQNVAAAQQLMYYQ

SEQ ID NO: 42964 - protein, 149 aa, Staphylococcus epidermidis RP62A
MERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 42965 - protein, 118 aa, Triticum aestivum
MAGGKEPIEVKFRLFDGTDIGPSKYDPATTVSALKDFILARWPQDKEITPKTVNDLKLINGGKILENNRTLAESRVTIGEVPGGVITMHVVVRPPQVDKNQKQLGNSPKQNRCGCTIL

SEQ ID NO: 42966 - protein, 319 aa, Oryza barthii
QLSPAIAQLQHLTKLSISMNSISGSLPPDLGSLKNLELLDIKMNTFNGSIPGTFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEALKGA

SEQ ID NO: 42967 - protein, 282 aa, Vitis vinifera
MKNRRVLFERPWLLTVVIGGMIGAAILINSFGRTSSNSLLCSFSGAYTRPDHSDDSVAQTQLIAILHYATSRVVPQQSLAEIRVSFDVLQSLAPCNFLVYGLGHDSVMWSSFNPKGTTIFLEEDPKWVQTVLKQAPNLLAHTVRYRTHLSEADQLLRSYKSEPACLPPDVRLRDNTACRLALTGLPEEVYDTEWDLIMIDAPRGYFPEAPGRMGAIFTAAVMARARKRQGVTHVFLHDVNRRIEKVYAEEFLCKKNLVKAEGRLWHFAIPSAANDTMNSAFC

SEQ ID NO: 42968 - protein, 332 aa, Staphylococcus epidermidis RP62A
MRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGYGDNAKAALMTRGLAEISRLGEKLGADPMTFLGLGGIGDLIVTCTSTHSRNYTLGFKLGQGKTAEEALKEMKMVVEGIYTTKSVYHLAQQEGVEMPITNALYEVLFEDVPVSKSVRTLMERDKKAE

SEQ ID NO: 42969 - protein, 326 aa, Methylobacillus flagellatus KT
MLASFTPTTSHAYILASLMIAHIYFVRRFPAPGESFQADGFYCETGGKGLNVLIGLHKLGIPVDGILPCGRTPSSRQQHLEVLSQWALDHIAAPITAEYNGHGVALIDEQGQNQIIVHPGANALLGENHVQPHATSIQRASLVYAPFELPDSAILAAFKIAHSAGRMTVLNPSPYRDISPELLALTDVFILNQTEAQAWLNGMPEHFASCEAALTWLRVIRFNQRFAGKSIILTLGCKGAIALLENGNTYTHTGFITPTVDTIGAGDAFASALLASLLRGDCVNTALRHGCASASLTIRQRGLLAHLPSEKVLHDFLNGEGSTINS

SEQ ID NO: 42970 - protein, 374 aa, Oryza sativa
MSLASHAVRSTRAFASSSIASARLTSLNRQINTSPFLGFRKMSSLPKTMKAVYIEKTGGTDVLQYKTDVPVPEPQEGEVLVKNDFIGINYIDTYFRSGVYKPPKFPYILGREGAGTIAAVGPNVPSDLTVGTRVGYMGQYAYAEYVPVAATYTIPLPDSIDSKTAAASILQALTAITLIRDAYPVQKGDWILVTAAAGGVGLWLCQLLRAIGARVIASASTEEKRNLAKENGAEFVLGYYEEDRDQFVKKVLEITGGEGVHAVFDSVGKATFDSSLATIRRKGSMISFGNASGPVEGFALARLSAKNLKLMRTTLFNFIVTREETLKAAEELWKLIEKDGLNVKIHEVYPLEDIVRATQDIEGRKTTGKLLLKP

SEQ ID NO: 42971 - protein, 186 aa, Zea mays
MSEEVKENQSGKLQKPTPRLNERILSSLSKRSVAAHPWHDLEIGPGAPVIFNVVVEISKGSKVKYELDKKTGLIKVDRILYSSVVYPHNYGFIPRTLCEDNDPLDVLVIMQEPVLPGCFLRARAIGLMPMIDQGEKDDKIIAVCVDDPEYKHYTDIKELPPHRLTEIRRFFEDYKKNEKQEVAVND

SEQ ID NO: 42972 - protein, 261 aa, Zea mays
MEKGKKSGSGRGYISWNDDMDKALLDTFVEYYNKGDRCQNGWKSHVYTAAIKNVREKCNVEITKDNIMSRNKTFDKHHTIINGMLQTSGFGWDWNKNKISVDSDSVWEAYVAKNKEANGYRHKTVLYWDSINLVFGKDHATGEAAKTPTDGARDMSKEEGTGKELTSSTTSGSLKRQRSSDSFTSMMAEKLDKFTEAIRDEAPKGPTSKEIFSTLEEIDGLDEDTFLDLFDILTGDARKYESLLALPLILRKRWLLKQLKK

SEQ ID NO: 42973 - protein, 425 aa, Vibrio parahaemolyticus RIMD 2210633
MSEDNRQAATPEEEHRQKALDYHAYPTPGKIAVELTKPAETAGDLALAYSPGVAEPVREIAQNPDNVYKYTAKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLEDSTIVCLGAGAAAVACMELLIKCGAMREKIYMLDRKGVIHTRRDDLNEYKQLFANNTDKRTLEDVIEGADLFLGVSGPNLLPPEALKLMADKPVVFACSNPDPEIKPELAHAVRDDLIMGTGRSDYPNQVNNVLCFPFIFRGALDVRASEINDDMKLAAVDAIRALAKEPVPESVLKAAGVEKLEFGSDYIIPKPMDPRLLPRVAKAVAQAAVDSGVARIEMPENYMAE

SEQ ID NO: 42974 - protein, 188 aa, Oryza sativa Indica Group
MTNVEGSKVDEDGDEVGEEGHAGSLCSIVADVKEPEADEVDNDGIEAGRAQGDGVAEDSNEVSGESDDENNGGDNKGVLTTEAGECVRDAKVLDIGGRGSGIVAARVPKKVLQFAGIEDVFTSSRGSTKTLGNFVKATFDCLMKTYGFLTPDFWRETRFIKTPFQEYTDLLARPKGLVIEAPAEKIEA

SEQ ID NO: 42975 - protein, 159 aa, Vitis vinifera
MIKPDGLSGNYTDEIKNAILESGFIILREMTVRLDEDTAGKFYAEHSSRSFFPALVKYMTSGPVLVMVLEKVNAVADWRALIGPTDAQKAKVTHPHSIRAMCGQDLEKNCVHGSDSPQSAEREISFFFEEFSSGQFLSPLVNITKYIYLNLPMPLLSKT

SEQ ID NO: 42976 - protein, 391 aa, Klebsiella pneumoniae subsp. pneumoniae MGH 78578
MSGYSLEDVLIKSALLVLEDGTQFHGRAIGATGTAVGEVVFNTSMTGYQEILTDPSYSRQIVTLTYPHIGNVGTNAADEESSQVHAQGLVIRDLPLIASNFRSTEDLSSYLKRHNIVAIADIDTRKLTRLLREKGAQNGCIIAGDSPDAQLALEKAKAFPGLNGMDLAKEVTTAETYSWTQGSWTLAGDLPEAKAESELPFHVVAYDFGAKRNILRMLVDRGCRLTVVPAKTSAADVLALNPDGIFLSNGPGDPAPCDYAIEAIEKFLETDIPVFGICLGHQLLALASGAKTIKMKFGHHGGNHPVKDIDNNVVMITAQNHGFAVDEATLPANLRVTHKSLFDGTLQGIHRTDKPAFSFQGHPEASPGPHDAAPLFDHFIELIELYRQSAK

SEQ ID NO: 42977 - protein, 209 aa, Magnetospirillum magnetotacticum MS-1
MGDLIQAERDQLSRNEHIKEASGYLRGKLAEALLMPASGAVSDDDGQLVKFHGMYLQDDRDLRPERMRKKLDRAYAFMIRLRIPGGVLTSKQWLVLDEIARSYANGSLRATTRQTFQYHGVIKSNLKRTMKAIDGALLDTIAACGDVNRNVLSASNPYQSKAHAAAYDLAKAISDHLLPRTGAWREIWLDGEKVVGGEDETVEPIYGKT

SEQ ID NO: 42978 - protein, 145 aa, Prochlorococcus marinus str. MIT 9303
MFGLIGHSTSFEDARKKALEIGYDHLDGDLDVWCSAPPQFLEEIEVESLTGKKIEGAYIDSCFVPEMLSRFKTARRKVLNAMELAQKRGIEISALGGFTSIIFENFNLLRHQHVRNTTLDGSALRLAILIQHGLFAVSLRTMPHF

SEQ ID NO: 42979 - protein, 621 aa, Klebsiella pneumoniae subsp. pneumoniae MGH 78578
MDSHTLIQALIYLGAAALIVPIAVRLGLGSVLGYLIAGCIIGPWALRLVTDAEAILHFAEIGVVLMLFVIGLELDPQRLWKLRASVFGGGALQMVACGVLIGLFCMLLGLRWQVAELIGMTLALSSTAIAMQAMNERNLTVSQMGRSAFAVLLFQDIAAIPLVAMIPLLAASGGATSLMAFALSALKVAAALALVVVLGRYLTRPLLRFVARSGLREVFSAVALFLVFGFGLLLEEVGLSMAMGAFLAGVLLASSEYRHALESDIEPFKGLLLGLFFIGVGMSIDFGTLVTHPLRIVILLVGFLAIKMLMLWLIARPLGVPRAQRRWFAVLLGQGSEFAFVVFGAARMADVLDGEWAKALTLAVALSMAATPILLVLLTRLEKSSSGQARDADEIDEEQPRVIVAGFGRFGQIAGRLLLSSGVKMVILDHDPDHVDTLRKFDMKVFYGDATRVDLLESAGAEKAEVLINAIDDPHVSLELVARVKEHFPHLQIISRARDVDHYIQLRQAGVEAPERETFEAALKSGRMTLEALGLGAYEARERADLFRRFNLQMVEEMVAMAENDAASRVAVFKRTSDMLTGIINEDRHHLSLVQRHGWQGTEEGRHTGDIADEPENKPSA

SEQ ID NO: 42980 - protein, 437 aa, Neocallimastix frontalis
MLANVTRSTSKAAPALASIAQTAQKRFLSVHEYCSMNLLHEYNVNAPKGIVAKTPEEAYQAAKKLNTEDLVIKAQVLAGGRGKGHFDSGLQGGVKLCYTPEQVKDYASKMLGHKLITKQTGAAGRDCNAVYVVERQYAAREYYFAILLDRATRGPVLVASSEGGVEIEEVAKTNPDAILTVPFSIKTGLTREVALDTAKKMGFTEKCVPQAADTFMKLYKIFIEKDATMVEINPMAENNRGEVVCMDAKFGFDDNASYKPKGIFALRDTTQEDPREVAGHAKWNLNYVGMEGNIGCLVNGAGLAMATMDIIKLNGGVPANFLDVGGSATAKQVKEAFKIISSDKAVSAILVNIFGGIMRCDIVAEGVIQAVKELGLDIPLVVRLQGTKVEEARELIKNSNLSLYAIDDLDKAAKKVVQLANVVGLAKENGIKIKIEN

SEQ ID NO: 42981 - protein, 338 aa, Arabidopsis thaliana
MTSYNNSSGSLALAVALLFAGALYIYFSSRSASDPISGLLQNVNTRLIQYPVDELETVLDKASTGNNKTVIIAMVNKAYVEEDGGGRTMLDLFLESFWEGEGTRPLLNHLMVVAADQTAYDRCLFRRLHCYKMDTEGVDLEGEKVYMSKDFIEMMWRRTRLLLDVLSRGYHIIFTDTDVMWLRSPLSRLNVSLDMHISVDRNNVRGQLINTGFYHARSNNKTISLFQKWYDMRLKSLGMKEQDVLKNLLDSGFFNQLGLNVGFLSTAEFSGFCQDSPDMGAVTTVHANCCVHIPAKISDLSLALRDWKRYKASRVNSRWSPHVECRRSWKDVHYVPKL

SEQ ID NO: 42982 - protein, 739 aa, Nicotiana tabacum
MSSKNLFSFLFLLVLPFSSSSDATAWIKSGFWYAGSEFPVPEIPSTMFTHIHFAFAYINASSFELYVSHSDEPYISTFSNTVKQKNPSVITLLSIWGGRDESPNFFAMTSQFSRRKSFITTSIKTARQYGFQGLDLIGVNPNTDANMTNMRSFIEEWRTAINSESKSSGTRTLILTMGAYYSPMLDSMSYPIDTIIRNFDWVHLKAYAALYDPTSKLNTDYGIKEWIKRGLPANKIVLGLAYHGYAWTLVNPKHNTVRTPARGLAITQDGSISYRYIKQYMKSYGVTPVYNSTFVVNYVTIGSFWIGYDDVEAIRTKVSYAKDKGLLGFAAFQIPSDDVNWELSKTAQDEEEEDQSGSNRRLLAILLPTLTLTILLLSTIVFILKKKTLRSEGIRELNERAIGHNLKVFKFDKIKAATDNFSIKNKLGEGGFGPVYKGRLSDGQEIAIKRLSAYSKQGVEEFQNEVTLASKLQHVNVLQLQGCCTEREEKILIYEYMPNKSLDFYLYDPVQSLQLDWETRVRIIEGVTQGLLYLQEYSAFTVIHRDLKASNILLDDEMKPKISDFGIAKLFQKDEKEANTGRIVGTYGCVPPEYVKRGLYSRKYDVYSFGVLLLQILGEKKNSSEYGIKNDLNLLEYAYELWEKGNGVDFLDLSLQDDSRIGKQLRYMQAALLCVQEKWEDRPSMLEVYSMLKNETEVLPNPKVPAFSKNKDNDTQETLVTPDLTCSDNSLTISQLIAR

SEQ ID NO: 42983 - protein, 509 aa, Saccharomyces cerevisiae
MATIAPTAPITPPMESTGDRLVTLELKDGTVLQGYSFGAEKSVAGELVFQTGMVGYPESVTDPSYEGQILVITYPLVGNYGVPDMHLRDELVEELPRYFESNRIHIAGLVISHYTDEYSHYLAKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVRIESCSMDYDFTKEDYDGLFYSNGPGDPSVLDDLSQRLSNVLEAKKTPYFGICLGHQLIARAAVQSTLKLKFGNRGHNIPCTSTISGRCYITSQNHGFAVDVDTLTSGWKPLFVNANDDSNERFYHSELPYFSVQFHPESTPGPEIQNSCLTFIQAVKEFKYTQVLKPIAFPGGLLEDNVQGTPRIEAKKVLVLGSGGLSIGQAGEFDYSGSQAIKALKEEGIYTILINPNTATNQTSKGLGDKVYFVPVNAAKQRDVDR

SEQ ID NO: 42984 - protein, 1063 aa, Oryza sativa Indica Group
MDGDADAVKSGRHGSGQACQICGDGVGTTAEGDVFAACDVCGFPVCRPCYEYERKDGTQACPQCKTKYKRHKGSPAIRGEEGEDTDADDVSDYNYPASGSADQKQKIADRMRSWRMNAGGGGDVGRPKYDSGEIGLTKSREKSPGASPDHHMMSPTGNIGKRAPFPYVNHSPNPSREFSGSIGNVAWKERVDGWKLKQDKGAIPMTNGTSIAPSEGRGVGDIDASTDYNMEDALLNDETRQPLSRKVPLPSSRINPYRMVIVLRLVVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKKGSFLSSLCGGRKKASKSKKKSSDKKKSNKHVDSAVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLIYCVLPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 42985 - protein, 439 aa, Staphylococcus epidermidis RP62A
MDIKMPKLGESVHEGTIEQWLVSVGDHVDEYEPLCEVITDKVTAEVPSTISGTITELVVEEGQTVNINTVICKIDSENGQNQTESANEFKEEQNQHSQSNINVSQFENNPKTHESEVHTASSRANNNGRFSPVVFKLASEHDIDLTQVKGTGFEGRVTKKDIQNIINNPNDQEKEKEFKQTDKKDHSTNHCDFLHQSSTKNEHSPLSNERVVPVKGIRKAIAQNMVTSVSEIPHGWMMVEADATNLVQTRNYHKAQFKQNEGYNLTFFAFFVKAVAEALKVNPLLNSTWQGDEIVIHKDINISIAVADDDKLYVPVIKNADEKSIKGIAREINDLATKARLGKLAQSDMQNGTFTVNNTGSFGSVSSMGIINHPQAAILQVESVVKKPVVIDDMIAIRNMVNLCISIDHRILDGVQTGKFMNLVKKKIEQYSIENTSIY

SEQ ID NO: 42986 - protein, 254 aa, Xanthobacter autotrophicus Py2
MPASRRVLIAGNWKMNGLKSSLAEIEALAAGYDGDLKAKLDLLVCPPATLLISAAERLAGSGVQLGGQNCHPAPAGAHTGGISAEMLKDAGVTSVIVGHSERRTNLSESDAVVMAKVKAAWCFGLLPIVCVGETAEERDAGEAVGVVTRQVHQSLPEGCTASNLVIAYEPVWAIGTGRTPTPEDVANIHGTIRSVLRSQFGAEADGIRILYGGSVKPDNAATLMAVADVDGALVGGASLKAADFLAIARATPAR

SEQ ID NO: 42987 - protein, 68 aa, Vitis vinifera
MRDWAALLIASALFAFLSPGLIFQIPGRERPADFMGMKTNIAAVFVHAVIYGLLLILFFIILNVHLYA

SEQ ID NO: 42988 - protein, 625 aa, Yersinia pestis biovar Microtus str. 91001
MGRIAVDLYGQQIGARLEDVASFAKYLGGSSGNVAYGSARQGLRSSMLARVGDEHMGRFLREELHQVGCDTSHLTTDKKRLTALVLLSIKDRDTFPLIFYRDNCADMAITAQDFSEQYIASARSLAITGTHLSHPNTREAVLTALRYARRNGVRTVLDIDYRPVLWGLTSLGDGETRFIESHQVTAELLAVFNLFDVIVGTEEEFHIAGGSTNTLDALRGVREVSDAALVCKRGALGCSVYTEAIPQTLDEGLTVSGVRVKVLNVLGAGDAFMSGLLRGYLNDEGWPQACRYANACGALVVSRHGCAPAMPSKIELDNYLARADAVVRPDLDVHLNHLHRVTTRRRQWPELCVMAFDHRSQLEEMALQCGADLCHISTLKTLILQASREAVHTAGLQGKAGLLCDGTFGQDALNAITGAGWWIGRPIELPGSRPLAMEHGNIGSQLIGWPQEHIVKCLVFFHPEDAYSLRLEQEQKIIEVYRACCQSGHELLLEVILPAGMPRSDELYLRAISRFYNLGVYPDWWKLPPLASEGWAALNKLIERRDPHCRGVVILGLDASLEALRTGFNAAAGYPIVKGFAVGRTLFGDASLAWLKRDIDDTQLIARIRDNYLQLITLWRERGQK

SEQ ID NO: 42989 - protein, 235 aa, Oryza sativa Japonica Group
MAGAGDELKLLGMWTSPFALRVKLALSFKGLSYEYAEEDLSNKSELLLSSNPVHKKVPVLIHNGKPICESQVIVQYIDEAFPGAGVPLLPSDPYERAVARFWAAYIDDKLLKSWLQASMGKTEEEKAEALKETFTAVANLEAAFEECSKGKPFFGGDAVGYLDVTLGALVSWVHAGEALYGMRLFDATRSPLLDAWVDRFAALDAAMAVLPDAGTLAEYAKKRQAERAAAAAANN

SEQ ID NO: 42990 - protein, 473 aa, Staphylococcus epidermidis RP62A
MSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNGYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEISLLQFMNGSSLELGLTTHAHPSLSEVVMELGLKANGQAIHV

SEQ ID NO: 42991 - protein, 412 aa, Rickettsia conorii str. Malish 7
MPIKILMPALSPTMTEGNLARWLKKEGDKVNPGEVIAEIETDKATMEVEAVDEGILAKIVIPQNSQNVPVNSLIAVLSEEGEEKTDIDAFIAKNNSVSPSPKTDANLPKPHENIANVEEQVTVIKHDVSRIFASPLAKRLAKMRNIRFESVKGSGPHGRIVKQDILSYTPSTAHNKIVSRNPEEYRLVPNNNIRKIIAKRLLESKQTVPHFYLSIECNVDKLLDIREDINKFFSEDKSTRISVNDFIILAVAKALQEVPNANASWGEDAIRYYNNVDISVAVAIENGLVTPIVKNANQKNILELSREMKALIKKAKDNKLTPEEFQGGGFTISNLGMYGIKNFNAIINPPQSCIMGVGASAKRAIVKNDQITIATIMDVTLSADHRVVDGAVGAEFLVAFKKFIESPVLMLI

SEQ ID NO: 42992 - protein, 239 aa, Glycine max
MRAPPTSHSITMAMAFPSVTSVTVENVTFPPTVKPPCSPNTFFLAGAGVRGLQIHHAFVKFTAICIYLQYDALSFLSVKWKTKSTHQLTESDQFFSDIVTGPFEKFMQVTMIKPLTGQQYSEKVAENCVAIWRSLGIYTDSEAEAIDKFLSVFKDLTFPPGSSILFTVSPNGSLTISFSGDETIPEVTSAVIENKLLSEAVLESMIGKNGVSPAAKQSLASRLSHLFKEPGVCDPQSHK

SEQ ID NO: 42993 - protein, 461 aa, Oryza sativa Japonica Group
MPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGDNPAAASASEREMEKQREVISLWKRAVLAKKKTNGVC

SEQ ID NO: 42994 - protein, 344 aa, Geobacter sulfurreducens PCA
MAIRLPAEWEEQDGVLIAWPHPGSDWYPWLRLVEPVFAQIVREITRFETALVVAADGERTAALLEAVGARMERVAIVELPTNDTWARDFGPVTVERDGRPVLLDFGFNGWGLKFAADRDNLVTRRLRHLGIFGDIPAEMVGLVLEGGSIESDGRGTVLTTAECLLNPNRNPHLSRAEIEEALARYLGTERVLWLENGFLAGDDTDSHVDTLARLAPDDTIVYVRCDDATDEHYAALFMMEKELANLRTREGSPYRLIPLPWPRACFDHEGQRLPATYANFLVINGAVLVPVYDDPADEAALEAIGRAFPGREIVGIDCRPLIIQHGSLHCVTMQLPKGVLPCPN

SEQ ID NO: 42995 - protein, 371 aa, Neurospora crassa
MADLLLPEPFASIPREPLTFGPSPIQPLPRISQALGGKVNVFAKREDLNSGLAFGGNKTRKLDSLTNKSGPSAPRYLVPDAISRGCDTLVSIGGIQSNHTRQVAAAASKLGLHAALVQEHWVPDWTDPGYDKVGNIQLSRLMGADVRLEPLAGFGIEHKQTLAKLKDDLEKEGRKPYYIPAGASDHPLGGLGFARWAFEVVAQEEELGIHFDTVVVCAVTGSTMAGMVAGFKLVEMLERHSERLGKVNKRRVIGIDASAKVEQTRAQVLRIAKQTAAKIGLKEEDITESDIVLDDRYHAGVYGVPDEKTIEAIKFGARTEAFITDPVYEGKSLAGMMDMIKNGEIEAGSNVLYAHLGGQLALNAYSALGLE

SEQ ID NO: 42996 - protein, 191 aa, Prochlorococcus marinus str. MIT 9303
MAVVGATGDIGSAVCRWLSSRTGVAELLLVARQQKPLVELQAELGGGRILSLEEALPEADVVVWVASMPRTLEIDMESLRKPCLMIDGGYPKNLDTKFAGGGVHVLKGGIVEFCNDISWDVGWMAEMDKPERQMFACFAEAMLLEFENCHTNFSWGRNQISLEKMDFIGMASLRHGFSSLNLNHQLQASAA

SEQ ID NO: 42997 - protein, 148 aa, Vitis vinifera
MATDHEAPSKPQGSSAPRWDSRRKRSFPRRKRLPVIRLGGGPAAAKQRRGPSLVRLMRRIKLRWLKLRYFFTLKKLKQYYRSMVKDFVEAGATLETFQQRILMETSFAVPVLGVSFSTYPSAAGGAGAGRLCNVKHEKSMDKNIISYI

SEQ ID NO: 42998 - protein, 763 aa, Oryza sativa Indica Group
MTVTPQITVSDGRLAVRGRTVLTGVPENVTAAHASGAGLVDGAFVGADAGEAKSHHVFTFGTLRECRFMCLFRFKLWWMTQRMGSSGRDVPLETQFMLIEVPATAAGDGHDGGGDGEPVFVVMLPLLEGKFRAALQGNDDDELQICIESGDKAVQTEQGVNMVYIHAGTNPFDTITQAIKAVEKRMQTFHHRDKKKMPSFLDWFGWCTWDAFYTDVTADGVKQGLRSLANGGAPPRFLIIDDGWQQIGTEDDDTDEHPAVAVQEGAQFASRLTGIKENVKFQSKNGGAGEDTPGLRMLVEEVKGEHGIRQVYVWHAMAGYWGGVAPAPAMERYEAALAYPVQSPGVTANQPDIVMDSLSVLGLGLVHPRKVLDFYDELHAYLASCGVDGVKVDVQNIIETLGAGHGGRVALTRAYNRALEASVARSFPDNGCISCMCHNTDMLYSARQTAVVRASDDFYPRDPASHTIHVASVAYNTVFLGEFMQPDWDMFHSLHPAAEYHGAARAIGGCPIYVSDKPGNHNFDLLRKLVLPDGSVLRARLPGRPTRDCLFSDPARDGESLLKIWNLNKCGGVVGVFNCQGAGWCRVAKKTRVHDAAPGTLTGAVRADDVDAIAQVAGGDGGGWDGEAVVYAHRARELVRLPRGAALPVTLGALEYEVFHVCPVRAIAAAPGGAAVAFAPVGLLDMFNAGGAVEECAVDAAAAVALRVRGCGRFGAYFSRRPARCALDGADVGFTYDGDTGLVAVDLPVPEQEMYRWNLEIHV

SEQ ID NO: 42999 - protein, 557 aa, Zea mays
MAAPPTEDCGWLLYLSLAAKCGDPSRLLGLAAVFVGACVVTSLLHWACPGGPAWGRYWWTRRGGLGIVRAAIPGPRGLPVVGSMGLMTGLAHRKLAAAAAAAGGQGSSRRRRLMALSLGETRAVVTGDPDVARELLGSAAFADRPVKESAYGLLFHRAIGFAPHGAYWRALRRVASAHLFSPRQVAASSAQRAVIARQMVDAVTTAAPAPAPAVVVARRFLKRASLHNVMWSVFGRRYDLLLLAADGEELKALVDEGYDLLGQLNWSDHLPWLARFDLQRTRARCSALVPRVNRFVGNIIDEHRARLGLGDTGGVTDFTDVLLSLQGVDKLSDADMVAVLWEMIFRGTDTVAVLMEWVLARLVLHQDVQSKVQEELDRVVGPPGQAASVTESDTASLVYLQAVIKEVLRLHPPGPLLSWARLATSDARVGGYHVPAGTTAMVNMWAITHDPSVWAEPTEFRPERFVGASAGAGAGAGAEDVPMIMGSDLRLAPFGSGRRSCPGKSLALATVGFWVATLLHEFKWLPPCRGVDLSEVLRLSCEMAAPLEARVVPRHAV

SEQ ID NO: 43000 - protein, 558 aa, Coprinopsis cinerea okayama7#130
MSTLAAQLNGTLPLSADAWSGFLAQAKQHVSALDSRTFVLLLINAPVIAIVLNVLRQLVIPKKATDPPEVFHWIPIVGSAIQYGNDPLNFFFKCREKYGDVFTFVLLGRRVTVALGPKGNNFILGGKSIVFNAEDAYTHLTTPVFGKDVVYDVPNEKFMEQKRFVKVGISAENLRAYVGMIEEEVEGFLNNDPAFSVFQQNDVNEWGTFNAVKVMQEITILTASRTLQGREIRNGLTKEFAQIYNDLDGGFTPLNFLFPNLPLESYRKRDRAHKKMSDFYVDIIKRRRAGHSDETDHDMISALLEQRYRNGTALKDHEIAHIMIALLMAGQHTSSATGAWTLLHLANNPDVAEALYKEQLEHFTNPDGSFREMTYDELRALPILDSVIRETLRMHPPIHSIMRYVRDDVAVPGSLSAPSKDKTYIIPKGHYVLASPVVSQMDPRIWKNPETWDPTRWSDPEGVAAEAYKTYVDENGEKIDYGFGAVSKGTESPYQPFGAGKHRCIGEQFAYLQLGVLISTVIRKLELRVDIIPEHNYHTMIMMPKTPHTISYRRRKAD

SEQ ID NO: 43001 - protein, 783 aa, Cyanidioschyzon merolae
MFEALSGMGIWTNSAARAEGTRARTKSKQATKEDKKVAATVTRNKVHGPGEGTSRPLRERTNQQSENLQALDPVAAFQKFRGSVEPSANEGKPPERGAARLRPGATREPLGRNADRALAVKNAVHNTRTPQGAHAGIDHSDEQVSEAPDRDGRSDRQAASTLIGADGASSVEPASPFGHQDEEADSPGWLGAAKNLASTKDDQVSPLTRILQSQGASDVPPHVTEEKVRGLLENAPEESDRHQGPLAAPSPLQRRLMRMSPNMHIVSLENIARLYLELQADREYLIRESEKCYRARAATVQDLREVEAALAELLTKKHALEEKLESLGERDELSRLLLGNLDEKVTVIGSESVAFEERIRQLKGSGVAQAVERALKERRGRSSFLPSATSAPPELKTENPPQSSDEAAADMPTGARLGAVANESRHSSSGARGSERDSLTPRLCIRTLYGHTGQVLAADVHEEADIIVSASADRTLRIWDLSVCMSLDESFVDSKDPFGSRKDTLHGHEGWVHALDIHPTGTLLVSGSADRTARLWKLYDAEESASSPLTSLPHTRRHRCLHVFAGGHRGAIMAIQMDDARVITGSTDRTLCCWDLETRARVLRMEGHEAGITALQFWRYGLATASADGTVKMWDMRTGRCHRTLPVTQSGDGEATQASVTCLQFDESRLITGSSDECVRVWDLRTAKCRQVLETGSSINALRFDRDRLYVGCADQVVRAYDMHQLLEPAQGRPSMLRRAFFGHTGAVNCLALSEYGLVSGAADQTLRLWNTRWHEDWHMTPE

SEQ ID NO: 43002 - protein, 130 aa, Oryza sativa Indica Group
MATMGEELYESDVLWPDHQSPHDVVPPTATATATAPTPARRGQQQITRHCSTASSRPVDIPRAAQRWSGGDQGDDCGGGTMVPPHVMVSRRRSTEEGDQAFSLRTGTGRARRDLSHRRNSVLRMTGFIEG

SEQ ID NO: 43003 - protein, 270 aa, Triticum aestivum
  misc_feature (210)..(210): Xaa can be any naturally occurring amino acid
  misc_feature (242)..(242): Xaa can be any naturally occurring amino acid
AYLGDFQNKVYKKQFLPVRNSRDIVDPRVRELAAQGLGCGLLLLRPLSFALPHYADCHKFGYVLRGSGVAGVLPVATGDASPAARERVVRLEAGDVIATRTGEVSWWYNDSDGDAGDLSIVFMGDTERAVSPGDMSYFFLPGGNSVLGGFDAGLLAGAWPGVTKEQAAAVFRSQPAVLLTGLSKKLPGVRPREDDRKRLVVNAGQVAAGXLKTLTAADMAALGGLGDHVVLRPARARRRARXPWVLRQGAAPGVPGNPGPPAFPVAFFPR

SEQ ID NO: 43004 - protein, 537 aa, Spinacia oleracea
MRSEVPSSTSPSFLSPPFIHLPLLSLSSPTPLPHSSSSTFSLFSTMAASQIGLVGLAVMGQNLALNIAEKGFPISVYNRTASKVDETLDRAKSEGDLPLSGHYTPRDFVLSIERPRSIVILVKAGSPVDQTIASLASFMEPGDTIIDGGNEWYQNTERRLSDAHSNGLLYLGMGVSGGEEGARFGPSLMPGGDFQAYDNIQHILKKVAAQVDDGPCVTYIGEGGSGNFVKMVHNGIEYGDMQLISEAYDVLKNVGGLSNEELGQIFDEWNKSELESFLVEITADIFKVKDDLADGGLVDKILDKTGMKGTGKWTVQQAAELSVAAPTIAASLDCRYLSGLKEERENAAKILEAAGMKEEVNAIRGGVDKKRLIDDVRQALYASKICSYAQGMNLLRAKSAEMGWDLNLGELARIWKGGCIIRAVFLDSIKQAYQRNPNLASLVVDPEFAKEMVQRQAAWRRVVGLAVSAGISTPGMCASLAYFDTYRRARLPANLVQAQRDYFGAHTYERVDLPGSYHTEWSKLARKSDPNVAAALH

SEQ ID NO: 43005 - protein, 87 aa, Arabidopsis thaliana
  misc_feature (21)..(21): Xaa can be any naturally occurring amino acid
AVVTSPDQATRGAPFSGLKSXSAAFPVTRKASKDITSITSNRGRVSCMNVWAPIGKKKFETRSKLPDLTDVELAKGVDYLLRNMWIP

SEQ ID NO: 43006 - protein, 639 aa, Vibrio parahaemolyticus RIMD 2210633
MITFSDIQLLRGGKPLLDQASATIHPGDKVGLVGKNGCGKSTLFALLKDELSIDAGSFSQPQHWELAWVAQETPALERSALEYVIDGDREYRGLEQQLAVAEEKDNGTLVAEIHGKIETIGGYSIRARAAELLDGLGFSQEQMSWNLTQFSGGWRMRLNLAQALLCRSDLLLLDEPTNHLDLDAVMWLERWLQNYPGTLILISHDRDFLDPIVGRIIHIENQQLNEYTGNYSSFENQRAQKMMLQQAMFEKQQKQMSHMQSYIDRFRYKASKARQAQSRIKALERMEKVLPAQFDNPFSFEFRQPAALPNPIMMMDDVSAGYGDNLILEKIRLNLVPGSRIGLLGRNGAGKSTLIKLLSGELKAQGGDLTYSQGVKIGYFAQHQLETLHPEETPLQHMMQIAPDQTEQQLRDYLGSFGFQGDKALEKVAPFSGGEKARLVLALIVWQKPNLLLLDEPTNHLDLDMRQALTMALQTFEGAMVIVSHDRYLLRATTDDLYLVHDRQVAPFDGDLNDYYKWLTEQQKAERKEAQALQPVKDTANSAAAKKEQKRREAEFRKLTAPIRKTLTQLENKMDKLGVALAEAEEQLADNSLYEAENKAKLNEVLALQASSKSELEEVEMEWMSAQEELEQMELEFNQ

SEQ ID NO: 43007 - protein, 352 aa, Oryza sativa
MADSPSPRLDEEDAFGRDFNSSPSPTAPPARSGEKRPFGDLDDDDEDVFASKKGKTKVEESAPGAATGMILSLRESLQNCKDNLASCQVEREAAKSEVQKWHSAFQNIPAVPAGTNPDPVSVVSYLNNLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVET

SEQ ID NO: 43008 - protein, 177 aa, Vitis vinifera
MAEGDEDLPRDAKIVKSLLKSMGVDDYEPRVIHQFLELWYRYVVDVLTDAQVYSEHASKPAIDCDDVKLAIQSKVNFSFSQPPAREVLLELARNRNKIPLPKSIAGPGIPLPPEQDTLISPNYQLAIPKKRTAQAVEETEEDEEGADPSHASQEGRTDLPQHTPQRVSFPIGAKRPR

SEQ ID NO: 43009 - protein, 486 aa, Desulfovibrio desulfuricans G20
MMAKYDYDIIVIGGGAAGLTVTAGAAQLGVKVLLVESGHALGGDCLHYGCVPSKTLLRTAGVRHLMRHAARYGLPDAQLPPVDFAQVAQRISEVQAVIQQHDSVERFTALGAEVLFGAASFADDHTVEIRSDDSVVRATGAKIVIATGSGASVPPLEGLKESGYLTNREIFSLPVLPASLIVLGGGPVALEMAQAFRRLGTEVTVVQRSGQLLSNEDADMADIVRLRLESEGVRVLTRTEIQSIRRGADGVQVRLVHEGSEKLLSAAELLVALGRAPHVSGLTLENAGVVYSARGVGVDARMRTNVPHIYAAGDVTGRYLFTHAAGYEGGIIIANAVFRLPKKADYTNMPWCTFTDPELASVGLNERRAQAAGVDYTVRTELFSGNDRALAEGAPEGRIKMLLDPREKVLGVQICGAGAGEIINQWVAVQAGKVSLSRIAGAVYPYPTLGEISKRVAGNVMADKLFSGKVQSALCFLFRHQGKACS

SEQ ID NO: 43010 - protein, 289 aa, Vibrio parahaemolyticus RIMD 2210633
MSAKHPIIAVTGSSGAGTTTTSEAFRKMFNMMNIRPAWVEGDSFHRFTRPEMDIEIRKAREQGRHISYFGPQANDFPGLEEFFRKFGHDGTGSVRRYLHTFDEAVPYNQMPGTFTPWQDLPENSDVLFYEGLHGGVVDGDVNVAQHVDFLIGMVPIVNLEWIQKFVRDTRDRGHSREAVMDSIVRSMDDYLNYITPQFSRTHINFQRVPTVDTSNPLNAKGIPSLDESFVVIRLRGIKNVDFPYLLAMIDGSFMSRHNTIVVPGGKMSFAMELIVRPILQQLIETGKIG

SEQ ID NO: 43011 - protein, 263 aa, Vibrio parahaemolyticus RIMD 2210633
MTPDVLFESLWQDYIQRLCPSAAKVHQLLQEDEALINDHIALRTFNVEPLGIETLAKPFLAAGYKACGDYVFESKKLVAKHYEHPDPKQPKVFISELKVEECSPDLQDIVAKLASQVDAEKLSGSAFLHGGRLWDLSFADYQTLAKESEYASWLAAHGYGANHFTVSVNQLNQHDEVKQVNDHLRQAGFVINESGGEVKGSPEVLLEQSSTMADKVPVTFEEGLEIIPGGFYEFAKRYPMENGELYPGFVAASADKIFESTNG

SEQ ID NO: 43012 - protein, 1208 aa, Arabidopsis thaliana
MVRGLVNFTGLSTRLLNICVDSLCKFRKLEKAESLIIDGIRLGVDPDVVTYNTLISGYCRFVGIEEAYAVTRRMRDAGIRPDVATYNSLIAGAARRLMLDHVLYLFDEMLEWGIYPDLWSYNTLMCCYFKLGKHEEAFRVLYKDLQLAGLNPDNALELFKEMQSRFKPELMTYNILINGLCKSRRVGTAKWMLTELKKSGYTPNAVTYTTILKLYFKTRRIRRGLQLFLEMKREGYTYDGYAYFAVVSALIKTGRTKEAYEYMQELVRKDGNLDAVDDLLGEIERRGMKADEYTHTIIVNGLLRTGQTRRAEEHFVSMGEMGIGLNLVTCNCLVDGLCKAGHVDRAMRYFESMEVKDEYTYTSVVHNLCKDMRFVCASKLLLSCYNKGIKIPTSARRAVLSGLRMSGCYGEARKAKAEMKLTLVIMGRVRLVTPSSSESEDERVTIIREADMNREEVAEENKFEDENCEQESPENLNEPEEENISEEGDNVEPMQSQGMEENPEEEEKEGEEEEESEGNQNPNFFSIQPKTYQRTWIWRDMRKIRRRRRFVVLFVGGSSSSEKREGEKKSFREKKGEEGNKERERKFSNSPVKLELKSPAKSELKSPAAKSEKITSEVVGENRGSNDRSIRMGLSWDRLVVVVGTDSFCDCQKRGQSLSFRASVSSYRVALMLITCLCILAVDFTIFPRRYAKTETYGTSLMDLGVGSFVLANAVVSRQARDVSSGNWITGIKATAPLLLLGFIRLVTTSGVDYQVHVTEYGVHWNFFFTLAAISILTSFVNIPAKYCGLLGFAVLAGYQTWLLSGLNTYLLSDERGTDIISKNKEGVYSILGKILTWLLGHVPSWRSLRIVTILFDNYVERISRRTALGIFMLSSYIPLNKLSSLEEAIDQNLLATFLLSDPNPSAWNQYINPRDCTQGLCSTFCPQWCTYINFSPPPISYEQFLNDGVASNPNLSPLVIAIFGIFATAFLLAAYYTLVSKYCANDTTNEAASESGRSDIILDVNSPERGDQDDPFALESSTAGLDDTLIKKIGFFKLKKHQNGFKINGTDCSICLGEFNEDESLRLLPKCNHTFHVVCIDRWLKSHSNCPLCRAKIIVPTTQQPEHHVVVMNLDRFTSNVGSAEGNVVVDDHREEVSVSISSHHPSWFSAADIVLRISRDGEEEEGNYDLENGNREKLVDLKRSFSSGGLVLGTQGRTRRSLNICP

SEQ ID NO: 43013 - protein, 513 aa, Glycine max
MATLSSYDHFIFTALAFFISGLIFFLKQKSKSKKFNLPPGPPGWPIVGNLFQVARSGKPFFEYVNDVRLKYGSIFTLKMGTRTMIILTDAKLVHEAMIQKGATYATRPPENPTRTIFSENKFTVNAATYGPVWKSLRRNMVQNMLSSTRLKEFRSVRDNAMDKLINRLKDEAEKNNGVVWVLKDARFAVFCILVAMCFGLEMDEETVERIDQVMKSVLITLDPRIDDYLPILSPFFSKQRKKALEVRREQVEFLVPIIEQRRRAIQNPGSDHTATTFSYLDTLFDLKVEGKKSAPSDAELVSLCSEFLNGGTDTTATAVEWGIAQLIANPNVQTKLYEEIKRTVGEKKVDEKDVEKMPYLHAVVKELLRKHPPTHFVLTHAVTEPTTLGGYDIPIDANVEVYTPAIAEDPKNWLNPEKFDPERFISGGEEADITGVTGVKMMPFGVGRRICPGLAMATVHIHLMMARMVQEFEWGAYPPEKKMDFTGKWEFTVVMKESLRATIKPRGGEKVKL

SEQ ID NO: 43014 - protein, 473 aa, Ustilago maydis
MTVVHSNPASRQQSTEPGTINGRYDAKRRKLASSDLAKESTVEANMSTDLSDESAELTGVEAVEPTANGEDALQEAKKGAANESKSAVCASADADTAEFGQTKVKAEEAVDLEEAMQPAPKSAASAVEEGVAQKKERPAVIEERTGLIQFRVVTNDDDHESMILLTGLKNIFQRQLPKMPREYISRLVFDRNHQSVAIVKRGLQVVGGITYRPFKQRKFAEIVFCAITSTEQVKGYGSHLMNHVKDHVKASSPVMHFLTYADNYAIGYFKKQGFTKEISLDRSIWVGYIKDYEGGTLMQCSMVPRVKYLEVSDMLAAQKEAILAKIRSISRSHVVHKGLQAMHDRDRLIKLKGLIENPDGTVAKPERAAKRDQNHGEEDPTATFLVNPSEVPGLKESGWTPEMDELSRRPKRGPHFAVMRHILVELNGHGSAWPFVNPVNGDEVTDYYDVIKNPMDLSTMEAKLENNQYAQRR

SEQ ID NO: 43015 - protein, 403 aa, Xanthobacter autotrophicus Py2
MSEVANPSCVAIIVAAGRGTRAGGPLPKQYQAIGGEPVLRRTLRLFATHPQITAVLAVIHSDDSVRFADTARDLPKILAPAFGGATRQASVRAGLEALAAASCTSPDLVLVHDAARPYTSPDLIARAVAAAQAADAAIPVLPVTDTVKRVDAAGIVAETLDRAALRTVQTPQAFRFDALRAAHAAAAAAGVETLTDDAAVMEWAGQPVATFEGESTNVKLTTPEDMTRAAGASFADLGDVRTGTGFDVHAFGPGDHVMLGGVAVPHSAGLVGHSDADVGLHALTDALLGALCDGDIGAHFPPSDPQWKGASSDRFLAHAVEKVTARGGRIAHLDLTLICEAPKVGPHRDAIRAAISLITGVPLARVSVKATTTEKLGFTGRREGIAAMASATIRLPFADEAEG

SEQ ID NO: 43016 - protein, 319 aa, Oryza rufipogon
QLSPAIAQLQHLTKLSISMNSISGSLPPDLGSLKNLELLDIKMNTFNGSIPATLGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEALKGA

SEQ ID NO: 43017 - protein, 69 aa, Phaseolus vulgaris
KNYTYSLEVGGNGRKMIWQGVPRSIRDSHRKVRDSFDGLIIQRSMALFFSGGDKKELKLRVTGRIWKEQ

SEQ ID NO: 43018 - protein, 137 aa, Brassica napus
  misc_feature (131)..(131): Xaa can be any naturally occurring amino acid
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGSAAXKYYEAG

SEQ ID NO: 43019 - protein, 274 aa, Exiguobacterium sibiricum 255-15
MEFVTLNNGLVMPQLGYGVFKVPEQEVYEAVREALRVGYRSIDTAMIYENEAGVGRALKDSGIPREDIFLTTKVWNKDQGYERTLAAFETSLQKLGVDYVDLYLIHWPMPDEDLYMDTWRALEQLYRDGKAKAIGVSNFHIPHLTRVLEEGTVVPAVNQIELHPFLSQEAIRAFCQKNGIVVEAWSPLMKGRDALTDPVITDIAARHGKTPAQVVLRWHLQHDIIAIPKSVTPSRIQENLDIFDFVLSPDDMRQIDQLNRNERTGSNPDEMHKK

SEQ ID NO: 43020 - protein, 524 aa, Oryza sativa Japonica Group
MEKSSELWLLWAVFSASLVFLYLTIRRRSGAGAGGKPPLPPGPTPLPLIGNLLDLRGGVIHDKLAALARVYGPVMMIKLGLNDAVIISSRDAAREAFTRYDRHLAARAIPDTFRANGFHERSAVFLPSSDERWKALRGIQGTHIFTPRGLAAVRPVRERKVRDIIAYFRDHAGEELVIRQAIHTGVLNLVSSSFFSMDIAGMGSETARELREHVDEIMTVFAQPNVSDYFPFLRRLDLQGLRRSTKRRFDRIFSILDDIVERRLVDRGERGGEGGASSNSSKSKHQYDGGDFLDALLELMVTGKMERDDVTAMLFEAFVAGGDTVAFTLEWVMADLLRNPPVMAKLRAELDDVLGGKDQSAIEEHDAGRLPYLQAVLKESMRLHSVGPLLHHFAAEDGVVVGGYAVPRGATVLFNTRAIMRDPAAWERPEEFAPERFLAREGKAPVDFRGKEADFIPFGSGRRLCPGIPLAERVMPYILALMLREFEWRLPDGVSPEELDVSEKFMSVNVLAVPLKAVPVKVIN

SEQ ID NO: 43021 - protein, 526 aa, Coprinellus congregatus
MFKFAVLSQFVALALAAIGPQADLFIGNANVAPDGFQRSAALAGTDANSMVFPGPVIQAFKGETFNINVRNRLADPSMLRTTSIHWHGFFQAGSAWADGPVGVTQCPIAPNRDFLYTFATARQAGTFWYHSHHRSQYCDGLRGAMVVYDPEDPHRSLYDVDNEDTIITLADWYHPPGPVLETLNVATANSTLINGKGRYPTGPTTPLAVVGVTAGKRYRFRLVSISCSPFFTFSIDGHRMTIIEADGESTQPLVVDSIDIHAGQRYSFVLEANQPVANYWIRSNPNRGNRGFAGGLNTAILRYVGAPDADPVKPSDVDVPVPALPLVETNLHPLENPAAPGPPALGGEGVTAIELQIGLQGREWTVNGATFHEPNEPILLQTLNGKQMNELLPNQGSLFPIPRNSVIELTMPGGGAGSPHPMQLHGHMFSVIRSASNSTPNFVNPVRRDVVSLGSNTADRVTVRFVTDNAGPWIMHCHIDWHLVHGLSVVFVEDIEGISDSQRVAEDHPWRQLCPIYEQEKPDNEP

SEQ ID NO: 43022 - protein, 281 aa, Bacillus pumilus SAFR-032
MVKSLNDTVTLNNGVEMPWFGLGVFKVEDGNQVVDAVKAAIRNGYRSIDTAAVYKNETGVGKAIKESGVKREDLFITSKVWNTDQGYDKALAAFDASLNRLGLDYLDLYLIHWPGPNAETFKDTWRALEKLYKDGKVRAIGVSNFYIQHLEELLKDAEVVPAVNQVEFHPKLTLVELRQYAKEKGIQIEAWSPLMQGKLLDHDVLKDMAARYNKSVAQVILRWDLQSGVVTIPKSINEERIKQNADIFDFELSKEDMEKIDALNNNERVGSNPETMTVGFE

SEQ ID NO: 43023 - protein, 288 aa, Triticum aestivum
  misc_feature (205)..(205): Xaa can be any naturally occurring amino acid
LLAVLGTLPCTLLIPGLFFIPESPRWLAKMNLMDDFETSLQVLRGFETDITAEVNDIKRAVASANKKATVRFQELNQKKYRTPLLIGTGLLVLQNLCGINGILFYASRIFRAAGFTNSDLATCALGAIQVLATGVTTSLLDKAGRRMLLIISTAGTTLSLLAVSVAFFLKDNLPHDSHSDYTLSMVSLVALVAYIITFSFGMGAXIPWLIMSEILPVGIKSFAGSFATLANMLTSFGVTMTANLLLSWSAGGTFASYMVVSAFALVFVILWVPETKGRTLEEIQWSFR

SEQ ID NO: 43024 - protein, 90 aa, Zea mays
MAQPAFLSSLRSRLCSAPPPPPNHRLQPRRGYHVELGAREKALLEEDVALKRFKSYKNSVKQVSKIGNALTLAVVLACSYELAVLATSTK

SEQ ID NO: 43025 - protein, 671 aa, Bacillus pumilus SAFR-032
MEIFLAVLVLLALIASSNIINRFVPFIPVPLIQVGLGILVAAFPSGLHISLNPELFFVLFIAPLLFNDGKRTPRDELWKLRAPILLLALGLVFATVIVAGYTIHWMIPSIPLPAAFALAAILSPTDVVAVSALSSRVNMPKGIMRLLEGEGLMNDASGLVAFKFAIAATVTGAFSIAEASFSFVLIAAGGLLTGFILSFFIIRFRYFLRRLGMDDVTMHIILQILTPFVIYLAAEEIGVSGILAVVAGGVTHAIEQDRMEANLAKLQIASSNTWNIILFILNGLVFVILGLQIPDVSTVIFQDEAFNNMQVITYILIITLCLMILRFLWVWLFWAGKWSATKKQNVKKPKLRASMLMTFSGVRGAVTLAGAFSIPFTLADGSPFPERHLIIFLAAGVILCTLILASVLLPLLSEKKDKQIAVDLDTKIQHAKRKLLRSAIKTLREGMNEDNREVSLALINDYRMKLRNIQREPYQFGMRRQEKKIRLHGIKAEQMKLQQLIEEEKIDQQEAYELQERFHELEMLYSNSFKIRFSKVKFLRLLQWLQLWRPNQLVSSGILENEDSYKQIRKKTAEAAVDSIKQHMNDENKQTCHQVIGFYNQVIYRCEHGPSFFQQKDRSFDRKKKELNFQAVQTIRNEIQTLYENGEINRDIAHHLREYINDMEAVLLTNT

SEQ ID NO: 43026 - protein, 186 aa, Fragaria x ananassa
MAALLQSATATATLSHRSVCCSTTSSSPITYSSSSTTAAALSWAPNNKRNAAQHQLVGFVRRKKPFAVSSSLDTAATVGQVTEVDKDTFWPIVNAAGDKTIVLDMYTQWCGPCKIIAPKYQELSQKYDDVIFLKLDCNQENKPLAKELGMRVVPTFKILKHDKVVKEVRGAKFDDLVAAIETVRTS

SEQ ID NO: 43027 - protein, 403 aa, Vibrio parahaemolyticus RIMD 2210633
MTTEIKVERGLFDEVMVPCYNPMEMIPVRGKGSRIWDQDDNEYIDFAGGIAVSCLGHCHPVMVDALTEQGNKLWHLSNVMTNEPALRLAKKLTEVSFAERVFFANSGAEANEAALKLARRYAADVHGPEKSEIIAFKQGFHGRTFFTVTVGGQAAYSDGFGPKPGDVTHLPYNDIEALQAHMSDRTCAVMMEPLQGEGGIVPPTPEFAQAVRELCDKHNALLIFDEVQTGNGRTGHFYAYQGLGITPDILSTAKSLGGGFPIGAMLTTAKLAEHLKVGTHGSTYGGNPLACAVAEAVVNEVTKPEVLAGVLEREALFRAGLEKINAKYNLFSEVRGKGLLLGAALNEEWQGRARDVLVAAGKQGLLVLVAGANVVRFTPSLVITQQEIEEGLAKLDKAIATLV

SEQ ID NO: 43028 - protein, 377 aa, Silicibacter pomeroyi
MTTAAIIVAAGRGTRAGGGVPKQWRPLAGRRVADWTLDRFALRQITHVVLVLHPEDHDAWDEFATTPLILAPGGSDRAGSVRNGLAALDGLGITKVLIHDVARPCVSAATIGAVLDALDAHPGAAPGLAVTDALWTGAEGLVTGTRERDGLFAAQTPQGFRYDAIVAAHAAHPGGAADDVEVARAAELTVAIVPGDPDNLKITRAEDFARAERILRQDMDVRLGNGYDVHRFGPGDHVILCGIKVPHDRGLQGHSDADVGMHAVTDALYGALVEGDIGRHFPPSDPQWKGAASEIFLRHAVDLVRARGFAVSNIDCTLVCEYPKIGPHALEMQAEMARIMGLEASRVSVKATTSERLGFTGRSEGIAALATACLVKP

SEQ ID NO: 43029 - protein, 512 aa, Bradyrhizobium sp. ORS278
MDKATPKADIYQANLDRAAPLLAKLKDEGIGHFIDGEVVPAISGATFETRSPIDNAVLATVARGNAEDIDRAATSAALAFRSWREMAPAMRRKLLHRMADAIEDHADDIAVLECIDTGQAYRFMAKAAIRAAENFRFFADKCTEARDGLSTPSEEHWNISTRVPIGPVGVITPWNTPFMLSTWKIAPALAAGCTVVHKPAEWSPITAQWLAKLAKDAGIPDGVLNTVHGFGEEAGKALTEHPAIKAIGFVGESSTGSAIMAQGAPTLKRVHFELGGKNPVIVFDDADLDRALDAVVFMIYSLNGERCTSSSRLLVQQSIAETFTAKLAARVRALKVGHPLDPATEIGPLIHERHLAKVCSYADVARQDGAIIAVGGKPFAGPGGGHYVEPTLVTGASQTMRVAQEEVFGPFLTVIPFRDEADAVAIANDVQYGLTGYVWTGDMGRALRVADALEAGMIWLNSENVRHLPTPFGGMKASGIGRDGGDYSFDFYMETKHVSLARGTHKIQRLGV

SEQ ID NO: 43030 - protein, 516 aa, Desulfovibrio desulfuricans G20
MEKQNKVIIVDYGSQVTQLIARRIREAGVYSEIHPCIVTAAEVAAMSPSAVVLSGGPASVLGEDSPALDKGLLELGVPVLGICYGMQLLAHNLGGELSCSETREYGPADLKFCAGSPLWDGLKTDESSRVWMSHGDRVKKVPAGFTVTGSTETLEVAAMADDQRRIYAVQFHPEVHHSEDGVRMLHNFLFKIAGIKADWSMSSFCERVIKEVSEQVGPDDQVVCALSGGIDSTVVAVLLHKAIGHRLHCIFVDNGVLRLNEVDEVSGYLREHFDLNLTVVDARERFMKQFAGVEDPEKKRKIIGYTFIDVFDEESQKIPNVKYLAQGTLYPDVIESISHKGPSAVIKSHHNVGGLPETMKLKLIEPLRELFKDEVRKLAVELGLPDFIVWRHPFPGPGLAIRVIGEVTEERLDILRKADKIVQNELTASGWYRKVWQGFAVLLPLKTVGVMGDDRTYEHVIALRVVDSVDAMTADWVRLPSEVLERISSRIINEVKGVNRVVYDISSKPPSTIEWE

SEQ ID NO: 43031 - protein, 442 aa, Methylococcus capsulatus str. Bath
MKVTIFGSGYVGLVTGACLAEVGNDVVCIDIDAGKIERLERGEVPIYEPGLDTIIKRNMVAGRLQFTTDIDLGVSHGLFQFIAVGTPPDEDGSADLQYVLAVARSIGERMQEYRVVVNKSTVPVGTADKVRGAVSEVLARRGVAIEFDVVSNPEFLKEGAAIEDFMKPDRIVVGTDNPRTTELLRALYAPFNRSHDRMVCMDIRSAELTKYAANAMLATKISFMNELANLAERLGADIEKVRVGIGSDPRIGYHFIYPGCGYGGSCFPKDVKALERTARDAGYPAQLLQAVEAVNDRQKEKLFEKISAYFGGDLAGKTIAVWGLAFKPNTDDMREAPSRTLMEALWRAGAKVRAFDPVAQEEAHRIYGDRADLILCDSPESALRGADALAVVTEWNVFRSPDFDEIKQSLTRPAVFDGRNIYDPAQMKAKGFDYFAIGRGSV

SEQ ID NO: 43032 - protein, 274 aa, Chlamydia trachomatis D/UW-3/CX
MFTDKETHRKPFPTWAHLLHSEPSKQFVFGNWKMNKTLTEAQTFLKSFISSDILSNPQIITGIIPPFTLLSACQQAVSDSPIFLGAQTTHEADSGAFTGEISAPMLKDIGVDFVLIGHSERRHIFHEQNPVLAEKAAAAIHSGMIPVLCIGETLEEQESGATQDILLNQLTTGLSKLPEQASFILAYEPVWAIGTGKVAHPDLVQETHAFCRKTIASLFSKDIAERTPILYGGSVKADNARSLSLCPDVNGLLVGGASLSSENFLSIIQQIDIP

SEQ ID NO: 43033 - protein, 829 aa, Arabidopsis thaliana
MVVAFSLEIVCPFASLSHNFQLKRNKRERFRACEGDRKRESERETITAALKSTTTAALKSTTTAALKKKTLSVSSLLLLRLRDKASPDAMISLTPSLFLNKTVVPGCSTRLSLRQPRTIITPPASLRVFSSLGSNQDPTGSVLIETTATSSSSLETSAADIVPKSTVSGGVQDVYGEDAATEDMPITPWSLSVASGYTLLRDPHHNKGLAFSHRERDAHYLRGLLPPTVISQDLQVKKIMHTLRQYQVPLQKYMAMMDLQETNERLFYKLLIDHVEELLPVIYTPTVGEACQKYGSIFLRPQGLFISLKEKGKIHEVLRNWPEKNIQGMGIPVGKLSLYTALGGVRPSACLPVTIDVGTNNEKLLNDEFYIGLRQRRATGEEYSELMHEFMTAVKQNYGEKVVIQFEDFANHNAFDLLAKYGTTHLVFNDDIQGTASVVLAGLIAALRFVGGSLSDHRFLFLGAGEAGTGIAELIALEISKKSHIPLEEARKNIWLVDSKGLIVSSRKESIQHFKKPWAHDHEPIRELVDAVKAIKPTVLIGTSGVGQTFTQDVVETMAKLNEKPIILSLSNPTSQSECTAEEAYTWSQGRAIFASGSPFAPVEYEGKTFVPGQANNAYIFPGFGLGLIMSGTIRVHDDMLLAASEALAEELMEEHYEKGMIYPPFRNIRKISARIAAKVAAKAYELGLATRLPQPKELEQCAESSIAVNQIKDDSELKVVETSIDFIENVIKSEMTTTIRGRKGKWKLTKNNIIYHSPMVREKDICWEYAEKLDGNKVKCKFCSRVLNGGISRLKHHLSRLPSKGVNPCAKVRDDVTDRVRSILSAKA

SEQ ID NO: 43034 - protein, 640 aa, Chlamydia trachomatis D/UW-3/CX
MTYSLLPHIHSPQDLHALSLDKLPVLCDEIRNKIIESLSLTGGHLASNLGGVELTVALHYVFSSPDDQFIFDVGHQSYVHKLLTGRNTEAFSNIRHDNGLSGFTTPQESNHDIFFSGHAGNALSLALGLAKGSSNSSSHILPILGDAAFSCGLTLEALNNIPADLSKFIIVLNDNQMSISENVGNIPQGISHWMYPQKISKLSQKIHSWIQNLPSFLHKKKTLSHKVDIALKSLSHPLFEQFGLHYVGPIDGHNVKKLVQALQMIKDQPQPILFHVCTVKGNGLAEAERDPIRYHGVKAHFQNTSLKKTSGNVELQTPISFPQHAGNILCRLGKKYPQLQVVTPAMSLGSCLEDFRKQFPDRFTDVGIAEGHAVTFSAGIARSGTPVCCSIYSTFLHRAMDNVFHDVCMQELPVIFAIDRAGLAFHDGRSHHGIYDLGFLCSMPNMVICQPRNALVLERLFFSSLLWKSPCAIRYPNIPANEKASNSFFPFSPILPGEAEILCQGDDLLLIALGHMCNTALTVKEHLLDYGISTTVVDPIFIKPLDRKLLQSLLTHHSKVIILEEHSIHGGLGSEFLLFLNQHNIKADVLSLGVPDMFIPHGNPETILNLIGLTSDHITQRILSHFKFSTPIPIERFFKA

SEQ ID NO: 43035 - protein, 437 aa, Magnetospirillum magnetotacticum MS-1
GHRCPSHQIRLDDLVPVGLGGALAHPHSTNHFAEFTGRVCPAPCEEACTLNLENQPVAIKTIEQAIADRAWNMGWVKPEPSATRTGKRVAVIGSGPAGMAAAQQLARVGHDVHVYEREPKAGGLLRYGIPDFKMEKRHIDRRVKQMEAEGVVFHYKSHVGVNVPLEELTSQFDAVLFCGGAEEPRNPQLPGQELDGVHYAMPYLVQSNRRVGAEPMPGNGELPILAAGKNVVVIGGGDTASDCVGTAFRQGALSVTQLDIRPRPPEREDKLTVWPYWPTKMRTSSSQAEGAEREFQAATLRLEGNSKGRLTGVVCARVDEKRQPIEGSEFVLPADLVFMAIGFAGSVRKGLLDESGVAVGQAQQRRRRRSDLPDLQSEDLRRRECAGAVLVVWAIREGVRAARDREGLMARPCAGSPVYRTSGAIAKGMGFCGPRGG

SEQ ID NO: 43036 - protein, 485 aa, Chlamydia trachomatis D/UW-3/CX
MIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESGVTLYPSCVFPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETALGAHPVHAVKTMRSIIQETEKTFDYHAFFQLNDKNSALKVSPYLEAIGFSGIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDVLSPSLDEIVP

SEQ ID NO: 43037 - protein, 174 aa, Cicer arietinum
NISGGHLNPAVTFGLAIGGNITIITGLFYWIAQLLGSIVASLLLNYVTSKSVPTHGVAAGLSPIAGLVFEIIVTFGLVYTVYATAADPKKGSLGTIAPIAIGFIVGANILVAGPFSGGSMNPARSFGPAVVSGNFADNWIYWVGPLIGGGLAGLIYGDIFIGSYAPAPASETYP

SEQ ID NO: 43038 - protein, 319 aa, Oryza rufipogon
QLSPAIAQLQRLTKLSISMNSISGSLPPELGSLKNLELLDIKMNTFNGSIPATFGNLSCLLHFDASQNNLTGSIFPGITSLTNLLTLDLSSNSFVGTIPREIGQLESLELLILGKNDLTGSIPQEIGSLKQLKLLHLEECQFTGTIPWSISGLRSLTELDISDNNFDAELPSSMGELGNLTQLIAKNAGLSGNMPKELGNCKKLTVINLSFNALVGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEALKGA

SEQ ID NO: 43039 - protein, 281 aa, Brassica napus
MVMLIIKLCLLAMAPLCTAAANAQTQGIGFGYRGRNGPKQWGRLNPHYTECSVGKLQSPIDIQRTQTFYNSTLEPLHRDYYTTNATLVNHVCNVAMFFAEGAGDVVINNKNYTLLQMHWHTPSEHHLHGVQYAAELHMVHQAKDGSFAVVASLFKIGSEEPFLSQMKDKLVKLKEERLKGNQTAQVEVGKINTRHIERKTRKYFRYFGSLTTPPCSENVSWTILGKVRSMSKEQVELLRSPLDISYKKSARPCQPLNGRRVEMFHERAAKKKAGNKKKKPN

SEQ ID NO: 43040 - protein, 480 aa, Aspergillus nidulans FGSC A4
MAPRYDSVAVIGTGPSGLSTLKALVDEGTFSRIRVFERRDRVGGLWHYDPVPDVFPTPGAPHIRNEIPASLPAFTEPVAEDTTARTGIHDQLDSNVGSGTMSFTHTPFPEVNSAVSVRQLGRGNPSRPFRVVSGYLEDLARPYLDRISFNTTVERVEKIDNRKKWRITARQSGHFQRNKPAEYWWQEEFDAVVVASGHYNVPLIPEIDGLAEAHKALPGHFEHSKSFRSANDYVDKRVVLVGGNISSADLIADLHAVVRGNLYLSQRGGNEALANVFSLPGVEIRPTIGRVDAEKAGLTVTFTNGSTVADVDKLIFATGYRLVYPFLVPDPVTPSNRVAGLYQHIFKIGDPSFAMVGQVRGALSFRVYEYQAVAVARYFANHNAKPLPSPAEQDEWEVGRLKYKGPTTLFHEIKPDFKEYFEYLREFAGPPGPGTNGYELPVFGEDWPNLGFAILQLKDKYWQSIKAASQNGKEKVQAKL

SEQ ID NO: 43041 - protein, 354 aa, Bacillus anthracis str. Ames
MEKRIVCLAGDGVGPEVMESAKEVLHMVERLYGHHFHLQDEHFGGVAIDLTGQPLPQRTLAACLASDAVLLGAVGGPRWDGAKERPEKGLLALRKGLGVFANVRPVTVESATAHLSPLKKADEIDFVVVRELTGGIYFSYPKERTDEVATDTLTYHRHEIERIVSCAFQLASKRKKKVTSIDKANVLESSKLWRIVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTADIGGTETTTSFTKAVMQEMEEQALVGRGR

SEQ ID NO: 43042 - protein, 251 aa, Zea mays
  misc_feature (222)..(222): Xaa can be any naturally occurring amino acid
  misc_feature (231)..(231): Xaa can be any naturally occurring amino acid
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRXIIGVDLNAXRFEEARKFGCTEFVNPKDTA

SEQ ID NO: 43043 - protein, 791 aa, Pseudomonas syringae pv. tomato str. DC3000
MVEYVVSLDKLGVHDVEHVGGKNSSLGEMISNLAGAGVSVPGGFATTAQAYRDFLELSGLNDQIHAALDTLDVDDVNALARTGAQIRQWIMEAEFPEKLNAEIRTAFAELSAGNPNLAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKDTLAAGRPAILRRNLGSKAIKMIYGEEASAGKSVKVIDVEPADRARFCLTDAEVSELAKQAMIIEKHYKCPMDIEWAKDGDDGKLYIVQARPETVKSRASANVMERYLLKETGKVLVEGRAIGQRIGAGKVRIIKDVSEMDKVQPGDVLVSDMTDPDWEPVMKRASAIVTNRGGRTCHAAIIARELGIPAVVGCGNATHTLQDGQGVTVSCAEGDTGYIFEGELGFDIKTNSVDAMPDLPFKIMMNVGNPDRAFDFAQLPNAGVGLARLEFIINRMIGVHPKALLNYSVLPPEIKDSVDKRIAGYHDPVGFYVEKLVEGISTLAAAFTPKKVIVRLSDFKSNEYANLIGGKLYEPEEENPMLGFRGASRYISENFRDCFELECRALKRVREEMGLTNVEIMVPFVRTLGEASQVIDLLAANGLKRGENGLRIIMMCELPSNAILADEFLEYFDGFSIGSNDLTQLTLGLDRDSGVIAHLFDERNPAVKKLLSNAIQACNKAGKYIGICGQGPSDHPDLARWLMDQGIESVSLNPDSVLETWFFLAEAQAPV

SEQ ID NO: 43044 - protein, 386 aa, Salmonella typhimurium LT2
MTSENPLLALRDKISALDEELLALLAKRRALAIEVGQAKLLSHRPVRDIDRERALLDRLIHLGKAHHLDAHYITRLFQLIIEDSVLTQQALLQQHLNNTHPHSARIAFLGPKGSYSHLAARQYAARHFEQFIESGCAKFTDIFHQVETGQADYAVVPIENTSSGAINDVYDLLQHTSLSIVGEMTVTIDHCVLVSGATDLNTIETVYSHPQPFQQCSKFLSRYPHWKIDYTESTSAAMEKVAQANSPRVAALGSEAGGMLHGLQVLERIAANQTQNITRFLVLARKAINVSDQVPAKTTLLIATGQQAGALVEALLVLRNHNLIMTKLESRPIHGNPWEEMFYLDIQANLESQVMQSALKELGEITRSMKVLGCYPSENVVPVEPA

SEQ ID NO: 43045 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDINDLSKHTLDKIKHFFETYKDLEPNKWVKVKGFENKESAIKVLEKAIKAYQG

SEQ ID NO: 43046 - protein, 410 aa, Fragaria x ananassa
MVAAAVTPTSSQLLCSSSRSISQLSPLQQCVFGSKATTATTPNSSKRNRGVGSVGVKCMAVAAETEPKKKTAYQITTLTSWLLEQEQKGTIDAELTIVLSSISLACKQIASLVQRASISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLADIDDGNLDSAAQKCIVSVCQPGSNLLAAGYCMYSSSVIFVLTVGKGVYAFSLDPMYGEFVLTQEKVQIPKAGKIYSFNEGNYQLWDDKLKKYIDDLKDPGPSGKPYSARYIGSLVGDFHRTLLYGGIYGYPRDQKSKNGKLRLLYECAPMSFIVEQAGGKGSDGHSRVLDIQPTEIHQRVPLYIGSVDEVEKLEKYLA

SEQ ID NO: 43047 - protein, 385 aa, Geobacter sulfurreducens PCA
MNIHEYQAKEILSAYGIPVPRGRVALTSDQVERAAKEMGGRCVIKAQIYAGGRGKAGGVKLVHHPEQAQDYGKELFGRRLITPQTGPEGLKVRRILVEEAVEIAREFYLSITLDRSTSRYCLIASAEGGVDIEEVVQKSPDKIHVLTIDPYTGLRPFQARRIALALGLSGTLCEDCVELMLNLYKVVLEKDCSLVEINPLVVTRAGWLMAMDAKINFDDNAIFRHREYPDMMDYSQLDTLEINAGKYDLSYIKLSGNIGCMVNGAGLAMATLDVLKEFGGEPANFLDVGGGATREKVAEAFKIILEDADVKGVFVNIFGGIMRCDVIAQGIIEAASEVHCTLPIVVRMDGSKVAEGKQLLVESGLNVQTADSLGEGAERIVGMLG

SEQ ID NO: 43048 - protein, 372 aa, Fragaria x ananassa
MPSPLSIGLSSPILPPKHHPHSSRPSRQTTMATPSSSWSSTSLIEYVGQGGGHVGDDLVLLFHHIEYACKRIAALVASPYNSTLSKRMPLPSSSADRDAPKPLDILSNEIILSSLRNSGKVAVMASEEDDTPVWISDDGPYVVVTDPLDGSRNIEASIPTGTIFGIYKRLAELDHLPKEEKALLNSLQAGTRLVAAGYVLYSSATIFCTSFGSGTHAFTLDHSTGDFILTHPSLKIPPRGQIYSVNDARYFDWPEGLRKYIDTVRQGKGRYPKKYSARYICSLVADLHRTLLYGGVAMNPRDHLRLVYEANPLSFLVEQAGGKGSDGKNRILSIQPIKLHQRLPLFLGSLEDMDELESYGDVQQKVNPGYEV

SEQ ID NO: 43049 - protein, 341 aa, Fragaria x ananassa
MDHEADAYRTDLMTMTRFVLNEQSKHPESLGDFTILLSHIVLGCKFVCSAVNKAGLAKLIGLAGETNVQGEEQKKLDVLSNEVFVKALVSSGRTCILVSEEDEDAIFVEPSKRGKYCVVFDPLDGSSNIDCGVSIGTIFGIYALYDGGEPKLDDVLQPGKNMVAAGYCMYGSSCTFVLTTGSGVHGFTLDPSLGEFILTHPNIKIPKKGKSYSVNEGNAKNWDGPTAKYVEKCKFPTDGSPPKSLRYIGSMVADVYRTLLYGGIFLYPGDKKSPNGKLRVLYEVFPMSFLLEQAGGQAFTGKERALDLVPKKIHERSPIFLGSYDDVEEIKALYAAEEKKE

SEQ ID NO: 43050 - protein, 460 aa, Oryza sativa Japonica Group
MKTLSGHTNYAFCLAFSPHGNMLASGSFDETVRVWEVRSGRCLRVLPAHSEPVTSVDFNRDGAMIVSGSYDGLCRIWDSATGHCIKTLIDDESPPVSFAKFSPNGKFVLAATLDSKLNAKLKTISCPRIAMLEQLFHRRSQPVRSSASGAPPTSPAPSPSSRATGEGVSDLAFSPDGRLIASASDDRTVRIWDLGDGGGGGGGGEPRLMKTLSGHTNYAFCLAFSPHGNMLASGSFDETVRVWEVRSGRCLRVLPAHSEPVTSVDFNRDGAMIVSGSYDGLCRIWDSATGHCIKTLIDDESPPVSFAKFSPNGKFVLAATLDSKLYIRSFQQSYQPPSMLETILGTISQEIGVGLSARRLWNFSAGKFLKTYTGHVNTKYCIPAAFSITNGKYIVSGSEDKCVYIWDLQSRKILQKLEGHTDTVIAVSCHPNENMIASGGLDGDKTVKVWVQKEEDQMEV

SEQ ID NO: 43051 - protein, 430 aa, Glycine max
MEMERVFEFPHTHMDRRPRKRARLGWDIPEVPKAQVGLFCGQDVGTISSFAPSRGPSENTTSSLFVKPVARNGSPPWRDDDKDGHYMFALGENLTSRYKIHSKMGEGTFGQVLECWDRERKEMVAVKIVRGIKKYREAAMIEIEVLQQLGKHDKGGNRCVQIRNWFDYRNHICIVFEKLGPSLYDFLRKNNYRSFPIDLVREIGRQLLECIAFMHDLRMIHTDLKPENILLVSPEYVKVPDYKSSSRSPSSYFKRVPKSSAIKVIDFGSTTYEREDQNYIVSTRHYRAPEVILGLGWSYPCDIWSVGCILVELCTGGALFQTHENLEHLAMMERVLGPLPQPMLKRVDRHAEKYVRRGRLDWPEGATSRESIKAVMKLPRLQNLVMQHVDHSAGDLIHLLQGLLRYDPSERLTAKEALRHSFFMRDQFRR

SEQ ID NO: 43052 - protein, 460 aa, Pseudomonas aeruginosa
MNEENNKQVLKLQEFIEKHNIDTVRLGAVDIDGVWRGKQVGAEYFLNKAALDGTQISNILFGWDVADHLVDGLAFTGWDSGYPDIALIPDLLTLSLVPWQAKTASVLCDIQHLNGQSLNLSPRNLLRKATEKAEQLGYKCHAAYEFEFYLLNDSIGSIAADQWRSINPVEKSGHCYSMLHHSSSSDIIGEVRKYMRDAGIVLEATNSEHGPGQYEINIKYDDALKAADDAIFVKNGIKEIAAKHGMTATFMAKPNAEWSGSSGHVHISLSNLITGAPAFANPENPAALSEVGYNFLAGMVELAREFSAIYLPNINSYKRTAGASWAGGNSSWGFDNRTVSHRAITSAGAAARVENRIPGADTNPYLVIAASLLSGLYGIENKLKPKDPILGNAYKVSPELARPLAASLEEATNIFRESEMARVLFPKEFVEHYSQMKVWEIKQANGFVNNWELARYLDII

SEQ ID NO: 43053 - protein, 363 aa, Klebsiella pneumoniae subsp. pneumoniae MGH 78578
MSKNYHIAVLPGDGIGPEVMNQAMKVLEAVRQRFAMHITTSQYDVGGAAIDRQGTPLPQATVAGCEQADAILFGSVGGPKWEHLPPAEQPERGALLPLRKHFKLFSNLRPAKLYQGLEEFCPLRADIAANGFDILCVRELTGGIYFGQPKGREGSGQHEKAFDTEVYHRFEIERIARIAFESARKRRHKVTSIDKANVLQSSILWREIVSEIGKEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADEAATAIENAINRALEEGVRTGDLARGTAAVSTDEMGDIIARYVAEGV

SEQ ID NO: 43054 - protein, 426 aa, Methanosarcina mazei Go1
MEEKSDLKRDLSLVEITLTGIGNILGAGIYVLMGKAAGLAGNFVWFSFLFAGVTAALSAFSYMELSSMYPRAGAEYEFVKRAFGERTGLFAGLLVVYYVTITSSAVALGFGRYFSSLFGASSLVGVAGLFLFLSLVMVYGVKESARLAVFISLIELTGLLVIVYAGFPYIGTVNYFEAPDLAGLFEASALIFFAFLGFEDIVRLSQETKNAEKTTPRALIIAISVTVFLYVCVAIASVSVLDFRVLGLSEVPLADVAAVAFGNDAFVLLSWIALFSTMNTVLVVMLGGSRIVYGMADAGSFPRALARVHPRFRTPWAAIFGIAFISGFFVLLGDITTVANIANFMIFIVFFMVNVSLIKLRYAEPERHRPFRVPVSIGRLPLFPSLGALSAVFLFSQISLEIMAYGFFLIVIGFIIVLIRTRKIPP

SEQ ID NO: 43055 - protein, 763 aa, Oryza sativa
MTVTPQITVSDGRLAVRGRTVLTGVPENVTAAHASGAGLVDGAFVGADAGEAKSHHVFTFGTLRECRFMCLFRFKLWWMTQRMGSSGRDVPLETQFMLIEVPATAAGDGHDGGGDGEPVFVVMLPLLEGKFRAALQGNDDDELQICIESGDKAVQTEQGVNMVYIHAGTNPFDTITQAIKAVEKRMQTFHHRDKKKMPSFLDWFGWCTWDAFYTDVTADGVKQGLRSLANGGAPPRFLIIDDGWQQIGTEDDDTDEHPAVAVQEGAQFASRLTGIKENVKFQSKNGGAGEDTPGLRMLVEEVKGEHGVRQVYVWHAMAGYWGGVAPAPAMERYEAALAYPVQSPGVTANQPDIVMDSLSVLGLGLVHPRKVLDFYDELHAYLASCGVDGVKVDVQNIIETLGAGHGGRVALTRAYNRALEASVARSFPDNGCISCMCHNTDMLYSARQTAVVRASDDFYPLDPASHTIHVASVAYNTVFLGEFMQPDWDMFHSLHPAAEYHGAARAIGGCPIYVSDKPGNHNFDLLRKLVLPDGSVLRARLPGRPTRDCLFSDPARDGESLLKIWNLNNCGGVVGVFNCQGAGWCRVAKKTRVHDAAPGTLTGAVRADDVDAIAQVAGGDGGGWDGEAVVYAHRARELVRLPRGAALPVTLGALEYEVFHVCPVRAIAAAPGGAAVAFAPVGLLDMFNAGGAVEECAVDAAAAVALRVRGCGRFGAYFSRRPARCALDGADVGFTYDGDTGLVAVDLPVPEQEMYRWNLEIHV

SEQ ID NO: 43056 - protein, 366 aa, Oceanobacillus iheyensis HTE831
MALTAGIVGLPNVGKSTLFNAITQAGAEAANYPFATIDPNVGIVEVPDERLNKLTELVNPKKTVPTAFEFTDIAGIVKGASKGEGLGNQFLSHIRQVDAICQVVRCFEDENITHVSGKVDPIDDIEIINLELILADLDTVNKRYQRVEKLARQKDKDAVAEQAVLAIVKEGLENDKPVRALEFSEDQWKIVKGLHLLTSKPTLYVANVSEDEVADPDGNEYVQKVKAHAADENAEVIIVCARIEEEIAELEAEEKEEFLEDLGIAESGLDQLIKASYNLLGLATYFTAGEQEVRAWTFRKGIKAPQAAGIIHTDFERGFIRAETVSYTDLVEAENMTTARERGKVRLEGKEYIVKDGDVIHFRFNV

SEQ ID NO: 43057 - protein, 128 aa, Magnetospirillum magnetotacticum MS-1
MFFYPLYFNFVCPSEILAHDHRVKAFAERNTNVIAVSVDSHFTHLAWKNTPVDKGGLGNVQFPMVADLTKDIAKSYGVLLPGGVALRGTFVIDKNGVVQSAHVNNLPLGRNVDEALRLIDALQFHEEH

SEQ ID NO: 43058 - protein, 163 aa, Klebsiella pneumoniae subsp. pneumoniae MGH 78578
MRRILSVLLENESGALSRVIGLFSQRGYNIESLTVAPTDDPTLSRMTIQTVGDEKAIEQIEKQLHKLVDVLRVSELGQGAHVEREIMLVKVQASGYGREEVKRNTEIFRGQIIDVTPSIYTVQLAGTSDKLDAFLASLRDVARIVEVARSGVVGLSRGDKIMR

SEQ ID NO: 43059 - protein, 171 aa, Solanum tuberosum
MANPRVFFDLTIGGAPAGRVVMELFADTTPKTAENFRALCTGEKGVGKMGKPLHYKGSTFHRVIPGFMCQGGDFTAGNGTGGESIYGAKFKDENFVKKHTGTGILSMANAGPGTNGSQFFICTAKTEWLDGKHVVFGQVVEGLDVIKKAEAVGSSSGRCSKPVVVADCGQL

SEQ ID NO: 43060 - protein, 138 aa, Zea mays
MASVRLSSATMTSSLAHATMVAPFIGLKSSAAFPVTCKANTEITSITSNGGRINCMKVWPPVGKKKFETLSYLPGLTDVEIAQEIDYLIRNKWTPCIEFEWSTVLYTVSMETSLDTMMDDTGQCGTFLCSDALTHLRC

SEQ ID NO: 43061 - protein, 302 aa, Oryza sativa Japonica Group
MKMPGRLLAAGAAALLVAASVMVATLLTAPLPFLPSLMPCLPAVTAPSGSGYSPPGLAALADAAVRYATTPTVPQQSRAEISLSLAVLRRRAPLRLLVFGLGHDSPLWHALNPGGATVFLEEDPSWYSVVRGQSPFLRGHLVAYRTRLDHADRLLATYKDHPSCLPGGGGNGGGDVPRVRGNAECPLALHNLPAEVYEKEWDMVMIDAPKGYFASAPGRMAAVWTAAAMARGRRGEGDTDVFLHDVDRRVEKAYAEEFLCERFRVGATGRLWHFRIPPASRRGNGTAAAGGAGAGDGRRPFC

SEQ ID NO: 43062 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFENKESAIKVLEKAIKAYQG

SEQ ID NO: 43063 - protein, 229 aa, Triticum aestivum
EDINEKMRAILIDWLIEVHYKFELMDETLFLTVNIIDRYLEKQVVPRKKLQLVGVTAMLLACKYEEVSVPVVEDLVLISDRAYTKGQILEMEKSVLNTLEYNMSVPTPYVFMRRFLKAADSDKQLQLVSFFMLELCLVEYQMLKYCPSLLAAAAVYTAQCAINRCWQWTKICETHSRYTRDQLIECSKMMVQFHQKAAGGKLTGVHRKYSAFKFGCVAKVEPAHFLLGG

SEQ ID NO: 43064 - protein, 480 aa, Arabidopsis thaliana
MASISLFEASIAIFCFIILHFFLGNWPVLGMLPGLLLEFHRIYDFSVEVLENSDLTFPFKGPWFTGMDMLFTVDPTNIHHIMSSNFSNYTKGPDFKQVFDVFGDGILTTDDSELWKNLKKASLVMLNHQGFQKNGTVVDLQDVFKRFMFDTTLVTVTGSADPRSLSIEMPEVEFAKALDHVGEGIMHRHVRPRLLWKLQKCVGFGQEKKFSKADATLNQACAKYILEKREETRSQGFDYHSNGSESEDILTYHIKIDTTKYELLNPSDDKFLRDTILAFVLAGRDTTASALTWFFWLLLENPQVVTKIRQEINTSNGGQEKPSCEPMEYLNNLVYLHGALYEAMRLYPPVPFERMSPIKPDVLPSGHKVDSSMKILIFIYALGRMRAVWGEDASEFKPERWLSETTSLRHEPSFKFLAFNAGPRSCIGKQLAMTLMKIVVVEILQNYDIKVVKGQKKIEPAPGPILRMKHGLRVTLTKKC

SEQ ID NO: 43065 - protein, 276 aa, Bdellovibrio bacteriovorus HD100
MPQPQETEYVLHRRFDRMGRLVGDEVMKRLFNTHVMVIGLGGVGSWAAESLARSGVGKLTIIDFDEICITNANRQLHALQGLVGKKKAEVMGERLRKINPQNTVTVIPEFYNAENSEMMLSHKPDYIVDAIDNLTAKTHLLATCRERGIKVITSGGSAAKMDPLRIKKADLADTYVDPMAAQVRKMLRQKYDFPEKNFGIPCIFSDETPIQPVELKYDNGQGFKCVCPKGQNDLHSCDSRNVIWGTASYVTGAFGLAMASHIVNEIHAQVWAEAKA

SEQ ID NO: 43066 - protein, 315 aa, Aspergillus oryzae
MPLDGVKNIVLVLSGKGGVGKSSVTLQLALALTLQGKSVGILDIDLTGPSIPRLVGLEDAKITQAPGGWVPVTVHPASTNDGAQRGSLRCMSLGFLLRDRGDAVIWRGPKKTAMIRQFLSDVYWGETDYLLVDTPPGTSDEHIALAEQLLRPATTNPAAGSSTMPRLAGAVLVTTPQAVATSDVRKEVNFCVKTQIPMLGVIENMSGYTCPCCGEVTNLFSSGGGQVMAQETGVKFLGAVPVDIQFGELVEGKVVDESDDESEDGAQPEQKREQKQDEVVDERPLVERYKDCWSYSRFEGFADTLLSEIEGGVAY

SEQ ID NO: 43067 - protein, 79 aa, Glycine max
  misc_feature (39)..(39): Xaa can be any naturally occurring amino acid
  misc_feature (46)..(46): Xaa can be any naturally occurring amino acid
FTVQENMLWMLQCRSGKLTGKGAFKIAVHMVNQGLVDIXLASRCYXPHDFDSLLHPHCDDASTYKDEMIALGLDHSPVA

SEQ ID NO: 43068 - protein, 663 aa, Saccharomyces cerevisiae
MTLGNRRHGRNNEGSSNMNMNRNDLDDVSHYEMKEIQPKEKQIGSIEPENEVEYFEKTVEKTIENMEYEGEHHASYLRRFIDSFRRAEGSHANSPDSSNSNGTTPISTKDSSSQLDNELNRKSSYITVDGIKQSPQEQEQKQENLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIVGFFILAIIIDCGGAGTDSYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAAAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPIWIALYIFYKVWKKDWSLFIPADKVDLVSHRNIFDEELLKQEDEEYKERLRNGPYWKRVLDFWC

SEQ ID NO: 43069 - protein, 234 aa, Vitis vinifera
MEWRKCYLDVVLVPLGLFITMGYHVWLWHKVRTQPLSTFIGMNVNGRRFWVSAMMKDNDKKNILAVQTLRNAIMGSTLMATTSILLCCGLAAVISSTYSVKKPLNDTIYGAHGEFMMAVKYVTILLFFLFSFLCHSLSIRFVNQVNLLINTPQDPMNVATPEYVTEVLEKGFFLNTVGNRLFYTALPLLLWIFGPVLVFLCSITFVPLFYNLDIVPPSRKGKMNEIENSGFESV

SEQ ID NO: 43070 - protein, 572 aa, Cryptococcus neoformans var. neoformans JEC21
MVLGHFSPQTNTTVPPPPHPSAFVPLFQTNTSVVSGKPNAFSTMAGTPSSQLAWLSGLSTNFNEMSADQKFLRKTSIIATIGPKTNNVETLVQLADAGMNIVRMNFSHGSYEYHQSVIDNARAAAAKSPSGRPIAIALDTKGPEIRTGLMKDDTDVPISAGHEFWVTTDKAYAEAGTAEHIYIDYTNIVKVTAPGKLIYVDDGILSLQVISIQGEKIRVKSLNSGVLSSRKGVNLPKTAVDLPALSEKDKSDLAFGVKNGVDMIFASFIRSANDVKEIRKVLGPEGADIKIIVKIENEQGVMNFDEILRETDGVMVARGDLGIEIPASQVFMAQKMMIAKCNVAGKPVICATQMLESMTYNPRPTRAEVSDVANAVIDGADCIMLSGETAKGKYPIEAVKMMAETAFLAESSIAYPPLFDQLRALTPRPTETAETLALSAVAAAIEQDAGAIIVLSTSGVSARLISKYRPACPIICVTRNEQTARQLHLSRGVYPVWFPEPRGIPAEKWQIDVDNRIRYGLRMALGLGIIKPEATVMAVQGWKGGLGHTNTLRILSVPSDPADLDLHSIERD

SEQ ID NO: 43071 - protein, 323 aa, Listeria monocytogenes EGD-e
MKATAIAHTNVALIKYWGKRDEHLILPANSSLSFTVDKFYTKTTVEWDEKLTQDTFILNNEQKTDAKVARFIDKMREEFGISAKAKITSENHVPTAAGLASSASAFAALALAGSNAAGRKDTKEYISRLARFGSGSASRSVFGDFVIWEKGELADGSDSFAVPFTNKLCDKMSLVVAVVSDKEKKVSSRDGMRLTVETSPFFENWVSAAEIDLEEMKQAILDEDFIKVGEITERNGMKMHATTLGAEPPFTYFQPQSLEIMDAVRELRENGIPAYFTMDAGPNVKVICERANENIVAEKLSGLAKNVLICHAGKEASVVSDEK

SEQ ID NO: 43072 - protein, 367 aa, Brassica napus
  misc_feature (161)..(161): Xaa can be any naturally occurring amino acid
MITKFLTPSFRSLRFFKSPLYLSESLAFGVKYSSMAEVENNVNAAPVSDDELYGFKRQEMYTGTLAGSVAPYGRHVFLCYKSHESWLPRVETEGLPQRFAKSFKDRRADFAVKTNLTVCGGGESDGDVLIFPEMIRYKAIKDTDVDAFVEDVLVNGKPWTXSGVQEELSGSFVFVCAHGSRDKRCGVCGPALMEKFDQEIGSRGLSGKIFVMPCSHIGGHKYAGNLIVFSPDSAGNVSGHWYGYVTPDDVPAMLDQHIAKGEIIQNLSRGKMGLIPEGEEAVKEDKHKIPNGNGVQVEKKGFTGGCCQGANGVSCCQEQTPEPVKKEGSVKKNWFRSIEKEELLLGAAAVGAVATIAVAYSIYRKSG

SEQ ID NO: 43073 - protein, 359 aa, Triticum aestivum
  misc_feature (185)..(185): Xaa can be any naturally occurring amino acid
  misc_feature (212)..(212): Xaa can be any naturally occurring amino acid
MAVDLTPRQPAKAYGGDGGAYYEWSPAELPMLGVASIGAAKLSLAAGGMSLPSYSDSAKVAYVLQGKGTVGIVLPEATKEKVVAVKEGDALALPFGVVTWWHNTPESATELVVLFLGDTSKGHRPGQFTNFQLTGASGIFTGFSTEFVGRAWDLKEDDAAKLVSSQPASGIVKLTAGQKLPVPGXADRKDMALNCLEAKLDVDIPNGGRVVXVLNTANLPLVKEVGLGADLVRIDAHSMCSPGFSCDSAYQVTYIVRGSGRVQVVGPDGKRVLETRIEGGSLFIVPRFHVVSKIADASGMEWFSIITTPNPIFSHLAGKTSVWKAISPEVLEASFNTTPEMEKLFRSKRLDSEIFFAPN

SEQ ID NO: 43074 - protein, 134 aa, Brassica napus
MAPTITTTTTTMAPTYTSIPIPTGDVISRSIHNLTSAISRHRPWSELVFSGAFCFPERFSSLPLRSRSNFRYFSVNYSLIIGTCAAFSLVTASPVALVVVGTIIALWLLLHFFREDPLLLWGFQVGDRMVVCFL

SEQ ID NO: 43075 - protein, 187 aa, Zea mays
  misc_feature (15)..(15): Xaa can be any naturally occurring amino acid
  misc_feature (24)..(24): Xaa can be any naturally occurring amino acid
  misc_feature (38)..(38): Xaa can be any naturally occurring amino acid
  misc_feature (66)..(66): Xaa can be any naturally occurring amino acid
  misc_feature (126)..(126): Xaa can be any naturally occurring amino acid
  misc_feature (139)..(139): Xaa can be any naturally occurring amino acid
  misc_feature (158)..(158): Xaa can be any naturally occurring amino acid
RPLFAAYDGAMMARXDLVAELPIXTVILLLQRDIARTXTRTLEKPLIVATNMLERMIDHPTPTTGXGSDIALGVRERADAIMISEETAHATHPLKEHLLLHTEGLRTKSCIYNPTTSPIAIASGHXLHNDEFSPPQLAXSLHAMQLSWAHTLRTPSLXFTQTRSMPGLLKHYRSSTTLFSFTNEELV

SEQ ID NO: 43076 - protein, 385 aa, Brassica napus
SAARGADLFESIAAEIISAMILGGTMAKKCKIEDPSGFILFPLVVHSFDLVISSIGILSIKGTRDASVKSPVEDPMAVLQKGYSLTIILAVLTFGASTRWLLYTEQAPSAWFCFALPPMGPIITAYAFVWISKYYTDYKHEPVRTLALASSTGHGTNIIAGVSLGLESTALPVLVISVAIISAYWLGNTSGLVDENGIPTGGLFGTAVATMGMLSTAAYVLTMDMFGPIADNAGGIVEMSQQPESVREITDLLDAVGNTTKATTKGFAIGSAALASFLLFSAYMDEVSAFASVSFKEVDIAIPEVFVGGLLGSMLIFLFSAWACAAVGRTAQEVVNEVRRQFIERPGIMEYKEKPDYSRCVAIVASAALKEMIKPGALAIASPIV

SEQ ID NO: 43077 - protein, 201 aa, Zea mays
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKAQDFRQQGTKVRRKMWLQNMKIKLIVLGIIIALILIIILSVCHGFKCGSK

SEQ ID NO: 43078 - protein, 502 aa, Pseudomonas aeruginosa
MEKTTTSPVGATYWRSRAENVEFEGRCLIDGKLIEAHSGQTFDCVSPVDGRVLTKVAEGGEADINKAVAAARAAFQDRRWAGQSPIFRKRTLQAFAALIRLHRDELALLETLDMGKPISASRSVDVEAVANCFDWYAEAIDKLYEQIAPTAENDLALITREPLGVVGAIVPWNFPMLTTAWKVAPALATGNSVVLKPAEQSPLTAIRLGQLALEAGIPEGVFNVVPGFGRSAGKALACHMDVDGIFFTGSTATGRLLTEYAAKTNLKRVCLELGGKSPNIILASYGDIEKAAVTAAESMFNNQGEVCIAPSRLIVERSIHKQVVEIVAEIARQRQPGDPLDPATRIGALVNAQHADRVMGFIERAKTDGATLAAGGTRALTETGGSYVVPTVFDNVSNDMEIAREEIFGPVLSVIPVSSVDEAVSVANDSPYGLGAGVWTDSLSDAHKISRKLRAGVVYVNCYNDCDITTPFGGVKQSGNGRDKSLYALDEYTELKTTWIRL

SEQ ID NO: 43079 - protein, 447 aa, Bradyrhizobium sp. ORS278
MTTTSSAPHDPVLTDAQLNSFWMPFTPNRQFKTNPRLFVAAEGMHYIKPDGGRVLDAMAGLWCVNAGHGQRRIVEAIQAQAAKLDFVSSFQMSHPAAFELAARIVAIAPDGLDHVFFTNSGSESVDTALKIARAYHRARGQGERIRFISRARAYHGMGWGGLSVSGLSRHRRDFGPLLPEIDHLPHTHDPERAAFSRGQPHWGVHFADELEKLLALHDPATVAAVIVEPVTGSGGVLPPPVGYLERLREICDRNGILLIFDEVITGFGRVGAAFAANAFGVTPDIITCAKGMTNGAVPMGGVIVHRNIHDTMMSGPAGIELFHGYTYSAHPLACAAALATLDVYQEQDLFGRAERVAPLWENAVHALRQAPHVIDIRNIGLLAAIDLKPRDGAPGARGSECAARCFEDGVLIRGSSDTLVLSPPLIVSEEQIGAVFRTIRQALDALD

SEQ ID NO: 43080 - protein, 301 aa, Glycine max
  misc_feature (59)..(59): Xaa can be any naturally occurring amino acid
  misc_feature (70)..(70): Xaa can be any naturally occurring amino acid
MAGIAFGSFNDSVSFASIKAYIAEFISTLLFVFAGVGSAIAYAKLTSDAALDPTGLAAXAICHGFALFVXVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSERSNPARSFGPAVVSGDFHDNWIYWVGPLIGGGLAGLIYGNVFIRSDHAPLSSEF

SEQ ID NO: 43081 - protein, 243 aa, Physcomitrella patens subsp. patens
MPPLTGDGGARVARNVRQVRDLCTRCVGSEECEGDGEKAGSGDGYVGSSEKKFLTLPTILTLARVAAVPALLAVFYCEEKWATTAGATIFVVAAVTDWLDGYLARKMGSSSEFGAFLDPVADKLMVATTLVLLCTRPPVAALAKVGPWLLPVPAITIIGREITMSALREWAASQGGDVRQAVAVNSLGKWKTAAQMVALTLLLAGRDGGYVMSAGVSLLYVSAGLAVWSLVVYIRSMWNRLAQ

SEQ ID NO: 43082 - protein, 188 aa, Zea mays
MGSGSFLKVLVSNLDVLAGPIVSLAYPLYASVRAIETKSPIDDQQWLTYWVLYSFITLFELTFAAVIEWLPFWSYGKLFFNCWLVLPYFNGAAHVYEHFVRPMIVNQQVVNIWYLPKKEGSDKPDDVISAAQKYIEQNGSKAFETLVNKFKTTNARRSILEEVEAERRARAERELAARDVNPFFHPNY

SEQ ID NO: 43083 - protein, 381 aa, Physcomitrella patens subsp. patens
MSDDESLHVIGNTLQGTTNQILRSLPDHLAMECLSRVPLSTLRRVNKIWQNLIYDPYFQSLRAANGRSQLDWVYTLVQSQDLSFKWQAFDPLSGLWHDLPPTPRPMEFQLNNPGCIGVSYSVQCASSRTKLVMVAGLKAKQHDKNRMTMEPALSHPYIYDTQTCQWKLGYPFTVPRKWCVCGVTEEKLYIASGSGKDWDRELSKSAEVYNLKSDSWKKIQNLSTSKFSGEAMTAVSNDNKLYFVSGRGVFSKEGVVYNIATDSWSEMAPGLKKGWTGLCVTVNGKFYSLETPAGKLKVHVPEKDCWDVIMEDSRLGDVEVLVSTKDKIVGIEGPGKSVQPSDRSILRVIDIACETPRIFDIPMHQGKIVSVQVLAPMSRRL

SEQ ID NO: 43084 - protein, 335 aa, Methylococcus capsulatus str. Bath
MRHCISVLGAGSWGTALALLIARNGVPTLLWSHRREHAEAMAAERRNAHYLPHATFPDTLSVTPDLAEAAATASDAVLVAVPSHAFRATLDLCAPHLQPEAGLMWATKGLDRTRGCLLHETAREILGPDRALAVLSGPTFAAEVVAELPSAITVGASSEAFGAKIVSWLHNAYFRAYTTDDLIGAQLGGACKNVLAIAAGISDGLGFGANARAALITRGLAEMMRLSLALGARTETLMGLAGVGDLVLTATDNQSRNRRFGLGVGKGRPREEIHAEIGQEIEGILAARLIHELAGRKGVDMPITAQTYRVLYEGLPPEEAVRNLLLRDPKPEWDR

SEQ ID NO: 43085 - protein, 528 aa, Chlamydia trachomatis D/UW-3/CX
MSIVLDKIGKTLGTRVLFDDVSVVFNPGNRYGLTGPNGAGKSTLLKIITGLVEPSRGTISLPKKIGILRQNIDSFGDVIVLDCVIMGNSRLWEAMQRRDALYAEEFTDAIGMELGEIEEIIGEEDGYRAESEAEELLLGIGIPEEFFSQKMATIPLDLQFRVLLCQALFGHPEALLLDEPTNHLDLHSINWLGSFLKDYNGTVIVVSHDRHFLNTITTHIADIDYDTIIIYPGNYDAMVEMKTASREQEKADIKSKEKKIAQLREFVAKFGAGSRASQVQSRLREIKKLQPQELKKSNIQRPYIRFPVSDKASGKVVFSIEGISKTYDADPLFKPFSLEIYQGDKIGVIGNNGLGKTTLMKLLAGVEQPSQGQVKLGHNVAFSYFPQNHADILKDCGEETLFEWLRRRKTGITDQEVRSVLGKMLFGGDDAFKQVKALSGGETARLLMAGMMLENHNMLILDEANNHLDLESVSALAWAINDYPGTAIFVSHDRTLIDECATKLLIFNKGTISFFGGPMSEYLASQKK

SEQ ID NO: 43086 - protein, 355 aa, Methylococcus capsulatus str. Bath
MLARVHSECLTGDVFGSRRCDCGEQLELALRAIGEAECGVLLYLRQEGRGIGLVQKLRAYNLQDEGLDTVEANLRLGHQADERDYHVAARMLEDLGVKSVRLMTNNPKKIDELRRYGIPIAARVPIEAPSHPENVRYLRAKVEKMSHMLSFERKRPRFPFLDALCEHQSEGPVSPRRPFVTLSRVQSLDGGDAPTAGAEACELAGALRAVHEGTLTASGPALRLTVRGGRKAPVNFAMAGTPSAVGDVVAIPADARGDIDLAAVLATILGLGVRTLLVEGDAGLSGRFLDQALADYCVITVVPEFQGGSGSGSGGIGRGASRIAASGCQTLGRDLVVYGSLRSERSETPAVLPSD

SEQ ID NO: 43087 - protein, 529 aa, Cryptococcus neoformans var. neoformans JEC21
MAGTPSSQLAWLSGLSTNFNEMSADQKFLRKTSIIATIGPKTNNVETLVQLADAGMNIVRMNFSHGSYEYHQSVIDNARAAAAKSPSGRPIAIALDTKGPEIRTGLMKDDTDVPISAGHEFWVTTDKAYAEAGTAEHIYIDYTNIVKVTAPGKLIYVDDGILSLQVISIQGEKIRVKSLNSGVLSSRKGVNLPKTAVDLPALSEKDKSDLAFGVKNGVDMIFASFIRSANDVKEIRKVLGPEGADIKIIVKIENEQGVMNFDEILRETDGVMVARGDLGIEIPASQVFMAQKMMIAKCNVAGKPVICATQMLESMTYNPRPTRAEVSDVANAVIDGADCIMLSGETAKGKYPIEAVKMMAETAFLAESSIAYPPLFDQLRALTPRPTETAETLALSAVAAAIEQDAGAIIVLSTSGVSARLISKYRPACPIICVTRNEQTARQLHLSRGVYPVWFPEPRGIPAEKWQIDVDNRIRYGLRMALGLGIIKPEATVMAVQGWKGGLGHTNTLRILSVPSDPADLDLHSIERD

SEQ ID NO: 43088 - protein, 420 aa, delta proteobacterium MLMS-1
MFRQSELANGVRIVTEQAPSKVVAVGIWIEVGARDEHDLTSGFAHFVEHMLFKGTERRSAHQIAREFDVMGGMANAFTSTETTCVQATVLADRLPQVADLLADIVLAPAFVPAEVENEREVIGQEIAMVEDTPDDLIHDLFNRQLWGRHPLGNPVLGSARVIGALNSEHLRSFHRRHYIPQRILIAAAGQLEHEQFCQLWADSFGALSAPEGTRAGAGRQPPRFAEPERRVFDRGLEQLHLMLGTYGPAENDPDRYAFHLLNTILGGNMSSRLFQEIREKRGLAYAVFSYLNCHSDSGNFGLYLGVDPLAAEEAAGLAAREIRRLRREPVTAGELDEARDYARALIMLAEENMEARMSRLARNTLAFGRELPVTEILAKLDRVSVDDIMAVADQTFTRPLNGVALGPLDDELLDWDVLDA

SEQ ID NO: 43089 - protein, 324 aa, Glycine max
MSMMAAYLRVPTSTPITPQSPTATRTKCRNLKTSCSVNAAKIPMPPLNPKDPFLSKLASIAASSPDTLLNTPKNSDTPPFLDIFDSPKLMATPAQVERSVSYNEHRPRRPPPDLPSLLLHGRIVYIGMPLVPAVTELVVAELMYLQYMDPKEPIYIYINSTGTTRDDGETVGMETEGFAIYDAMMQLKNEIHTVAVGSAIGQACLLLSAGSPGKRFMMPHAKAMIQQPRIPSSGLMPASDVLIRAKEVIINRDNLVKLLAKHTGNSEETVANVMKRPYYMDATRAKEFGVIDRILWRGQEKVMADVASPDDWDKGAGIKIVDGF

SEQ ID NO: 43090 - protein, 558 aa, Coffea arabica
MECVREYQLRNVSSHCSISEMDDYDLSKLLDKPDKPRLNIERQRSFDERSLSELSIGLSRALDAYETAYSPGRSALDTPVSSARNSFEPHPMVADAWEALRRSLVFFRDQPVGTIAAYDHASEEVLNYDQVFVRDFVPSALAFLMNGEPEIVKNFLLKTLQLQGWEKRIDRFKLGEGAMPASFKVLHDPDRKTDTIVADFGESAIGRVAPVDSGFWWIILLRAYTKSTGDLSLAETPECQKGMRLILSLCLSEGFDTFPTLLCADGCSMIDRRMGIYGYPIEIQALFFMALRCALVMLRHDTEGKEFIERIVKRLHALSFHMRSYFWLDFQQLNDIYRYKTEEYSHTAVNKFNVIPDSILDWVFDFMPTRGGYFIGNVSPARMDMRWFALGNCVAILSCLATAEQAAAIMDLIEARWDELVGEMPMKICYPAIESHEWRIVTGCDPKNTRWSYHNGGSWPVLLWLLTAACIKTGRIQIARRAIDLAESLLLKDSWPEYYDGKLGRYIGKQARKFQTWSIAGYLVAKMMLEDPSHLGMISLEEDKQMKPLIKRSSSWTC

SEQ ID NO: 43091 - protein, 262 aa, Cryptococcus neoformans var. neoformans JEC21
MPIELDLDSILQFAIKLALDLVTEVDKAVEKFIVERIREAYPSHKFIGEESYEGQQITDEPTWIGDPIDGTTNFVHGFPMVATSIGLAHKGIPVVGVIYNPFLDQLWSAAKGRGAYLNQKRKLPITGSSKPLASLGQALIGVEYGMSRSPPALPRKLAAFEKLTAHTDVGGKMCHSLRSMGSAALNIVLVASGGLDIYWEVGAGICILEESGGRCFGAKTADLSGEVDAKLMEIVLLQKETSLDQQKKFIKEFYDCVEDFDP

SEQ ID NO: 43092 - protein, 531 aa, Exiguobacterium sibiricum 255-15
MGFFHRGTHEIGKAGIDLEAHLDQEMILVLDFGGQYNQLITRRIRDLGVYSELHSHKITAAEVKDIAPAGIIFSGGPRSVYAEDAYRCDPEIFDLGIPIFGICYGMQLMSQHFGGTVERAGHREYGKATLTLNDPSPMYANLPLEQTVWMSHSDLVTSVPNGFVVDGTNVSCPIASIKNEELKMYGVQYHPEVNHTMFGKELLKNFLFEVCQCTGDWSMENFIEIEIAKIKEEVGDKKVLCALSGGVDSSVVAALIHAAIGDQLTCMFVDHGLLRKGEAESVMKTFADHFHMNVIKIDAQDRFLNKLKGISDPEQKRKIIGNEFVYVFDEEASKLTDMDFLAQGTLYTDIIESGTDTAQTIKSHHNVGGLPEDMQFKLIEPINTLFKDEVRELGKELGLSDEIVWRQPFPGPGLGIRVLGEITDEKLEIVRESDFILRDEIKKAGLEREIWQYFTVLPPLRSVGVMGDERTYDYAVGIRAVTSIDGMTSDWARIPWDVLEKISVRIVNEVQNVNRVLYDVTSKPPSTIEWE

SEQ ID NO: 43093 - protein, 334 aa, Vibrio fischeri ES114
MAFNLRNRNFLKLLDFTPKEIAHLLELSAELKKAKYSGYEQPRLTGKNIALIFEKSSTRTRCAFEVAAFDQGAKVTYLGPSGSQIGHKESMKDTARVLGRMYDGIEYRGFGQTIVEELGQYAGVPVWNGLTDEFHPTQILADFLTMQEYANGKQLSQITFAYLGDARNNMGNSLMVGAAKMGMEIRLVAPKQFWPEEELVTQCQEIALQTGAKIVLTEEVTEGVKGCDFLYTDVWVSMGEAPEAWDERVALMTPYQINMDVIKATENPNVKFMHCLPAFHNDETTLGKEIAEKYGMNGLEVTEDVFESEYSIVFDEAENRMHTIKAVMVATLGS

SEQ ID NO: 43094 - protein, 438 aa, Aspergillus nidulans FGSC A4
MPISKIHARSVYDSRGNPTVEVDVVTETGLHRAIVPSGASTGQHEAHELRDGDKSKWLGKGVLTAVKNVNETIGPAVIKENLDVKEQSKIDEFLNKLDGTPNKSNLGANAILGVSLAIAKAGAAEKGVPLYAHISDLAGTKKPYVLPVPFQNVLNGGSHAGGRLAFQEFMIVPDTASSFSEGLRQGAEVYHKLKALAKKKYGQSAGNVGDEGGVAPDIQTAEEALDLITEAIEQAGYTGKIHIAMDVASSEFYKPEEKKYDLDFKNPDSDPSKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADISVGLRSGQIKTGAPARSERLAKLNQILRIEEELGENAVYAGQNFRKSVNL

SEQ ID NO: 43095 - protein, 336 aa, Triticum aestivum
MSTACVGINGFGRIGRIVLRQCLAKGLQVTAINDPFIDLDYMVYMFKYDSTHGRFKGDVATKNGMLVVNGKEIHVFQERDPKAIPWAKAGAEYVVESTGVFTTVEKAGAHLNGGAKKVVISAPSADAPMYVMGVNHDSYDPSQHVVSNASCTTNCLAPLAKVINDTFGIEQGLMTTVHAVTATQKTVDGPSGKLWRDGRGAAQNIIPASTGAAKAVGKVIPELNGKLTGMAFRVPVADVSVVDLTCTLKNEATYDQIKEAVKKASESAQYKGILGYTDEEVVSSDFIGDSHSSVFDAKAGIQLTKKFVKLVSWYDNEYGYSARVADLISYMHSREQ

SEQ ID NO: 43096 - protein, 453 aa, Agrobacterium tumefaciens str. C58
MKEYDAIFIGAGQAGPFLAARMAAMGRKVVLIERKFLGGTCVNAGCMPTKTLVASAKTAQVARRASEFGVRIDGEPVVDMKAVAARARKVTLDARSGLASWFDSLETMDVVYGHARFVGAKVVSVGGSLYTAPQIFINVGARPHIPDVPGLANVPYLTSTSVIALEELPKHLVVLGGSYIGLEFAQMYRRFDAQVTVIERGQYLASREDEDISQAIADILTRDGIKVLLSHKIVSVTTDSAEITVRTDQGDVRGSHVLVAVGRQPNTDDLGLDQAGVETDRRGYITVDERLQTNVEGIWALGDCNGRGAFTHTSYNDFEIAAANLLDGGDRKVSDRILGYGLYIDPPLGRVGMTERQAKEAGHRIKVATRPMNRVGRAVEKGETLGLMKLVTEADTDRVLGAAFLGVGGDEAVYGVLDAMNLGATTEKLRWAVPIHPTVGELVPTLISDLKET

SEQ ID NO: 43097 - protein, 244 aa, Streptomyces sp. CH7
IPGDTEVRELDLASLASVRAFAAKLTADHPSVDVLVNNAGLVHLGPRRTTADGFELHVGTNMLGPYALTGLLLDALTAGSGGRVVSLSSITHKNAHLDFGDLMSEHGYRASSAYGRSKLATTLFGLELDRRLRAAGLPVVSALAHPGLTRTNLTPRAWEHRGRFGRLIAAGGLLATQSVEQGALPQLRAATDPEVRGGQFFGPARLWETRGPVTEARLGEEAADPAVARRLWAVAEDLTGVRYP

SEQ ID NO: 43098 - protein, 346 aa, Pseudomonas aeruginosa
MRAAVYESFQGKITVQTMPDPEPSEFGAVIEVKASGICRSDWHGWVGHDTDIVLPHVPGHEFAGVVAAVGRGVTKWKVGDRVTMPFMGVCGSCGECSSGNEQMCDHQFQPGFKHWGSFAQYVAIDMADRNLVALPEAVAFSTAAGLGCRFATSFRAMAFQARIEPGQWVAVHGCGGVGLSAIMIAEALGANTIAIDIADDKLELARALGAARTINARQVDNVASAIADLTGGGAHVSVDALGSVVTCRNSIESLRKRGKHLQVGLLAGDQALPAIPMGRVVLKELQLLGSYGLQPHKYGDMLAMIEAGKLKPEKLIGRTVTLEEATTILPKMDSFQERGVAIIDRF

SEQ ID NO: 43099 - protein, 435 aa, Pseudomonas aeruginosa
MTALISSSNYPLPVVHHARGVFIYDDSGKSYIDGSGGAMTVSIGHGVPEVLSAMSRQAQQVCFTYRTHFTSTAAEELAKEIVALAPGDLNKVFFVNSGSEATELSMRTAIQYWQARGQPTKTKILGRAISYHGMTMGSLSMSGHAARRADYSNLLHQFAVAPPPYAYRFEVPNDGTFGASVWEKIIQEQGADTIAAVIVEPIVGAAGGALTPPIGYLKALREICDRHSILLISDEVITGMGRTGTWFGCEHDGIVPDIIATGKGMSSGYTPMGGVIIRDGIMEALGERVKLFGHTFSANPLSAATCLAVIRYMKEHAILDNVAARSVQLESGLKDLSVRYPWMADVRGRGLLWGFEFVKDATTKEPIDAARQPNLRFAQHCFDAGLIAYPAGIAPLNNSALLAPPLVISASETEELLSRLEIGLQRFGNEMGLPA

SEQ ID NO: 43100 - protein, 162 aa, Zea mays
  misc_feature (9)..(9): Xaa can be any naturally occurring amino acid
  misc_feature (105)..(105): Xaa can be any naturally occurring amino acid
  misc_feature (125)..(125): Xaa can be any naturally occurring amino acid
  misc_feature (146)..(146): Xaa can be any naturally occurring amino acid
MAVTIAWVXARQTFDSRGNPTAEGDVGLRDSGYARGAGPRGASTAIYEALKLRNAGSDYLAKGALKGASMGNNIMGPIFVANPPTEQVEIDDFMGHQVDGTSNEXGWWEQNFGPNDILAVSLAGXELGAMVKKIPLDQNIEGLGGXNETLGVPVPAFKVIKE

SEQ ID NO: 43101 - protein, 503 aa, Capsicum annuum
MAIGSLARRKASTILSSSRYVSKYSSYYFSRSFASGSDENDVVVIGGGPGGYVAAIKAAQLGLKTTCIEKRGTLGGTCLNVGCIPSKALLHSSHMFHEAQHSFAQHGVKFSSVEVDLPAMMSQKDKAVAGLTRGIEGLFKKNKVNYVKGYCKFLSPSEVSVDTIDGGNTVVKGKNIIIATGSDVKSLPGLTIDEKRIVSSTGALALTEVPKNLVVIGAGYIGLEMGSVWGRLGSQVTVVEFASDIVPTMDGEVRKQFQRSLEKQKMKFMLKTKVVSVDTAGDVLKLTLEPAAGGEQTTLEADVVLVSAGRVPFTSGLGLDKIGVETDKAGRILVNERFASNVTGVYAIGDVIPGPMLAHKAEEDGVACVEFIAGKEGHVDYDLVPGVCYTHPEVASVGKTEEQVKALGLDYRVGKFPFLANSRAKAIDDAEGIVKVLAEKETDKILGVHIMAPNAGELIHEAVLALHYGASSEDIARTCHAHPTMSEALKEAAMATYDKPIHI

SEQ ID NO: 43102 - protein, 148 aa, Brassica napus
  misc_feature (37)..(37): Xaa can be any naturally occurring amino acid
  misc_feature (110)..(110): Xaa can be any naturally occurring amino acid
IEDPFDQDDWEHYAKMTAECGDNVQIVGDDLLVTNPXRGVLKAIAEKSCNALLLKVNQIGSVTESIEAVKMSKRAGWGVMASHRSGETEDTFIADLSVGLSTGQIKTGAXPCRSERLAKYNQLLRIEEELGSEAVYAGANFRKPVEPY

SEQ ID NO: 43103 - protein, 172 aa, Vitis vinifera
MDHNETGCQAPPEAPILCINNCGFFGSAATMNMCSKCHKDLVLKQEQAKLAASSFESIVEGSSNCNAKESMVAIAKADIIQTGPSESMPVPTQAACASPSETNDRVKEGPNRCSSCRKRVGLTGFNCRCGNIFCAVHRYSDKHACPFDYRTAARDAIAKSNPVIKPEKLDKI

SEQ ID NO: 43104 - protein, 1310 aa, Arabidopsis thaliana
MFEKNGRTLLAKRKTQGTIKTRASKKIRKMEGTLERHSLLQFGQLSKISFENRPSSNVASSAFQGLLDSDSSELRNQLGSADSDANCGEKDFILSQDFFCTPDYITPDNQNLMSGLDISKDHSPCPRSPVKLNTVKSKRCRQESFTGNHSNSTWSSKHRVDEQENDDIDTDEVMGDKLQANQTERTGYVSQAAVALRCRAMPPPCLKNPYVLNQSETATDPFGHQRSKCASFLPVSTSGDGLSRYLTDFHEIRQIGAGHFSRVFKVLKRMDGCLYAVKHSTRKLYLDSERRKAMMEVQALAALGFHENIVGYYSSWFENEQLYIQLELCDHSLSALPKKSSLKVSEREILVIMHQIAKALHFVHEKGIAHLDVKPDNIYIKNGVCKLGDFGCATRLDKSLPVEEGDARYMPQEILNEDYEHLDKVDIFSLGVTVYELIKGSPLTESRNQSLNIKEGKLPLLPGHSLQLQQLLKTMMDRDPKRRPSARELLDHPMFDRIRGFKTPTSRFSELFQIPVKSDSSNTLGTFCLSLISSVFVTVSQYLLEGYVPFLYERFRNLVHLIMAKKDSVLEAGWSVMEAGVAKLQKILEEVPDEPPFDPVQRMQLYTTVHNLCTQKPPNDYSQQIYDRYGGVYVDYNKQTVLPAIREKHGEYMLRELVKRWANQKILVRWLSHFFEYLDRFYTRRGSHPTLSAVGFISFRDLVYQELQSKAKDAVLALIHKEREGEQIDRALLKNVIDVYCGNGMGELVKYEEDFESFLLEDSASYYSRNASRWNQENSCPDYMIKAEESLRLEKERVTNYLHSTTEPKLVAKVQNELLVVVAKQLIENEHSGCRALLRDDKMDDLARMYRLYHPIPQGLDPVADLFKQHITVEGSALIKQATEAATDKNYVLPQAASTSGLKVQDQVLIRQLIDLHDKFMVYVDECFQKHSLFHKALKEAFEVFCNKTVAGVSSAEILATYCDNILKTGGGIEKLENEDLELTLEKVVKLLVYISDKDLFAEFFRKKQARRLLFDRNGNDYHERSLLTKFKELLGAQFTSKMEGMLTDMTLAKEHQTNFVEFLSVNKTKKLGMDFTVTVLTTGFWPSYKTTDLNLPIEMVNCVEAFKAYYGTKTNSRRLSWIYSLGTCQLAGKFDKKTIEIVVTTYQAAVLLLFNNTERLSYTEILEQLNLGHEDLARLLHSLSCLKYKILIKEPMSRNISNTDTFEFNSKFTDKMRRIRVPLPPMDERKKIVEDVDKDRRYAIDAALVRIMKSRKVLGHQQLVSECVEHLSKMFKPDIKMIKKRIEDLISRDYLERDTDNPNTFKYLA

SEQ ID NO: 43105 - protein, 471 aa, Vitis vinifera
MEPRVGNKFRLGRKIGSGSFGEIYLGTNIQTNEEVAIKLENVKTKHPQLLYESKLYKILQGGTGIPNVKWFGVEGDYNVLVMDLLGPSLEDLFNFCSRKLSLKTVLMLADQMINRVEFVHSKSFLHRDIKPDNFLMGLGRRANQVYVIDFGLAKKYRDSSTHQHIPYRENKNLTGTARYASMNTHLGIEQSRRDDLESLGYVLMYFLRGSLPWQGLKAGTKKQKYEKISEKKVSTSIEALCRGYPTEFASYFHYCRSLRFDDKPDYAYLKRIFRDLFIREGFQFDYVFDWTILKYQQSQISGPPSRALGPGAGPSHGIPPAVANMDRQSGGEDGRPSGWSSADPSRRRTTVPALNLGSLKQKSPVANDSTMAKDSLSANVRASGSSRRGAVSSSRDAVIVGGESDPSRSRADASPGALRKISSGQRGSPVHSSEHKRISSGRNTSSNIKNFESTLKGIESLHFNNEERVQY

SEQ ID NO: 43106 - protein, 431 aa, Chlamydia trachomatis D/UW-3/CX
MLRQETAPLVCKFGGTSVGTAQSIRRVCEIIQEERPSFVVVSAVAGVTDWLEEFCRLPKGKRAALTEKIRERHESIAKELGIEVSLAIFWEILEHFEDVEELFSEDQARILAIGEDLSSTLICSYCCTYVLPLKRLEARQVILTDSQFLRAVPDLALMQTAWGELALQEDTIYLMQGFLGATSSGKTTVLGRGGSDFSASLIGELCKARELRIYTDVCGVHTADPKILKDTQLIDSLTFEEMQELASSGAKVLHQDMLKPCVRAKVPIFVTSTFNVTKEGTWICASLNESTEGPVIKALSLKSNQALWFVEYNSPLVRLEDVLGCVRSLGFVPGVVMAQSLGVYFTIDWEEYPQTITKALEAFGTVSCEGPLSLVALVGAKLASWSMSRVFEALHRTPVLCWSQTDTVINLIINKDFGVAVTELLHDCLFK

SEQ ID NO: 43107 - protein, 462 aa, Zea mays
MHSDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEKLLNDEFYIGLRQKRATGEEYDELIEEFMSAVKQFYGEKVLIQFEDFANHNAFDLLEKYSKSHLVFNDDIQGTASVVLAGLLAALKMVGGTLAEQTYLFLGAGEAGTGIAELIALEISKQTNAPIEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAAKAYELDTIPELGTHHVPFLV

SEQ ID NO: 43108 - protein, 242 aa, Neptuniibacter caesariensis
MAKVCVVTGGSAGIGEAVVKLLTSKGYRVFNLDLHSSATGEYIHCDVTSAEHIATAVARVLSEAGRIDVLVSNAGIHFSGNIETTSEEELDRVLSINVKGAYYLLQAVLPVMRQQLAGSIILMGSDQSIIAKRNSFAYNMSKAALASMAKTTALDYAEYGIRANAVCPGTIETPLYHQAIDRYCERSGSDKVEVHKEEAALQPIGRLGQPDEVAALVALLAGDDARFITGSLQVIDGGYTAQ

SEQ ID NO: 43109 - protein, 383 aa, Arabidopsis thaliana
METQIHQLEQEAYTAVLRAFKAQSDAISWEKESLITELRKELRVSDDEHRELLSRVNKDDTIQRIRDWRQGGASQITRHATIQPFDVLPSPTFSAARKKQKTFPSYNPSIGATGNRSFNNRLVSSGISGNESAEALIGRKVWTKWPEDNHFYEAIITQYNADEGRHALVYDIHAANETWEWVDLKEIPPEDIRWDGEESGVALNIGHGSASFRGNRRGQIHGGRGRGPRIHQPRRELVPPPTQQNGSGGRRTSSDDIELFNTDSLVKEVERVFDSTHPDPLELDKAKKMLKEHEQALIAAIARLADTSDGEMGNNNKSTLRLVCNLRIIYYLPLNFCVMMIISSIITNLILGKIIRELIHTCSACDFSVTCKQLNSLKYRSSS

SEQ ID NO: 43110 - protein, 623 aa, Oryza sativa
MGGGVEERKVVDLEDGDGEEGEDAAAVAAGSSRETRMLPRMPVRVLLAEGDDSTRHIICALLRKCGYRVAAASDGVKAWDILKEKSFNIDLVLTEVELPLMSGFLLLSTIMEHDACKNIPVIMMSSNDSVSMVFKCMLKGAADFLVKPIRKNELRNLWQHVWRKQLSSGVLDVQHTQQEDNLTERHEQKTGVTKAEHVTENVVHKNMECSEQESDAQISCTRSELEADSRHTNNLLEYKQPMGRHFSKPDHKNTEKNGGTKIHASNDGNLIPRREEDASPRRMTCSNDINCEKASRDMELVHIIDNQQKNNTHMEMDVARANSRGNDDKCFSIPAHQLELSLRRSDYSRLESQEKNERRTLNHSTSSPFSLYNCRTASSTINAGDAQACSTSATHIDLENKNGDSKTPSQDKRETNQPPIRVVPFPVPVGGLTFDGQPFWNGAPVASLFYPQSAPPIWNSKTSTWQDATTQAISLQQNGPKDTDTKQVENVEEQTARSHLSANRKHLRIEIPTDEPRHVSPTTGESGSSTVLDSARKTLSGSVCDSSSNHMIAPTESSNVVPENPDGLRHLSQREAALNKFRLKRKDRCFEKKVRYQSRKLLAEQRPRVKGQFVRQDHGVQGR

SEQ ID NO: 43111 - protein, 569 aa, Vitis vinifera
MAGALHLCGVTTPNCAVSSRRSLHCQPLWSQRVDFTLSVAGGSRLCRSVKDSSRKNVLRVCCSGGSIDVLEKSKTENQTTDGVTEQLTIAMKFGGSSVASAERMREVADLILSFPNERPVIVLSAMGKTTNKLLLAGEKAVSCGVSNASCIDELTFIKELHLRTADELGVDSSVISAHLEELEQLLKGIAMMKELTLRTKDYLVSFGECMSTRLFAAYMNKIGAKARQYDAFDIGFITTDDFTNADILEATYPAVAKRLLGDWISDPAIPIVTGFLGKGWRSCAVTTLGRGGSDLTATTLGKALGLREIQVWKDVDGVLTCDPNIYSHAKPVEYLTFDEAAELAYFGAQVLHPQSMRPAREGDIPVRVKNSYNRNAPGTLITRTRDMSKAVLTSIVLKRNVTMLDIVSTRMLGQFGFLAKVFSIFEELGISVDVVATSEVSISLTLDPSKLWSRELIQQASELDHVVEELEKIAVVNLLQHRSIISLIGNIQMSSLILEKAFHVLRTKGVNVQMISQGASKVNISLIVNDDQAEKCVRALHSAFFESLSEVDRECQSDNGSTSAFSNGH

SEQ ID NO: 43112 - protein, 182 aa, Vitis vinifera
MACTIDFRCLDEGLGGQKNKRKRSSETEINDVSMEIDNDNNDDASAPSAKRQAIPSSENPDKPKYDGIIAGKVSGRKWKQPRKQRSSASKVSLKGTTFEQRAKQKEIKKAYKERMTELKEEIRTNKVEKRKKREEREKRKQENILKSGTKLQIISNPKTLKKIAKSKQRKQLKLVPDSLVKK

SEQ ID NO: 43113 - protein, 463 aa, Bradyrhizobium sp. ORS278
MLKSNLDVSEMFVERQAQRSTMHSRHLNEQLVRVLKTIGYDVGFQKGQGQYLYDRDGARYLDLLSGFGVFAIGRNHPTLRDALKSVLDSDLPNLVQLDVSTLAGVLAERLLEYVPYLDKVFFANSGAETVEAAIKFARGATGRPGIVYCGHSYHGLTYGALSLTEDSNFRTGFEPLLPGCTAVPFNDLAALEQALASREIAAFIVEPIQGKGVNMPTDEFLPGAAALCKKYGSLFIADEIQTGMGRTGRFLAVEHWNVEPDMVLLSKALSGGHVPVGALLTRKAIFDKIFNRMDRAVVHGSTFAKNDLAMAAGIATLEVLKAEKLIEAAAKRGAELRLALTRMVPGYELLKEVRGKGLMIGVEFGPPKSLRLKASWTMLESANKGLFCQLITVPLFKDHKILTQVAGHGLHTIKLLPPLTITEDDCNWIERAFDDVIAQSHKVPGAIWSLGKTLVDNAIRKSA

SEQ ID NO: 43114 - protein, 395 aa, Spinacia oleracea
MASPAPRSLSSSSSSSSSSFCPSISPPPRSPSRASLPFSVKCNTVEPLKLVNGKPSVPILDEQSLPKFLHSKRLESSVNRSNTRLKLFSGLANPALAKEVAWYMGLELGKVKIKRFADGEIYVQLEESVRGCDVFIIQPTSPPANENLMELLIMIDACRRASAKNITAVIPYFGYARADRKTQGRESIAAKLVANLITEAGANRVLACDLHSGQSMGYFDIPVDHVYCQPVILDYLASKGIASSDLVVVSPDVGGVARARAFAKKLSDAPLAIVDKRRHAHNVAEVMNLIGDVKGKVAVMLDDMIDTAGTITKGAELLHEEGAREVYACCTHAVFSPPAIERLSSGCFQEVIITNTLPVAEKNFFRQLTVLSTANLLGETIWRVHDDSSVSSIFQ

SEQ ID NO: 43115 - protein, 146 aa, Triticum aestivum
  misc_feature (130)..(130): Xaa can be any naturally occurring amino acid
MAAAKSNQLSTLVPNMFAAGLLDDQFRQLEMLQDEGNPDFVAKVVMLFCEEGERIIGELAKQLDQPCVDYGKVDTFVDQLWGSSLYVGAQRVKNTCIQFHECCQEKSKVGCLKTLDSLRNDFYDLCSMFXHRLQLQQHVLNCRPEQ

SEQ ID NO: 43116 - protein, 472 aa, Burkholderia thailandensis E264
MKNDLPGLATLDALLRDQRAAYLRAPYPSWATRADHLRALRKMLLDNRDALAAAIDADFGHRAKEEVLMSEIWLAKEEIDEALKHGKRWIKPKSRAMNKWMRPARAKVMPQPLGVVGIVVPWNYPVLLAAGPLICALAAGNRAIIKMSELTPRTSQLFEELISKTFARDHVAVVNGDAEISAAFSGLPFDHLLFTGSTNVGRHVMRAAAENLTPVTLELGGKSPVIIGPRARFDAAVDAIITGKTLNAGQTCIAPDYVLVPRGKEAEFVARARARMAKLYPNLSTNPDYTSIISERHFARLQRLASDAQQAGAQLHPLTDAAPDPALRRLPPVLVTQAPDASQLMQEEIFGPLLPIVPYDTLDDAIAYVNARARPLALYLFDEDRSSVERVMRDTISGGVTVNDTLMHIACGTLPFGGVGASGMGAYHGYDGFVTFSKMKPVLTQPRLNTRAMIAPPYGKRFAAILKLMLKF

SEQ ID NO: 43117 - protein, 299 aa, Neptuniibacter caesariensis
MSTYFPTIEDYVGKTPLVRLQRIGQANGNIILCKLEGNNPAGSVKDRPALSMIQRAEDRGQIKPGDTLIEATSGNTGIALAMAAAIKGYKMKLIMPDNSSEERKASMTAYGAELIPVTKEEGMEGARDLALAMQERGEGIVLDQFSNMDNPEAHYCGTGPEIWEQTQGKVTHFVSSMGTTGTIMGTSRFLKEQNPDVQIVGLQPSEGAQIPGIRRWPQEYLPKIFDENRVDRILDINQDDAENTMRALAQEEGIFCGVSSGGSVAGALRLAEEVENAVIVCIICDRGDRYLSTGVFNQN

SEQ ID NO: 43118 - protein, 456 aa, Klebsiella pneumoniae subsp. pneumoniae MGH 78578
MEGQQHGDRLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWWPEIPTWASAAVFFIAINAINLTNVKVFGEMEFWFAIIKVVAVVAMILFGGWLLFSGNGGPQATVRNLWDQGGFLPHGFYGLVMMMAIIMFSFGGLELVGITAAEADNPEQSIPKATNQVIYRILIFYVGSLAVLLSLLPWTRVTADTSPFVLIFHELGDTLVANALNVVVLTAALSVYNSCVYCNSRMLFGLAQQGNAPKALLSVDKRGVPVNTILVSALVTALCVLINYLAPESAFGLLMALVVSALVINWAMISLAHMKFRRAKKQQGVVTRFPALFYPLGNWLCLLFMAAVLVIMLMTPGMAISVWLIPVWIAVLGVGYLFKEKAAATIKAQ

SEQ ID NO: 43119 - protein, 341 aa, Listeria monocytogenes EGD-e
MNKKRDFIDTKDFSKEEILFMIEIGRKMKESIKNGHYPQLLKHKTLGMIFEQSSTRTRVSFETAMTQLGGHAQYLAPGQIQLGGHESVGDTAKVLSRLVDILMARVERHQTVVELANTAAIPVINGMSDYNHPTQELGDAITMFEHLPKGKKIEDCKIVFVGDATQVCASTMFMATKLGMDFVQFGPKGFQLREEHLKVAEENCEVSGGSYLITEDVDIALKDADFIYTDVWYGLYEAELSEEERMKTFYPKYQVNKELISKAAPHVKFMHCLPATRGEEVTDEVLDAPYSVVIDEAENRLTAMRALLVYFMNPYVKEAGFAVAEKYDAELELLLRNGAGL

SEQ ID NO: 43120 - protein, 1309 aa, Schizosaccharomyces pombe
  misc_feature (132)..(132): Xaa can be any naturally occurring amino acid
  misc_feature (148)..(148): Xaa can be any naturally occurring amino acid
  misc_feature (391)..(391): Xaa can be any naturally occurring amino acid
  misc_feature (785)..(785): Xaa can be any naturally occurring amino acid
MKHIKNEREEVFLEDDQAQHSQAELLSSKDENLQPSIPLSPVAFELDFSGNFQFISDNSSELLDIPKDKIIGHSVAEVLGTDGYNAFMRAVNCLLKDDSHSYHVRFQHSINANHANQNYYTAKGDLPSDEKXTKPFDAIGILIRHPGXAIPAHTMWVVNPATNSLGSVSPLVTKLLDVIGFGASLLDKYLCDLRTSYHKHNSLDALPLPTPEFCQICEREIQSWFFELHSKFCLSTSTYESVVQAAQDSLLYFRSTLLEIQEGMQKDSSLVPVYKNEPLIVDADDYFFTDENKQTLSLCSFLSQVMYYLEVAIDITIPPVKIIVNFDKVDSLRVQSPRSEKATIELDNYNPSLENCSSAVIALWEDIKTAVDTKITGVLRLRNAIYYSERXRLEIDHHVQEIIDDVVSNLVTNHSSTSLGHLESKLAPSITFPDACDALEAEECITRPGSATNTPQSDRSLDINDLSRSSSYSRHLSHVSLSNPDFAIGSPMSQDSSNYSSPLHRRKASDSNFSDPRFDDLKYLSPNSSPRFVASDGPNRPASNGRSSLFSRGRASNLGDVGLRLPSPSPRIHTIVPNSAPEHPSINDYKILKPISKGAFGSVYLAQKRTTGDYFAIKILKKSNMIAKNQVINVRAERAILMSQGESPFVAKLYYTFQSKDYLYLVMEYLNGGDCGSLLKTMGVLDLDWIRTYIAETVLCLGDLHDRGIIHRDIKPENLLISQNGHLKLTDFGLSRVGYMKRHRRKQSSSIPVLDLRDRSSAISDLSLSTASSVLEAQSLITPEXPKRPSLNEKLLSLDGTSIRLAGQSFNYENSAEDSPTATNTPTSQVDESNIFRSTDSPRVQPFFENKDPSKRFIGTPDYIAPEVILGNPGIKASDWWSLGCVVFEFLFGYPPFNAETPDQVFQNILARRINWPAEVFTAESSVALDLIDRLLCMNPANRLGANGVEEIKAHPFFKSVNWDTILEEDPPFVPKPFSPEDTVYFDSRGLKGFDFSEYYNQPTVTEAQKLEEERPASSIPQHVSGNRKGRLRSNTISTPEFGSFTYRNLDFLNKANRNTIQKLRKEHMAVKSAKTSVDDTFSQYMSRFKAKLSTSQSVGPVKSSRRASMADYEASTTTRVQDITTDSIDSIDDFDSLKEGRMLSFFDNLALEDHKGVSSTMSASQSQSSMHTALPDVTEGTSSDEHTTIQKGRIDNLQAQSLTHKRNAISYPGLFQLDRLQMIIPKDEIELAEILKKIFPKLTLVLIDDPWSILKKLLQNEQFNVVFLHFGNDKVSSSRLMYSVRTSATINSRVPVCIHLRGRDLHSD

SEQ ID NO: 43121 - protein, 313 aa, Triticum aestivum
NPVIKQGQVATLQSLSGTGSLRLAAAFIQRYFPDAKVLISSPTWGNHKNIFNDARVPWSEYRYYDPRTVGLDFEGMIADIQAAPEGSFVLLHGCAHNPTGIDPTPEQWEKLADVIEEKKHMPFFDVAYQGFASGSLDEDASSVRLFVKRGLEVFVAQSYSKNLGLYAERIGAINVVCSAPDIADRVKSQLKRLARPMYSNPPIHGARIVANVVGDPTMFGEWKQEMEEMAGRIKNVRQKLYDSLSAKDQSGKDWSFILRQIGMFSYTGLNKAQSDNMTDKWHVYMTKDGRISLAGLSLAKCDYLADAIIDSFP

SEQ ID NO: 43122 - protein, 363 aa, Listeria monocytogenes EGD-e
MRTIDSSSKKDGFRMPGEFEKHAGCYIIWPERPDNWRLGAKPAQKAFVDVATAISHFEPVTVVASSSQYVNARYMLSDEIRVVEMDNDDAWVRDSGPTFVVNDSGDVRGVDWSFNSWGGLVDGLYFPWDKDDQVAQKICELERKDRYRLADFVLEGGSIHVDGEGTLVTTEECLLSEGRNPQLSKQQIEMVLKEYLNLEKIIWLKRGIYLDETNGHVDNIFNYVRPGVVALAWTDDETDPQYEISKECFDILSNETDAKGRKLEVHKINVPKPILITDEESKGVDAVEGTLPREEGDRLAASYINYYTANGGVIFPLFGDPNDELAREKLQQLYPNCEVVGVKAREILLGGGNIHCITQQVPR

SEQ ID NO: 43123 - protein, 379 aa, Exiguobacterium sibiricum 255-15
MRAVTYQGTKNVEVKDVQDPSIEKNDDIIVKITSTAICGSDLHIYQGNMPAKKDYVIGHEPMGIVEEVGPDVTKVKRGDRVVLPFNVACGHCFFCEHDMESQCDNSNGNPHVDTGGYFGFTEEFGGHPGGQAEYLKVPFGNFMPLVVPESCELEDEALLFLSDVIPTAYWSVINSGVKKGDTVVILGSGPVGLMTQKFAWMQGAKRVIAVDQQVYRLNHAKMTNRVETVNLQDHKETGQYLKELTQGGADVVIDCVGLDGKMSAVEKVEQKVGLQGGTLSAINIAKDAVRKFGTVQLTGVYAKKYNQFPLGDFFTRNITLKMGQAPVVHLMPELFQKIINQEFDPTDIITHKIDLEQAAHAYQTFNDHEDGCIKVILKP

SEQ ID NO: 43124 - protein, 306 aa, Vibrio fischeri ES114
MKPTKQILEDILDEVRPLIGQGKVADYIPALACVPNDKLGIAVFTNDGEMLTAGDATECFSIQSISKALSLTLAMELYQPEELWQRVGKEPSGQAFNSLIQLEMEQGVPRNPFINAGAIVISDMLYSRFSAPKHRLLEFVRKLSGNDHIIYDRVVANSEMDHSDRNASIAYLMRSFGNFDNEVMPVLKNYFHACALSMNCVDLARTFGYLANKGIQPGISEPIVTPMQCKQINALMATCGLYDGAGEFAYRVGMPGKSGVGGGIIAIVPGEMTIAVWSPELDPSGNSLAGTKALELLSERIGRSIF

SEQ ID NO: 43125 - protein, 369 aa, Listeria monocytogenes EGD-e
MGQLKGLPVEDGFRMPGEYEPHIGCFMIWPERPDNWRLGGKPAQQNYKEVAVAISNFEPVTMFVSPNQYKNARKELPDTIRVIEMSNDDAWIRDYGPSFLVDDKGDMRGVDWGFNAWGGLLDGLYFPWDKDNQIAKKVCELERIDYYSQKDFILEGCSIHVDGEGTLVTTEECLLSEGRNPNLTKIEIEQTLKKYFHAQKVIWLKHGFYLDETNGHVDNIFNFVAPGEVVLSWTDNKSDPQYEISRECYDILANKTDAKGRTFIIHKLHCPDPVLITQTESEGVEAINGTFPRQAGDRLAASYVNYYTANGAIIFPLFDDPKDKDAQELLEKLYPDRKIVGIKAREILLGGGNIHCITQHLPDKSTIRE

SEQ ID NO: 43126 - protein, 461 aa, Rhodococcus sp. RHA1
MRIAEHVVDLIGNTPLVKLSSVIGENHGTVAAKIEYLNPGGSSKDRIAVKMIDAAEASGELKPGGTIVEPTSGNTGIGLALVAQKRGYKCVFVCPDKVSEDKRNVLKAYGAEVVVCPTAVAPEHPDSYYSVSDRLARELPGGWKPNQYSNPGGPQSHYETTGPEIWADTDGKITHFVAGVGTGGTITGTGRYLKEVSGGKVKVIGADPEGSVYSGGTGRPYLVEGVGEDFWPSAYDPSIPDEIIAVSDADSFEMTRRLAREEGLLVGGSCGMAVVAALEVAKREGPDAVIVVLLPDGGRGYLSKIFNDKWMASYGFLRTPLDGKPDEKTVGDVLRGKSGELPDLVHTHPSETLRDAIEILREYGVSQMPVVGAEPPVMAGEVAGSVTERDLLSAVFEGRAHLADPVEKHMSKPFPLIGSGEPVSAATKALGDTDALMVVDDGKPAGVITRHDLLGFLSAGS

SEQ ID NO: 43127 - protein, 272 aa, Vibrio fischeri ES114
MEHRNIAFIGAGNMTRSIIAGLISSGYPKDKITATNPSTEKLDHLSQCYGIHTSTDNLQAAQQADVIVLAVKPQMMAMAAEPLQQIDFSNKLVISIAAGISAKRLNEMFASELNLVRVMPNTPALVGKGMSGLFAVEHINEQDKCFASDLLSAVGEVCWVAQESGINSVIAAAGSAPAYFFLFMEAMQAEAINQGFDEATARQLVQQAALGAAEMVVANPETQLSTLREQVTSKGGTTAEALRTFNEHQLQEIVAKAMQAAVSRAEEMESLF

SEQ ID NO: 43128 - protein, 280 aa, Triticum aestivum
SFAMDWLEISWDELELKERIGAGSFGTVYRADWHGSDVAVKVLTDQGVGEAQLKEFLREISIMKRVRHPNVVLFMGAVTKCPHLSIVTEYLPRGSLFRLISKASSGEILDLRRRLRMALHVAKGINYLHCLNPPIVHWDLKTPNMLVDKNWSVKVGDFGLSRFKATTFISSKSVAGTPEWMAPEFLRGEPSNEKCDVYSFGVILWELLTMQQPWGGLGPAQVVGAVAFQNRRLPIPKDTIPELAALVESCWADDPRQRPSFSSIVDTLKKLLKSMQGSGS

SEQ ID NO: 43129 - protein, 347 aa, Exiguobacterium sibiricum 255-15
MGVKVAVNGFGRIGRMVFRRLIAEGKSEVVAINASYPVETLAHLIKYDTVHGKFAYPVDIIDGALMVNGRQIQIVSERDPEQLPWGQLGIDIVVEATGKFNSKTGAEKHLTAGAKKVVITAPAKGDLRTIVMGVNDEMYDHETDAIVSNASCTTNCLAPVVQVIDRAFGIESGLVTTIHAFTNDQNNIDNPHKDLRRARACGSSIIPTSTGAAKAISLVLPHLEGKLNGLALRVPTPNVSLVDLVVEVSRDTTVAEVNEAFVKAADGALDGILGLTMEPLVSIDFNGEEKSTVVDGLSTMVMGGRQVKVLAWYDNEWGYSCRVVDLVHLVGAHIEATGNEAKQLELK

SEQ ID NO: 43130 - protein, 236 aa, Vibrio fischeri ES114
MTSIKQNINQITHQIENSIQKCGRNPDSVQLLAVSKTKPIELLEQAIEAGQRIFGENYVQEGIEKVQYFQKQHSTTSLEWHFIGPIQSNKTRPIAEHFDWVHSVERLKIAQRLNDQRPSELGELNVLIQVNTSSEESKSGTTAEEVMELAAAINKMPNLTLRGLMSIPANVSNYAEQLAAFKQLTSIQNQLRAQYPQIDTLSMGMSGDMDAAIEAGSTMVRIGTAIFGARDYKNKE

SEQ ID NO: 43131 - protein, 444 aa, Aspergillus nidulans FGSC A4
MASSSSNVVGVHYRVGKKIGEGSFGVIFEGTNLLNNQQVAIKFEPRKSDAPQLRDEYRTYKILVGCPGIPNVYYFGQEGLHNILVIDLLGPSLEDLFDHCNRRFSVKTVVMVAKQMLSRVQTIHEKNLIYRDIKPDNFLIGRPNSKAANVIHVVDFGMAKQYRDPKTKQHIPYRERKSLSGTARYMSINTHLGREQSRRDDLEALGHVFMYFLRGGLPWQGLKAATNKQKYEKIGEKKQTTAIKELCEGFPEEFTKYLSYVRNLGFEDTPDYDYLRDLLTQALKNAGEVEDGEYDWMKLNNGRGWEYKSYSSQQALQNSAMHTSARDLHGQQIRNSQRPGVTADRLNAAQPPPPSPAKPGAGKTREPQNVRGGIPPKRQSGGFDTTPAASTVAQFQNSNANISGHRIGSPATPAKNQPAPGGQQASNEPQPTLMQKVMKALCCG

SEQ ID NO: 43132 - protein, 410 aa, Rhodococcus sp. RHA1
MLARVEPVTLDQIRAARKLLDPVMRRTPVIASRALSERCGHVVSLKCENLQRTGSFKPRGAYNRIANLSVAERACGVVAASAGNHAQGVAWAATELGIPSTVFMPTGAPLPKLVATKAYGATVHLTGDTVDDALVAAKEFANETGAVLIHPFDHVDIVAGQGTVGLEILEQEPDVGTLVVPTGGGGLIAGIAAAVKATRPDVRIVGVQAEQAAAWPRSLAEGRPIPLETMSTMADGIAVGRPGDVPFAHVGSQVDAIVTVSEDALSRALLLCLERAKLIVEPAGAAAVAALISCSTDELGLTGKVCAVLSGGNIDPLLLTHVVNHGLRAAGRYLGVHVTIPDRPGGLVSLLGVISGNGASVVDVVHSRTGGALALDEVEVFLTVETRGPGHRQDLLDALRDAQYTIRLQE

SEQ ID NO: 43133 - protein, 70 aa, Glycine max
CNNVWKGGLQVDQSKGMLGTFAPQKEPYVHTLKEDITPSGVLARGVYSAKIKKKKKKKKKKKKKKKKKKK

SEQ ID NO: 43134 - protein, 884 aa, Aspergillus nidulans FGSC A4
MPPPRTRAEVQAQKQKEKLAQSYNELLKLIGKGSFGKVYLASHKLTNHSKVVLKSSDKEDTNLAREIHHHRQFLHPHIARLYEVIVTEKLVWLVLEYCPGDELYNYLLRNGPLPIDKVKKIFTQLVGAVSYVHSKQCVHRDLKLENILLDKHENVKLCDFGFTREYEGKASYLQTFCGTVCYSAPEMLKAEKYAGEKVDVWSLGIILYALIAGELPYDDDDDQVTKARILNEEPKFNDKFPDDAKALINLLLSKRPLLRPSLDEVLAHPFLSEYAAEQLAILKLPRPPPFSTSLEKTTLHRMKSAGINIDDVVDSVMAQRCDALAGWWALLIEKEQRKEAKRERKRRERDAEAKNIRRLSAASSRLEKISAALVEVDEEGYSTAPLHERGRRDRRSLPSQLAVPELPMLPEPPLQSHNLTTPPPPPPVDKDSIRSHSSTRRLPPAPPPKDRRRSRPSTLHASASQPELAQHGGIFRRRTGRRQYPIISQLASLKHWFVESAKRAKSPHPKSAGGTSRKFLSEKLSPAKGQEGTKKTTLAVSTTGQPNDLATPTQIKRASNASSLAPSSASYPHRRHSYPRQPRPLSTGASHRNSLSPSPLTPRGSYRRSSVGLRGRKSTSSSVSSIRSIHHGHSRSKASSISSNSIGSATTPTARVAKSPHTSVKVLPTTPGASARFPTNIRLVRNPGHGLRDLDEPDGVPTSSYNEAAPAPLLYSPSSSLVFARRKRSTFKGPMLHVANLVASGGMASECPNGDVRMDVPAIKAARPTTRKSQIIEEEEDPEDEYEEVDAFTGTEEEPASPTGVVSSELSDSDHAHSRGQPVLEPAPDLDSSPLRPPRSSSLRTTSRDPVLGSDDSDQAALNASPKSVVSGKRSLYSGVDAAK

SEQ ID NO: 43135 - protein, 974 aa, Neurospora crassa
MAGLKIGWGSVLLVLALVLVVLPDKAAAFGAGNIPSIAQVEGHNWRHGDIEDVLKTLAFINGKKWTTMMVGRTYFGNWLRDYSQAIDVGSLKGVNAATIRIIVWVLSFLAHGYATEEFEVTEERLGVYRPEEHIDNPLGYADGKDAREYDPRLRGPVHPAELEIDPNTGMKNYIANEELAHHQGWNTTSAGYIRFSLQRCIHYGRLYTSGSHGRGKESDLCEALRCLGQALHTLEDFPAHSNYCELVLIDMEERRGGHSPVFPHVGTATKLKLENRQFRRVRPGEGYDSGAKYAWPLVTGTFGGVDFLHSVLGEANDHFTQSEVDEMNDALLTAEQLTKGSGGGSSRDRGLSLFGLNLGGSSSNDGDFISLVSKLPGVGDGYASTARSLKAASEAQEQENSRSAGNVNVVPGMSPNFDPVKTAAKIYPILEFRDKIVRSINNMIEKIPGLESLLEKISETLTAFILGLLAPFLRPIINQVTQVLKEGSSGLIATSAKQQLEPWNNPDCDNPTHSMLSKDHFTNILNSCAGRVAANIVQYVVPRVVYAWENPGVPDSEVIADVLQVFHHPANYKQEIEIQRTMYDTVVQWSRETHHNYKKLLDSESVKEGHNHVLNGQPMNRGPGGGHTSCGADGGHGKVAGSLWSKIQSRDLDTSAPSGGVGGGRPSSSTDHKYGYSASSSHHEVPTHGEAASYFSSADPRHASPPTDRYYGSRPSSSGYGSSVHGSGRPSPAPGSFGYHHGGHQAYECSSSSYPSQPSYAGSSGPSYGGSSGPSYGGYSQPSYGSQPSYSSQPSYGAHPSQPPYGSQPHYGGPSHGSYSGGRPPSPPRPSGYGGGYAGYSAGPPPSHGGYGGYGGYGGGPSGGAPYPHGGPVSGGGSAPYPHGGRADAYERNYDQHYESDERLGGKDGRKKKRSHGSRSSSEERDGRGYPGQGSRGSGHHGGGGGYGGGYGGGYGGGGGYGGGYGGRDEHRRY

SEQ ID NO: 43136 - protein, 383 aa, Fragaria x ananassa
MVTAASIGSRVESLASSGISTIPKEYVRPEEELVNIGDIFEDEKSTEGPQVPTIDLKEIDSDDIKVREKCREDLKEAAVEWGVMHLINHGISDELMERVKKAGKAFFDLPIEQKEKYANDQASGKIQGYGSKLANNASGQLEWEDYFFHCVYPEDKRDLSIWPQTPSDYIVATSEYAKELRGLATKILSILSLGLGLEEGRLEKEVGGLEELLLQMKINYYPKCPQPELALGVEAHTDISALTFILHNMVPGLQLFYGGKWVTAKCVPNSIVMHIGDTLEILSNGKYKSILHRGLVNKEKVRISWAVFCEPPKEKIILKPLPETVSEEEPAIFPPRTFFEHIQHKLFRQSQEALVSTKESAALKSTTESALKSTKEAALISTN

SEQ ID NO: 43137 - protein, 189 aa, Zea mays
  misc_feature (22)..(22): Xaa can be any naturally occurring amino acid
  misc_feature (78)..(78): Xaa can be any naturally occurring amino acid
  misc_feature (100)..(100): Xaa can be any naturally occurring amino acid
  misc_feature (112)..(112): Xaa can be any naturally occurring amino acid
  misc_feature (136)..(136): Xaa can be any naturally occurring amino acid
  misc_feature (170)..(170): Xaa can be any naturally occurring amino acid
  misc_feature (184)..(184): Xaa can be any naturally occurring amino acid
TLSLPARILNRSTAHLHSILSXNNSTVVDEFFRTLVDSVPHLTYHIHITSARMLLHIALAYPVNIANAKCEVWELGIXHNVYVDLLLGEFSHYYTRLNHXGISRELQLLLLXYGIHSISEGLYEGLSIANMCSDDXRALMTLDLQELISVLQHIVLSNETSKLLTVDTFXIKAYYLPETEYVQXARSHP

SEQ ID NO: 43138 - protein, 383 aa, Fragaria x ananassa
MVTAASIGSRVESLASSGISTIPKEYVRPKEELVNIGDIFEDEKSTEGPQVPTIDLKEIDSNDIKVREKCREDLKEAAVEWGVMHLINHGISDELMERVKKAGKAFFDLPIEQKEKYANDQASGKIQGYGSKLANNASGQLEWEDYFFHCVYPEDKRDLSIWPQTPSDYIVATSEYAKELRGLATKILSILSLGLGLEEGRLEKEVGGLEELLLQMKINYYPKCPQPELALGVEAHTDISALTFILHNMVPGLQLFYGGKWVTAKCVPNSIVMHIGDTLEILSNGKYKSILHRGLVNKEKVRISWAVFCEPPKEKIILKPLPETVSEEEPAMFPPRTFFEHIQHKLFRQSQEALVSTKESAALKSTTESALKSTKEAALISTN

SEQ ID NO: 43139 - protein, 517 aa, Staphylococcus aureus subsp. aureus MRSA252
MSEVKKVVKHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAVLAGSDLLGTNHALSLAFSGFATSAVALVAAALFLAAAMQETNLHKRLALLVLSIVGNKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSIALYFIMIKVMPPEINTIEGGKDLIKEELHKLGPVSAREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKTGIPLTIVGYILVIVFSMTYWKWLGLL

SEQ ID NO: 43140 - protein, 290 aa, Desulfovibrio desulfuricans G20
MLIRKVVIPVAGWGTRSLPATKNIPKEMLPVYNKPVVQYVVEEAMRSGLTDVVFVTNRDKTIIEDHFDYNLQLESVLERAGKTEMLRQVREVAEMVNIHSVRQKRQLGLGHAVLCAREVVHNEPFAVMVGDDLQFGMEPGIQQLINVAVAERLPVVGVMEVPADKVSRYGIISGEEISPGIFRVHDLVEKPAVSEAPSRLAIVGRYILTPDIFKVLENLSPGHGGEIQLTDGLKVLAQGRGLLAVKLRGMRFDAGDWAEYLTANIYFALQEEDLRDELVERLRPLLPFKC

SEQ ID NO: 43141 - protein, 418 aa, Colletotrichum lagenarium
MGDLQGRKVFKVFNQDFIVDERYTVTKELGQGAYGIVCAAVNNQTQEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPQLFAQANPDALDLLDRMLAFDPSSRISVEQALEHPYLHIWHDASDEPDCPTTFNFDFEVVEDVGDMRKMILEEVYRFRQLVRTVPGSTQAGAQAAGQAGAGQVPIPSGNPGWTSSDPRPQEYVGQGGGLEADLAGGLDHRR

SEQ ID NO: 43142 - protein, 122 aa, Oryza sativa Indica Group
PVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAY

SEQ ID NO: 43143 - protein, 932 aa, Oryza sativa Japonica Group
MPRRSASRYAAYWAADALAGDDALDFSLTKALVGVSPDSLTGAPEAVRERVALRCLQEVVSLASDGDYEATPTAGGVLSVDASRSCEDSLLQLIREIGSSGSLEKVMLLPFSQDVQKFICIKRPTLPETSFELLREVYPEITPVVLPSPVEQNGNDQHDNVSHDLENTEKTGFNTDGAQLQQDDLANLVNESNTGNLQKDAMATPDFHQPCTSENRCFDQPQEDSINAVGVNIRSPKDSPTNVDRHIQVAAEPSLATSADLLGSNTGTISEQDMIDDTTMVQSQSQGVKNPNTLHYNNGDEPLVASIQSPKDSIHEGLTIQATVSPAFDRSNDALPASTSEISQLPEFITARDTVMNSEPRINKSHPNSPKHDTVDKANQDVDYGSVGIQKAAAFLSEDRNGATQGEKSEIKDPPENTAEHTKMFEQENSVEAQLEVGCSDKVNQDIQDDGNIMTKNMVCDGLNVQTAPEPHSCRMALHNKNLVANHLSEQNIGRNTTAVEKDCCSIPTSPQVVNDTRVKQPSNKRTMGNTVVETSHVHSSDDSLSGFAATGLLSMADKIPFCTQDQDANGPVEGLSEQDLCIKCGKDGQLLKCSSCLLAAHDTCFGSLATLDDSGQLYCPVCFYTKATEAYQKAKKTYSEARKNLSAFLGRKQLAEQHQQAAVGQRAANNEDHLNGCNDASKRKDNHQSEGNNLSHRDEDPTRKRKKQKTNATSDACAQEVVTEKNNRKQAQVAEHEQPEENEEASGESGNDNSLHKTTHSSQTKCSPAVNQNVDADKENGLASSQQSEDSDEIEATSSNDSTKKSSPPWRKLRHRKAIYQDKDTAMPSNSKKVLGNRDQHMASPSRKRNYACPPKRYSNPIVPAGRRTKLCWTEKEEITLREAMAKFTPRDNGPIPWVQILEHGRDVFHRTRLPSDLRVKWRNMKKKSGS

SEQ ID NO: 43144 - protein, 122 aa, Oryza coarctata
PVGENKRGREVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPIAPGKQEVEHAY

SEQ ID NO: 43145 - protein, 122 aa, Oryza coarctata
PVGENKRGGEVYRLYDVGGQRNERRKWIHLFEGVNAVIFCAAISEYDQMLFEDETKNRMMETKELFDWVLKQRCFEKTSFMLFLNKLDIFEKKIQKVPLSVCKWFKDYQPIAPGKLEVEHAY

SEQ ID NO: 43146 - protein, 360 aa, Physcomitrella patens subsp. patens
MVEKTEDAPVGAVPEDANQHCPGTEAEQAGKASACEGCPNQQICATAPKGPDPDLVAIEERMRTVKHKILVLSGKGGVGKSTFAAQLSFALAGLDKQIGLLDIDICGPSIPKMLGLEGQEIHQSNLGWSPVYVEDNLGVMSIGFMLPDPDEAVIWRGPRKNGLIKQFVKDVDWGDLDYLVVDAPPGTSDEHISIMQYLKASNVDGAIIVTTPQEVSLIDVRKEINFCKKVGIKVLGVVENMSELRQQLESAEFKSVDAQGEEQDVTNEVLDVLKSHAPHLLSSFVATSVFYGGAGGAEKMCKQIKVPFLGRIPLDPKLGKAADEGRSCFGDRDCSASAAALRTVINRILSVTEKGAGVSV

SEQ ID NO: 43147 - protein, 309 aa, Mesorhizobium loti MAFF303099
MAAGKPVVILGVFVADTAYRADRQPRMGETILGNSFKLGPGGKGSNQAVAAGKLGADTTFLTRLGVDAFADMAKRTWQDAGVKSAVIDTPDSYTGAAYIFVEEGSGNNAIIVSPGAAMLISPTDIEANAALIRGAGVFVTQLEQPIDAAMRALEIARGAGVTTILNPAPAAKLPDRVYTLCDYLTPNETETEELTGLKVSSVDEARTASGKLLEKGVGTVIVTLGDKGALLHSKGRSEHVPAISAGPVVETTGAGDAFNGGFAAALSRGVEPLQAVRFACAVAGISVTRPGTAPSMPTLQEVEALLAKG

SEQ ID NO: 43148 - protein, 494 aa, Neptuniibacter caesariensis
MRQNIYVVDGSTTIRNLYSAVLESVGYRVKCFKTGESCYKALNFEIPDLIIMGAELPDTECVELSTRIKSQPEFILLPIVVVSSIRSMELKQRCFQAGVTDFILKNCTQAFLLERVKNILQRKETMQFNQHLAGQRFNVLIAEDSASLLALYGVMLEQLGCFPILCSNGKEAWEELQKHDDIDLILTDVEMPIMDGIEFNHLVRSASEYDQVPLIVVTQHDQEELLCELLSSGASDFITKPFSHEELRARIGSHLRTRFLYKEQLRLNRELQEANTYLEDRVRERTQELYDANIETITKLALACDYKDKDTANHIDRVKLYSEELGRAVGLSSEVIKRLGYSSMMHDVGKITTPDHILNKPGPLDDQEWVEMRNHSAAGARVLGGSAFFNMARDIALYHHEKVDGTGYPKGLKGDEIPLAARIVAVVDVFDALVSKRSYKEPWSTEQAVTELQRIAGVHLDKRLVEIFILMLESGQLDYIRSKYPEHEVADDHF

SEQ ID NO: 43149 - protein, 559 aa, Brassica napus
  misc_feature (212)..(212): Xaa can be any naturally occurring amino acid
  misc_feature (301)..(301): Xaa can be any naturally occurring amino acid
  misc_feature (359)..(359): Xaa can be any naturally occurring amino acid
INVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGIWVCWITTLFATDFFEIKAVKEIEPALKNQLIISTAIMTVGIAVVSWVGLPSSFTIFNFGTQKVVQNWQLFLCVCVGLWAGLIIGXVTEYYTSNAYSPVQDVADSCRTGAATNVIFGLALGYKSVIIPIFAIAISIFVSFSFAAMYGVAVAALGMLSTIATGLAIDAYGPISDNXGGIAEMAGMSHRIRERTDALDAAGNTTAAIGKGFAIGSAALVSLALFGAFVSRAGVHXTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 43150 - protein, 370 aa, Brassica napus
IRLITCCSCCPCRAAARAGASSYADELVKTAKTIASPGRGILAMDESNATCGKRLDSIGLENTEANRQAYRTLLVSAPGLGQYISGAILFEETLYQSTTEGKKMVDVLVEQNIVPGIKVDKGLVPLVGSNDESWCQGLDGLSSRTAAYYQQGARFAKWRTVVSIPNGPSALAVQEAAWGLARYAAISQDSGLVPIVEPEILLDGEHDIDRTYEVAEKVWAEVFFYLAQNNVMFEGILLKPSMVTPGAESKDRATPEQVASYTLKLLRNRIPPAVPGIMFLSGGQSELEATLNLNAMNQAPNPWHVSFSYARALQNTCLKTWGGRAENVNAAQTTLLGRAKANSLAQLGKYTGEGESEEAKEGMFVKGYTY

SEQ ID NO: 43151 - protein, 438 aa, Edwardsiella ictaluri
MRLPDTQRILDLLDCPMLPSVTGEHLEGRLLTIGATLLRAHLPGVGLGEQCTLPDGSPAEVVAIEGDQALLSPYQPPLGLANGMLVTPLGAQACIGVSEALLGRVIDALGQPADGKPPAQATQWRSLDSPPPDPMQRAPIDTLLPMGVRAIDATLSVGVGQRLGIFSPAGCGKSTLLGMMATNSQADVVILALIGERGREVREFLEQIMSPELRARSVVILATSDRPALERIKAADTATVIAEYFRDRGHNVLLLVDSLTRYARAIREIALAAGEPTVSGGYPPSLYARLPRLLERAGPAACGSITAFYTVLVEQKSDPLAEEVRSLLDGHIVLSRRLAEASHYPAIDIMASISRVMSQIVTPQHRQAANRLRHLMATWQEIALLVRVGEYRAGQDTDADEAIARREAIDNLLCQKTDEHCPLAPTLSALYSAVGQPC

SEQ ID NO: 43152 - protein, 104 aa, Brassica napus
MQNSRIPPFTESKRKKIHNPKQHPLPSRISKKASTRIKPSHQPEMFSSDSSEYRALRRNYLLLEEESFALERELKEVEVEVKALEDEKVELLDKLVVMEGLVDP

SEQ ID NO: 43153 - protein, 339 aa, Vibrio fischeri ES114
MLRVAINGFGRIGRSVLRALYESDKRDKIEVVAVNELSQPEAMAHLFQYDSTHGRFQHKVTHDQEYPYSDVPDSSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKMLVWCDNEWGFANRMLDTALAMSK

SEQ ID NO: 43154 - protein, 419 aa, Xanthobacter autotrophicus Py2
MNTASSTLHPAVRNGSFDVEAVRADFPALSLEVNGHPLTYLDNAASAQKPRQVIQRMVTAYEREYSNVHRGLHYLANAATEAFEQARESVRGFINAASVDEIIFTRSGTGAINTVASSLGQSIEAGDEIVLSIMEHHSNIVPWNFLRERKGAVIRWAPVTEDGSFDFEAFKGLLTERTKIVAITQMSNVLGTVTPIKEIVAAAHAVGAKVLVDACQSIVHMPVDVRDLDVDFLAVTGHKLYAPTGIGVLYGKLDLLAQMPPYEGGGEMIREVTEDYVTYGVPPHRFEAGTPPIVQAIGLGAAVEYVNSIGRERIAAHEHELSVYAHERLGALNSLRIIGTAPGKGGIISFEMKGAHPHDVATIIDRYGVAVRAGTHCAQPLLARYGTTATCRASFALYNTRADVDRLVDALVKAQDLFA

SEQ ID NO: 43155 - protein, 387 aa, Vibrio fischeri ES114
MSVIKMTDLELAGKRVFIRADLNVPVKDGKVTSDARILASLPTIKLCLEAGAKVMVTSHLGRPTEGEYNEEFSLAPVVNYLNDALDCDVKLAKDYLDGLELNAGELVVLENVRFNKGEKKNEEELSKKYAALCDIFVMDAFGTAHRAQASTHGVGMNAPVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIGNAKTILWNGPVGVFEFKNFEAGTAGISKAIAESAGFSVAGGGDTLAAIDKFGIKADVSYISTGGGAFLEFVEGKVLPAVAMLEERAKA

SEQ ID NO: 43156 - protein, 563 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVIRLIELKLPVFDAPESLIKQAQLTAATNAKQ

SEQ ID NO: 43157 - protein, 183 aa, Zea mays
MATVDATTPTESGGKQQAPSLPACRSFSGANPALRVLLFAVTLAGLVLLATAKQTVRVPIPQFPGLLLSRPAKFTDSPALILLTALASLKLVSGSFPATRTLFLLVLLDVLYAAIMASATGSGGGVAWIGLKGNSHTNWNKICNIYGKFCRHIGSSVFLGLVASIILVLLAILNAHSLYRRSR

SEQ ID NO: 43158 - protein, 279 aa, Staphylococcus aureus subsp. aureus MRSA252
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDDPVIVKIAEKYHKTPAQVVLRWHLAHNRIIIPKSQTPKRIQENIDILDFNLELTEVAEIDALNRNARQGKNPDDVKIGDLK

SEQ ID NO: 43159 - protein, 494 aa, Saccharomyces cerevisiae
MSSEEDYFDELEYDLADEVNEEKEDIQTKKLTTVNCQTEKFNPFEILPESIELFRTLALISPDRLSLSETAQILPKIVDLKRILQQQEIDFIKLLPFFNEIIPLIKSNIKLMHNFLISLYSRRFPELSSLIPSPLQYSKVISILENENYSKNESDELFFHLENKAKLTREQILVLTMSMKTSFKNKEPLDIKTRTQILEANSILENLWKLQEDIGQYIASKISIIAPNVCFLVGPEIAAQLIAHAGGVLEFSRIPSCNIASIGKNKHLSHELHTLESGVRQEGYLFASDMIQKFPVSVHKQMLRMLCAKVSLAARVDAGQKNGDRNTVLAHKWKAELSKKARKLSEAPSISETKALPIPEDQPKKKRAGRKFRKYKEKFRLSHVRQLQNRMEFGKQEQTVLDSYGEEVGLGMSNTSLQQAVGATSGSRRSAGNQAKLTKVMKHRISEANQQADEFLISLGHNTEQPNLSPEMVQMHKKQHTNPEEETNWFSGHG

SEQ ID NO: 43160 - protein, 302 aa, Physcomitrella patens subsp. patens
MENYEKIEKIGEGMYGKVYKAWDKRTGAMVALKKNKIENEKEGIPATTLREVSLLQVLSTCIYFVRLLSVENSHKNGKTSLFMVFEYIDTDLRRFMDLSWPGPDNPLPQNTIKSFMFQLLKGVAHCHSHGIMHRDLKPQNLLVDWKKGLLKIADLGLGRAFTVPMKSYTHEVVTLWYRAPEILLGASHYSTPVDMWSVGCVFAELCRKSPLFPGNSELQQLLFIFRLLGTPNEQIWPGVTTLRNWHSYPQWKPHEIAQAVPRVERSGVDLLDRLLQYNPANRISAKEALVHPYFDSLDKSQF

SEQ ID NO: 43161 - protein, 572 aa, Saccharomyces cerevisiae
MLSKSEKNVDLLAGNMSNLSFDGHGTPGGTGLFPNQNITKRRTRPAGINDSPSPVKPSFFPYEDTSNMDIDEVSQPDMDVSNSPKKLPPKFYERATSNKTQRVVSVCKMYFLEHYCDMFDYVISRRQRTKQVLEYLQQQSQLPNSDQIKLNEEWSSYLQREHQVLRKRRLKPKNRDFEMITQVGQGGYGQVYLARKKDTKEVCALKILNKKLLFKLNETKHVLTERDILTTTRSEWLVKLLYAFQDLQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEINYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGLEHSDPFSTFY

SEQ ID NO: 43162 - protein, 301 aa, Prosthecochloris aestuarii DSM 271
MRNDKWDAGRIARQDGRIALISGANSGIGFDTAVVLAGKGAEVVLAVRDIGKGEEACKAIRKDFPDAALQVMLLDLADLSSVRRFAYAFLARYSRLDLLINNAGVMVPPQRCVTVDGFELQFGTNHLGHFALTLLLSGLLKQTPSSRVVTVSSGAHYFGKLDFSDLNWQRRPYRKWQAYGDSKLANLYFTRQLQRRLAEDHASTIAVAAHPGWSGTNLQRYEPLAMLMNRFFAQTSAMGALPELYAATARDVAGAEYFGPGGIGGLRGYPVRCSSSRLSEDQGVGQRLWEVSEVLTGVFWQ

SEQ ID NO: 43163 - protein, 212 aa, Triticum aestivum
  misc_feature (164)..(164): Xaa can be any naturally occurring amino acid
  misc_feature (166)..(166): Xaa can be any naturally occurring amino acid
  misc_feature (169)..(169): Xaa can be any naturally occurring amino acid
  misc_feature (178)..(178): Xaa can be any naturally occurring amino acid
VNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIEAWGKKEGSLCXIXVIXAHKDDTNKXLLQWGPRALLPIQATNPNPTNCIIIYTHTTSHQY

SEQ ID NO: 43164 - protein, 173 aa, Oryza sativa
  misc_feature (111)..(111): Xaa can be any naturally occurring amino acid
  misc_feature (161)..(161): Xaa can be any naturally occurring amino acid
MATTRPARSDPHLPPEEAARVEAEVRGYFDSMAPRRPSKPPRSDPSDAGEGGAEADADADLPELRRLRDLEAKPQKLVLDGGDVNGEEYVETQYYNGLNCIDKQHHTTGTXGFIKVERPNGSSFNVTTVAYSSDSIIRCMSNPATNDWIPSSETVCPVKMXIPVSNKPSRSDS

SEQ ID NO: 43165 - protein, 373 aa, Neptuniibacter caesariensis
MKYFKLPDLGEGLPEAEILEWHVQEGDKVQTDQIVVSVETAKAIIEVPSPQSGVIAHLFGQAGDTIHTGEPLLEFSGEDEEDTGTVVGKIPVASQQTQSGDDFIIGSPTSGTVSESVKATPAVRALAKRLNIDLAQVRGSGRNGSVTPADIEKASKMDQLHGKAEPLRGVRKQMALAMSRSHAEVVPVTINEDANIHAWPKGTDITLRLIHAIAYACAKEPAFNAWFDGQSLSRRIHQKIDLGVAVDTEQGLFVPVLRDIGSRDLTDIRSGLDNLRNDVKARTIPPQELQGATITLSNFGTIAGRYANPIVVPPQVAIIGAGVIREKILAIDNEMKIQKILPLSLTFDHRALTGGEAARFLQALLTDLSLSEV

SEQ ID NO: 43166 - protein, 161 aa, Zea mays
MTSSSSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 43167 - protein, 764 aa, Legionella pneumophila str. Paris
MLKILKRIVQDVTAASDLKEALGILVQRINTAINAEAVSVYLIDNKNAEYVLIATEGLNKQAEFRVRIALDCGLIGLIGRREEPINIENAPSHPDFYHNPLIGEDHLNAFLGVPIIQHRKLYGVLVVQQLEQRHFDDAEESFLITLAAQLGGIIAHAEATGELAELTQPKKGIGVDKVEAAYTALTGIGSVPGIGIGTAVVVYPPADIDAVPRNPVEELEDEINAFYEALETTRDDIRRLSKRMKETVAEEEHALFDVYLRILDRDSLGAEVEHVIREEKISAQAALATVIKKHVQQFESMGDDYLRERASDFRDLGRRVLAELQRTQREEIVYPKRTILIGEEITAAALAEVPEGQLAGVVSAKGSNNSHVAILARALGVPTVMGLRGLKVELVSRRALIVDGYYGHVYISPSKSLLAEFKQLAQEEQELNQSLVSLRDKPAETTDNYRVSLQVNTGLAMDAGLSMSVGAEGVGLYRSEVPFMSRDRFPSEDEQTIIYRQTLKAFAPRLVTMRTLDIGGDKILPYFPVEEENPYLGWRGIRITLDHPDVFLIQVRAMMRASEELDNLRIMLPMVTTLSEVEEAVYLIEQAFEELVEEGCEIVKPKIGVMIEVPAAAYLAREMAKRVDFISVGSNDLTQYLLAVDRNNARVAALYDPLHPAMLRTLLKIVEGGHAAGVEVSICGEMASDPLAVILLIAMGFDTLSMNSASLPRVKWVIRNFAIANARKILAEVLEFEHPAEIRFHLQKALEEEGLGGLIRAGKS

SEQ ID NO: 43168 - protein, 533 aa, Xanthobacter autotrophicus Py2
MGKLKREIGLIGLTFVAVSGIIGSGWLFAPLLAAQHAGPAALIAWVIGGAAMLLFALTFAEISAMLPVAGGIARVPQFSHGNVVAMAMGWSAWVGYNTTAPIEVEAMLRYLGPHLGWLYTAPGSGTLSWAGVAVAGLMMVAFTVINAFGVRFFTRVNTAITWLKIAIPLVVVAALLAARFEPANFTQAGGGFAPFGVAGVLAAVSSGGIAFSFIGFRHAIDMAGEVKNPGVTIPIALVLALAIAFVVYGGIQFAFTGALLQADLAHGWGALALPGDFGPLGALAAALGMLWLVSLLNFGAVVGPFAGGLVSVGSNARLAFALAENGFFPERFASLSARGVPVAALLLNLVFSLATFVLLPFSEVVQLNSSAVILSFVVGPVAVVALRQLLPDATRPLRVPAVKLVAPVAFIIATYIIYWSGWPTVWRLGLCLLAGLALFLVHARNRAAGSLDLAEAVWLAPYLAGLGLVSFLGSFGGRGLIPFGWDLLVLAALGGGAFALAVRERLSQAKFDRYMSEERVLDAATEEEPEVRV

SEQ ID NO: 43169 - protein, 585 aa, Bacteroides thetaiotaomicron VPI-5482
MYLENIYSPADVKKLSFQELNDLSHEIRASLLQKLSEHGGHFGPNFGMVEATIALHYVFNSPKDKIVYDVSHQSYVHKMLTGRKDAFLHPAEYDHVSGYSEPQESEHDFFVIGHTSTSISLASGLAKGRDLTGGNENIIAVIGDGSLSGGEAFEGLDYVAELGTNMIIIVNDNQMSIAENHGGLYKNLKDLRDSNGQCECNFFKAMGLDYMYVNDGNHVEALIEAFSKVKDIQHPIVVHINTLKGKGYEPAEQDKETYHWRTPFDLETGESKVNDDAEDYSEVTAQYLLKKMKEDKRVVTITSGTPAVLGFTPDRRQEAGKQFVDVGIAEEHAVALASGIAANGGKPVYGVYSTFIQRSYDQLSQDLCINNNPAVLLVFWGTLSGMNDVTHLCFFDIPLISNIPNMVYLAPTCKEEYLAMLEWSICQNEHPVAIRVPATDVISCGEPVESDYSNLNRYKVAHRGSKVAILALGSFFGLGQSVLSLLKDKANIDATLINPRYITGVDSELMDELKADHELVITLEDGVLDGGFGEKIARYYGATDMKVLNYGAKKEFVDRYDIQELLRANHLTDEQIVEDILSLIG

SEQ ID NO: 43170 - protein, 3649 aa, Micromonospora griseorubida
MTANNEEKLREYLRRALADLHEARAQVHRLTEEAHEPVAIVGMGCRFPGGVETPEQLWELVASGTDAISPFPTDRHWDVDGIFDPEPGRAGRTYCREGGFLVDAPGFDAGFFGVSPREAVAMDPQQRLLLEVSWEALERAGFDPLALRGSRTGVYAGVMHHDYGLNHSFDEETGGFLGIGTAGSVVSGRVSYVLGLEGPAVTVDTACSSSLVALHLAVQALRSGECDVALAGGVTVMATPGIFVEFSRQGGLAVDGRCKAYSDSADGTGWSEGVGVLVVQRLSDAVAAGRRVLAVVRGSAVNQDGASNGLTAPSGPSQQRVIRAALASARLSVGDVDVVEGHGTGTRLGDPIEAQALLATYGCRGGGRSLLLGSVKSNIGHAQAAAGVAGVVKMVLAMERGVVPASLHVGVPSSHVDWSSGAVEVVGEACAWPETGRPRRAAVSSFGVSGTNAHVILEQAPVADAASFVVVPVSVASGADSSGGVAPVSDVSDAGSSSVAVPWVLSARSEWGLRAAAGRLEAALSGPLSGSGSGSGAVSGVDVGWSLGGRSVFGWRGVSLSGVGGLGVLAGGGVGSGVVVGSGRVASGGVVFVFPGQGAQWVGMARGLLAESEVFSEAFDEVGGVVQGLVDWPVRATACGESGGGHLGRVDVVQPLSFVVMVALAGLWRSWGVVPHGWVGHSQGEIAAAVVSGALSVEEGARVVVGRSRVIGARLAGGGAMVSVGASVGVVEGLLGGLGGGLEVAVVNGPGQVVVAGDVGGVEGLLVRCGEVGVRARLLPVGYGSHCGLVDVVRDELLSVLGEVRAGESVIPFYSSVDVGVVDGGVLDGGYWFRNLRLRVRFGEVVRRLVGDGFSSFVEVSAHPVLVGAIEDVWGEVGGGVGSCVVGSLRRGDGGLGRMVVSAAEGWVRGLPVQWRRVPVLGGGRQVGLPTYPFQHDRYWLAPTTPATDPRPQQDDLRYRVRWQPVRMERTARLTGRWVLLLPDRLPATDRDIADRVARTMANAGADVDEIVVDATTVSGESLEASLVGAAGVLSALALVEEEHPEFPILPVGLAATLTLLRSLAVAGAPLWTLTRNAVAALPGEVPHLAGAQVWALGRVAALELPSPWGGLIDLPTEPNQQVLKRLVGVLAQNAEDQVAVRNPAAYGRRLVPAPAVREESSWQPQGTVVVVGDTGAPEIERMIHRLRDEGVEVVDADRDTLGTVLAEHASITVVVAPPAVPVAPLAETTLAGFAATVEAKTGDARWLERLPDTPALQAVILFSSVSGVWGGVGQAGYAAGCAYLDALAERLRAGGVSATSIAWTPWEGTSGADVVSRGGVVPLDAERALDVLFRALRSGRSETVIADIDWDLFLPSFTMARPTVLFDEIPEVRQLREAGAERPETPRVDSAFSRSLIGLAPADQRRMVDDLLATHIAAVLGESSFAVDAERAFRDIGFTSVSAVDLRNRLGAATGLTLPASLVFDYPNPQALVDYLLAELTNQSAEQEDVRPTEKVDEPIAIVGMGCRFPGGVSSPEDLWDVVASGVDAVSPFPVDRGWDLESLFDGDPDRAGTTYCREGGFLDDVAGFDAGFFGVSPREAVAMDPQQRLLLEVSWEALERAGHDPRELRGSRTGVYMGTNGQHYLPLLRDSEEDFDGYFGTGNSASLMSGRISYVLGLEGPAVTVDTACSSSLVALHLAVQALRSGECDLALVGGATVMATPDVLTEFSRQRALSADGRCKAFSDAADGFGASEGVGVLVVQRLSDAVAAGRRVLAVVRGSAVNQDGASNGLTAPSGPSQQRVIRAALASARLSVGDVDVVEGHGTGTRLGDPIEAQALLATYGRRGGGWPLLLGSVKSNIGHAQAAAGVAGVVKMVLAMERGVVPASLHVGVPSSHVDWSSGAVEVVGEACAWPETGRPRRAAVSSFGMSGTNAHVILEHVATEQPAADPEPSVSVGDSDSVVPWVLSARSEWGLRAAAGRLEAALSGPLSGSGSGSGAVSGVDVGWSLGGRSVFGWRGVSLSGVGGLGVLAGGGVGSGVVVGSGRVASGGVVFVFPGQGAQWVGMARGLLAESEVFSEAFDEVGGVVQGLVDWPVRATACGESGGGDLGRVDVVQPLSFVVMVALAGLWRSWGVVPQAVVGHSQGEIAAAVVSGAWSVEEGARVVVGRSRVSGARLAGGGAMVSVGASVGVVEGLLGGLGGGLEVAVVNGPGQVVVAGDVGGVEGLLVRCGEVGVRARLLPVGYGSHCGLVDVVRDELLSVLGEVRAGESVIPFYSSVDVGVVDGGVLDGGYWFRNLRLRVRFGEVVRRLVGDGFSSFVEVSAHPVLVGAIEDVLGEVGGGVGSCVVGSLRRGDGGLGRMVVSAAEGWVRGLPVQWRRVPVLGGGRQVGLPTYPFQHDRYWYTGPSRRGDLTSAGLAEANHPLLAAAVDLPDDHGLVFTGRLSRASVPWLADHALLGVSVLPGTAFVEMALWAGRRAGFGQLEELTLTTPLPLPESGAQLLVRIDTVDGSGDRTITFHSRVPGDDGSERWTKHAQGTLVTPTGSARDQAEWKYPDGPDLSVEEFYTRLAERGYHYGPVFRGLRGVRRAGEDVFAEVALPQEADGSRFGLHPALLDAAVQAMGLGGFFPDDGQIRVPFSVRGVRLHTTGVERLRVRVSRSAEDAVRVDCVDEQGRPVCEIDSLVVRAIDTDQLVEDARTPVGELLYRVDWPLLTVGPAQPPKHCAVVGDDPYGLAAVLGDQGVTCDVHPDVAAFTIRSVTMPDVVVATLPASTDPDVPAVRDVANRALDLAQWWLSVATDAEAARLVVVTSGAVATQRGEPLRDPAAAAAWGLLRSAQAEDPGRLVLLDVAGQRPDGAALLAALASGKPQLALRDGNLRVPRLTRTETGDALLPPAGTSAWRLAVGENATLADLCLEPADTATVSLLPGQVRIAVRAAGLIFRDTLIALGVYPDQAAMGAEGAGVIVEVGPEVAGLAVGDRVFGLWDRALATHVVVDHRTVVAMPSGWSFAEAATVPAVFLSAYYALKHLARAVPGQSILVHAAAGGVGMAALQLARHLGLEVYGTASPGKWDVLRDQGFDDRHIANSRTLDFADRFLDASGGRGVDIVLNSLAGGFVDASLRLLPRGGRFLELGKTDVRDADRIAAEQPGVTYRAFELMEAGPDLLGEMLRELLVLFDTGVLRPLPLFAHDIRHARDAFRTLSQGRHVGKLVLTMPATIDPGGTVMITGGTGNVGGVLARHLVERVRRYGTCRSSSRQGPAAPGVDDLVAELADLGATVTVHAGDVADRAEVERLVAAVPAEHPLTAVVHAAGTLDDGMIPSLDQEQVGRVLRPKADGALYLHELTRGSALSAFVLFSSVAAVLGGPGQGSYAAANGFLDAFAQNRSAAGLPTVSLSWGLLAGAARMTAHVDQDALRRRMSRGGILPLSGRDLTALFDAALAGTEAHQVPVRIDPSAIPDDAGVSPLLRGLAAGRPARAVASEPVDVRSLVERLTGMPEEAQQTLLENLVRTHAAAVLGYDGPDAIQGDTAFMEIGVDSLAAVDVRNRLAAATGLRLAASTDFDHPTPVVLAGHLRAQLGLETRTVPLVGELERLTEALGSTSLVDIDPDDRREIAARFTALHARWLEMQQAEKPAKDTELTVDDIDAADDDAIFAYLDDRLSDS

SEQ ID NO: 43171 - protein, 300 aa, Zea mays
MGNARRPAADSAAASDREVGFAKLHGECFEYYMQTYSIVLGRHSRRRSKGPVAAPPEADDGVDVDLGALGAGMNVSRRHARIFYDFLRRRFALEVLGKNGCLVEGVHHVPGSAPVKLDSQDLLQMGDTKFYFLLPSRSVFDAGITRRSSAVQRAIPPPPSDDDEDEDEHEEAVAAAKRRRDGYNGSKSYREADDQLLLQLEEKDVISSAATILSDLCGPQEWISINKLHEVMFDKYGGMWHHSRVRKYLTSEDFAEAETDGRLWHGLALLLRKYPEHFVINIRKGGGLITEFVSLVSLQS

SEQ ID NO: 43172 - protein, 379 aa, Zea mays
MATAGKVIKCKAAVAWEAGKPLSIEEVEVAPPQAMEVRVKILFTSLCHTDVDFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 43173 - protein, 416 aa, Zea mays
NKFVQKSRLVPASRPAVPETSSPVSTPTPRTRLLLACCFCGSRPSDPAPPMPPQPNGGKVTPNLAMDAEATRLLNLTVLQRLDPAVEDILITAAHVTLYDFNIDLNQWSRKDVEGSLFVVKRNSQPRFQFIVMNRRNTDNLVEDLLSDFEYELQPPYLLYRNASQEVNGIWFYNQQDCEAVASLFGRILNAYAKVPPKPKVPSTKSEFEELEAVPTSAAIDGPLEPPPASAAVVLDTPDESLISYFSGAASIGSVSNAQPSGRVHPSTESIPSSHVPLIVPSAASTHQLPPSVASTASPLPVHGTNAHTSRPTNLVTPDFFAPPPSSSAPLAPPGASVVPTAPPLHPTSAASIQRSQYGTPLLQPFPPPTPPPSLNPSHSDRLTVTRDRVKDALQRLVQSDEFVDLVCRELQRSLV

SEQ ID NO: 43174 - protein, 394 aa, Medicago truncatula
MGAEKPRSCATYFENSKPYFAMILLQFGYAGMNIITKLSLNGGMSHYVLVVYRHAFATIAIAPFAIIFEWKDQPKITFSVFMQILLLALLGPVIDQNFYYAGLKLTSPTFSCAMSNMLPAMTFVMAVLCRMEIVNLKKLRCQAKVIGTILTVAGAMLMTLYKGPVLELMWTKYIPHSNANITSSSSKDNWFLGSILLIIATLAWSSLFVLQAKAIETYKNHQLTLTSLICFFGTILAFATTLIMENKDSVWTIGWDMNLLAAAYAGIVTSSISYYIQGLVIKKKGPVFATSFSPLMMIIVAIMGFFILAEQLFLGSVIGSILVVIGLYSVLWGKHKEQVECKVSPDDIPLPIKSARINGNMGAFSASFDKHSEVKLDQKEESNISLVIINYNRS

SEQ ID NO: 43175 - protein, 525 aa, Oryza sativa Japonica Group
MTKPQQQSPPSTTATTTTSPPPPPPSTPPPASSSSSSLAKLPLRLHSLASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSPHPPLPPQ

SEQ ID NO: 43176 - protein, 569 aa, Medicago truncatula
MSLLKAVFVWCICLGLFELSLAKGKSHYKFDVEYIYKKPDCKEHVVMGINGQFPGPTIRAEVGDTLVIDLTNKLHTEGTVIHWHGIRQFGTPWADGTAAISQCAINPGETFQYKFKVDRPGTYFYHGHYGMQRAAGLYGSLIVDLPKSQREPFHYDGEFNLLLSDLWHTSSHEQEVGLSSAPMRWIGEPQNLLINGRRQFHCSLASKYGSTNLPQCNLKGGEECAPQILHVEPKKTYRIRIASTTSLASLNLAISNHKLIVVEADGNYVHPFAVDDIDIYSGETYSVLLTTDQDPKKNYWLSIGVRGRKPSTPQALTILNYKPLSASVFPTSPPPVTPLWNDTDHSKAFTKQIISKMGNPQPPKSSHRSIHFLNTQNKIGSFTKWAINNVSLTLPTTPYLGSIKFNLKNTFDKNPPPERFPMDYDIFKNPVNPNTTTGNGVYTFQLNEVVDVILQNANQLNGNGSEIHPWHLHGHDFWVLGYGEGRFRPGVDERSFNLTRAPLRNTAVIFPYGWTALRFKADNPGVWAFHCHIEPHLHMGMGVIFAEAVHKVRNIPKEALKCVLQPRCS

SEQ ID NO: 43177 - protein, 172 aa, Zea mays
GGEAVDGEGDGEKPAVEAEADERAAEEMAPKKAAAAKKAAEEVEVEEVVDGDEAVDGEGDGDEDDDDDDEDSDDEEEVDGEDDQEEELGTEYLVQPLGRAEDEEHSSDFEPEENGEGADDEEIDEEDDDGEDSVKAQTSTKRKRSGDEEEEDDDDGDDDGDDDDDGRPPSKR

SEQ ID NO: 43178 - protein, 386 aa, Prosthecochloris aestuarii DSM 271
MTNFVFTDIALVVIAATLLGWLSLLTRQPIIIAYILAGVLLGPWGFKVITEIQFINEVSDIGITLLLFLAGLSLHPGKLFELFGKTFFLTLFTSTVFAGVTGAILYGFGATATEAIITGVAMMFSSTILVVKLMPTNTLHQKHMGAVAIAVLIMQDILAVLAIAFIKGGSGSTLLGWITSMAAGILLAFAAIVAERYAIRKIISQVQRYNELLNLVTLAWCFALALLAEKIGLSHEIGAFIAGVSLANGPISNFLAEGLKFFRDFFLVLFFFTLGAKLDFSLLITVLKPALLLTTALLFLKPLIYWSGFRLTGETMKFSREMGFRLGQNSEFALIIAVIAAESGVLSQANSQLIQLVTILTMTISSYILVFFFPTPLGTSKPLKID

SEQ ID NO: 43179 - protein, 197 aa, Staphylococcus aureus subsp. aureus MRSA252
MILVIDNNDSFTYNLIDYIKTQTKLTVQVVGIDNLLIEDIINMKPKAIVISPGPGNPDDYPILNEVLEQFYQRVPILGVCLGFQCIVSYFGGNIIHGYHPVHGHTTQLRHTNEGIFQGLPQNFNVMRYHSLIADGATFPNCLKITAKNDEAIIMAFEHITFPVFGVQYHPESILSEYGYRQVELFLSKVGDYCENRI

SEQ ID NO: 43180 - protein, 390 aa, Burkholderia thailandensis E264
MNAPHDMPTTPTLLSRLPDVGTTIFTVMSALAAEKGAVNLGQGFPDFDCDPRIVDAVARAMRDGRNQYPPMAGIAPLREAIADKIARLYGHRYDAATEITVTAGATQALLTAILCAVHPGDEVIVIEPTYDSYLPSIELAGATPVFVTLNAPDYAIPFDKLAAAITPKTRAILINTPHNPTGTVWREADMRALADIVRGTHLLIVSDEVYEHMVYDGTRHESVARYPELAARSIVVSSFGKTFHVTGWKVGYVAAPAPLTAEFRKVHQFNVFTVNTPMQFGLADYLRDPEPYLTLPAFYQKKRDFFRAGLANTRFKLLPCAGTYFQCVDYSTISDLPEAEFAKWLTTEIGVAAIPVSAFYHEPHESGVVRFCFAKREDTLATALERLARL

SEQ ID NO: 43181 - protein, 372 aa, Zea mays
MMAAAAISGSSGHLVVSSPRFRQPLTLPSRSGRPIAAAASAVARGGVAVAAVSSPAVSAVAGKDAKQAPKDFLHINDFDKDTIMNILNRAIEVKAAIKSGDRSFQPFNGKSMAMIFAKPSMRTRVSFEAGFFLLGGHAIYLGPDDIQMGKREETRDVARVLSGYNDIIMARVFAHQDILDLAKYAAVPVINGLTDYNHPCQIMADALTMLEHVGRIENTKVVYVGDGNNIVHSWLLLAAVLPFHFVCACPKGFEPDAKTVEIARSAGISKIEITNDPREAVKGADVVYTDVWASMGQKEEADYRKQKFQGFTVDEALMEIAGPQAYLMHCLPAERGVEVTDGAIEAPNSIVFPQAENRMHAQNAIMLHVLGA

SEQ ID NO: 43182 - protein, 498 aa, Idiomarina baltica OS145
MSKKVPLYIDGEFRASKAESWIPVTNPATQEVIAEAPCATQDEMEAAVASAREAFKTWKEVPVSERARVMMRYQALLKEHQEEIAEILAQETGKTFEDAKGDVWRGIEVVEQAANIPSLMMGETVENVARSIDSYSYIQPLGICAGITPFNFPAMIPLWMFPMAIACGNTFILKPSEQDPLTPTRLVELFEQAGAPKGVLQVIHGGKDQVDFVLDHPEIHALSFVGSVPVAEYIYRRGTENGKRVQAFAGAKNHCVIMPDANKQQVINNLVGASVGAAGQRCMAISVAVFVGAAKEWIPEVAEAIAKVRPGAWNDENAAYGPVISPQAKERIEQMITDGENEGAKLLVDGRGCTVEGLPDGNWVGATVFSEVTADMDIYKKEVFGPVLSMMEVEDLDDALTLVNNNPYGNGTSIFTSNGAAARKYQHEVTVGQVGINIPIPVPLPFFSFTGWKRSFFGDLHAYGKQAIRFYTETKTVTARWFESDIEASGPNMSIHLK

SEQ ID NO: 43183 - protein, 646 aa, Bacillus subtilis
MDDSAPYIGANDAWDLGYTGKGIKVAIIDTGVEYNHPDLKKNFGQYKGYDFVDNDYDPKETPTGDPRGGATDHGTHVAGTVAANGTIKGVAPDATLLAYRVLGPGGSGTSENVIAGVERAVQDGADVMNLSLGNSLNNPDWATSTALDWAMSEGVVAVTSNGNSGPNGWTVGSPGTSREAISVGATQLPLNEYAVTFGSYSSAKVMGYNKEDDVKALNNKEVELVEAGIGEAKDFEGKDLTGKVAVVKRGSIAFVDKADNAKKAGAIGMVVYNNLSGEIEANVPGMSVPTIKLSLEDGEKLVSALKAGETKTTFKLTVSKALGEQVADFSSRGPVMDTWMIKPDISAPGVNIVSTIPTHDPDHPYGYGSKQGTSMASPHIAGAVAVIKQAKPKWSVEQIKTAIMNTAVTLKDSDGEVYPHNAQGAGSARIMNAIKADSLVSPGSYSYGTFLKENGNETKNETFTIENQSSIRKSYTLEYSFNGSGISTSGTSRVVIPAHQTGKATAKVKVNTKKTKAGTYEGTVIVREGGKTVAKVPTLLIVKEPDYPRVTSVSVSEGSVQGTYQIETYLPAGAEELAFLVYDSNLDFAGQAGIYKNQDKGYQYFDWDGTINGGTKLPAGEYYLLAYAANKGKSSQVLTEEPFTVE

SEQ ID NO: 43184 - protein, 191 aa, Nocardia farcinica IFM 10152
MSKHAAVESDEHVAERTAEAARQVERLTRWHDDFPTPGVRFADLTPVFADAEGFRSVIESLAACAPDADLVAGVDARGFLLGAGVAATLGTGVLAVRKGGKLPPPVISREYSLEYGSAALEIPGNGVELRGRRVLLLDDVLATGGTLAAAAHLFVEAGAQVVAAAVVLELEFLGGRARQGDYPLTSILRLP

SEQ ID NO: 43185 - protein, 267 aa, Bdellovibrio bacteriovorus HD100
MMNLDTLLQKMWVDYCQLNPAAKRIYDIFTAEGETVLNDHIALRTFNHPRLGIESLAKHFKKLGYVEKGEYTFVEKKLYAKHYEHPNMDNPKIFISELELEKVSPFIRETVNQLVAQVPDSVIESETFAMAGRPWKVNWETYAKLAEESEYASWVAAYGFRPNHFTVNVNKLNKFNDLPTLNKFVQEKGYTLNKSGGEIKGTKADYLEQSSTMASEIPVKFDDGSTHNIPGCYYEFAKRYPLDNGQLYQGFVAKSADKIFESTNKQK

SEQ ID NO: 43186 - protein, 544 aa, Oryza sativa
MADAATTPLLTSHEAKPAKAPSIDDAIETYIGATGARQLLTAMLLAFAWAFEAQQVFMPVFTDAEPTWHCTGVAATAGGDPGSSCSPAAASPCALPPGTWEWDRPAETSVVSEWALKCGGGGPALVSLPASSFFAGNLAGGFLLTTLADTHLGRRKMLVLSLATMSVAGVLTAFSPNVWVYAALRFVSGFGRSMVGTSAMVLSTELVGKWWRNTVSVAGFVLFSVGFMSLPALAYTLREASWRDMYVWTSLPSLCYAVLLYFLVQESPRWLLVRGRNQEAIEALRQIASLNGGEGVTTSSFSMLDACAVEVGDGVAGGDGMFASLRLIWERRWAFQRLAAMMTASFGVGVVYYGLPLSVGSLSSDLYLSVAYNAAAELPSSVLSWLLMGRFNRRSSLVALTAASGLCSLACVVIPDEEAGTGGLRLAAELASFFASCAAFDVMLMYSIELFPTSVRNSAVGLVRKAAVLGGVVAPMLVALGRERSYWSFGVFGLAVGCLGLFVTWLPETKGRRLSDTMEEEEEAAAAILSCAGASDMNNNGELV

SEQ ID NO: 43187 - protein, 299 aa, Cryptococcus neoformans var. neoformans JEC21
MTSTAIPPAAVAANNNTLNSALAAEQISSPASPVDKPVDEKKQLEEGEIEENPSEGDSQTKTIFDDASKFNVKHPLFSTWTLYFDSPQSKSLPKTPQTTPAMPQGSHGWMADIRKVVSFDSVEEFWGLYNNIIPPSQLPGKANYYLFKNGIIPAWEDPQNKNGGKWSIQVPKNSESKSSIDRMWLYTMLAAIGETFETASTDSENAPSPTQSDLITGVIVSPRPAFYRISIWTREASDVNVLDTDAIKARLLNIGKHFKTSVLGYELEQKLTEGGFQTELTFDAHKDSEKKVNKNKFTV

SEQ ID NO: 43188 - protein, 622 aa, Neurospora crassa
MPPLYSHNLEPGRDSLELASLASSDPGPDTGDDTSSRPSISSSRKLSLEREDPLDNGNYAASGHRVRPERSTSVNSTFSFAANLFPLSSTTGGGYAPLGAPTATRGHVNGGLGGGSLEKHKTLTYLNGLSLIVGLIIGSGIFSSPSQVNANAGSPGAAIIVWVVAGILAWTGAASYAELGGAIPLNGGPQVYLSKIFGELAGFLFTWVAVLVLKPGSAAIISIIMGEYLVRTFIGAEAETINPWISKSVALVGLFLVTFLNSVSTKLGTRMNDMLMFLKFVALLGVTIVGIVVAATGFSFSGAANLDWKKHDWFEGTKMDASAFAVALYAGLWAFDGWDNTNYVVGEFRNPGRDLPRVIHTAMPLVILSYILANVAYFFVLPLDTINSTNTVAVIFGSKVFGPVGALILALIVSASCFGALNASTFTSSRLVYVAGKEGYIPELFGRIGSGTAVDQHESLTTMRTRSWFTKKLVRIVADEDTGLFYTPIPALMLNCALTTAYVCVGEFGTLVTFYGVAGYTFYFLTVLGLIVLRVKEPNLERPYKTWITTPIIFCCVSLFLLSRAVFAQPLQTLLVVAFVVVGVPVYYWRRYVNGRSAVKREAGGMREVREERPWWKFWQIR

SEQ ID NO: 43189 - protein, 753 aa, Vibrio fischeri ES114
MLTQLRDIVDHVAKAESLDDALALLVKNTRHSMHTECCSVYLMSNDNLRLELMATEGLKAKPKTVSLGIDEGLVGLVARSCEPLNLANASVHPSYKYIPSIAEYKFNSFLATPIIYRRQNLGVLVVQQKEKRQFTEVEESFLVTLSAQLAVILAHAKAHESWSTQLQPQSIEQKQFKGISASNGVAIAPLWFDDAQPRIESILPSSCLDTEQEQDRLGTAVELALKDFRRAKKRFEQELNTETLAIFDLFTHLLNDPMLKGDLKKQINQGDSAEWALRQVIESYAGRFEKMSDSYLSERANDVRELGQRLLYFLNYEGKLELDLAHPVILVTTQLTASMLASVPQDKLKAVISLEGAANSHAAILSRALGIPAIMGVEFNPTHYHQNLAIVDGYSGALYIKPTEALIQEYTELQNEELALSELITQDLDKPTFTRDEHQMKIYLNAGLSADTSIAVNQGVDGVGLYRTEIPFLLQQRFPSEEEQYLQYKTILETYPKKPVIMRTLDIGGDKPLPYLPIEEENPFLGWRGIRFTLDHPDIFLLQLKAMVRANIGNGNLSIMLPMISGLPELKQARKLINQAYEEVLGESEGDFSQPRIGMMIEVPSMLYLLPRVVGLVDFISVGTNDLTQYLLAVDRNNARVSHVYESYHPAVLLALKQIIDTANQYKLPVSVCGELAGDPIGCLLLLGLGYQSLSMNTSNVAKVKYIIRQVSQQEVEQLVATLLHHDDAEQILTDMIGFFEEKDLSGFIRAGR

SEQ ID NO: 43190 - protein, 478 aa, Legionella pneumophila str. Paris
MTTPLYPIILAGGSGTRLWPLSRQNFPKQFLKLNGELSLIQQTMKRAMGLPGNQTIIVSNDAHYFICQDQLKDFNAQTTYLLEPCARNTAPAIACAAHYLANTVGKDAVMLVLPSDHWIADDEIWLAAMLEGGQFASENNAIVTFGIKPDSPKTGYGYIEAGTTLFSNIKQVLSFREKPDAHSAAQFVSKGNYFWNSGMFICRAGVYLEELEQFEANIYQFSQQALTLAQHHHDFLRLDLDCFSQCKEESIDYAIMEKTDKAVVIPISIQWSDLGCWTAVADANKQDEQGNTLIGNVIAQDSHNCLINSEELLVTTVGIQDQIIVATSDAVLVADKRYSQQVKDLVHSLRKDHPHLTQDHQRVPRPWGYYEVLAEGTSFKVKRLMVKPGAKLSLQTHQHRAEHWVIVGGEAEVVNGNNTFRLSKNQSTYIPKNALHRLSNPHNEPLYVIEVQSGSYLGEDDIKRFDDIYLRKEVELAE

SEQ ID NO: 43191 - protein, 512 aa, Debaryomyces hansenii CBS767
MLVTLKTPTGNSISFKTGLFINNEFRQAKNGNELTTPNPATGEPLATISAATAEDIDDAVKAARKAFETTWGKKSTPSQRSEALHKWADLIDANIDTLAELESLDNGKPVWMARDVDIKDSIACLRYYAGLADKIEGRTIEQEEGVKLAFTRPEPIGVCGQIIPWNYPIQMFAWKVGPALAAGNTVIMKPAEQTPLSALVLAELAAKAGFPPGVINIVNGLGAVAGKAISSHMDIDKIAFTGSTVTGRTIMEAAAKSNLKKVTLELGGKSPVVVFDNADIDQAVNWVSQGILFNHGQDCCAGSRLFVQDTIKDVFLAKLKTNFESHVIGDPFDIKTFQGPQVSKQQQEKIQSYIKSGIEEGATLFTGGEQRLAHLSAQFKNGYYVSPTIFTDCKPGMKIVDEEIFGPVLTVQSFSTEEEAVEKANNTEYGLAAGVFSQNASQCMRMVHALRGGTVWCNHYMALSNAVPFGGMKQSGFGRELGIEGLKEYTQTKAVHWNYGEEAVWPIDGTTV

SEQ ID NO: 43192 - protein, 605 aa, Saccharomyces cerevisiae
MRIKKKNTRGNARNFITRSQAVRKLQVSLADFRRLCIFKGIYPREPRNKKKANKGSTAPTTFYYAKDIQYLMHEPVLAKFREHKTFARKLTRALGRGEVSSAKRLEENRDSYTLDHIIKERYPSFPDAIRDIDDALNMLFLFSNLPSTNQVSSKIINDAQKICNQWLAYVAKERLVRKVFVSIKGVYYQANIKGEEVRWLVPFKFPENIPSDVDFRIMLTFLEFYSTLLHFVLYKLYTDSGLIYPPKLDLKKDKIISGLSSYILESRQEDSLLKLDPTEIEEDVKVESLDASTLKSALNADEANTDETEKEEEQEKKQEKEQEKEQNEETELDTFEDNNKNKGDILIQPSKYDSPVASLFSAFVFYVSREVPIDILEFLILSCGGNVISEAAMDQIENKKDIDMSKVTHQIVDRPVLKNKVAGRTYIQPQWIFDCINKGELVPANKYLPGEALPPHLSPWGDAIGYDPTAPVEEGEEEESESESESEDQVEEEDQEVVAGEEDDDDDEELQAQKELELEAQGIKYSETSEADKDVNKSKNKKRKVDEEEEEKKLKMIMMSNKQKKLYKKMKYSNAKKEEQAENLKKKKKQIAKQKAKLNKLDSKK

SEQ ID NO: 43193 - protein, 1014 aa, Gibberella zeae PH-1
MQLTGLRALLHSAVAASRSQARSRILCRSFQTTSTWRNTGAGAGANNGDKPPNQSTAVEDEEIQPQNGTENMPGRSRVRASSSLKSRTARKQAAPALPPVKLPQEFLNDNVTLHHARTRPQLPIALAEDAKQPKTSSIFIDPQAADKNTRVSESNKALEDYFDTTFSALVEKVADRAKEITAIEPNSCETDDLVHKLTNFTRAYDMLLDSAWHLTDSLYPARHPEYTYASRPFWWWHYYKDFDRHTQEFRDQFLSVQTGLDSILDYDWRLDHSLSQAIADLPVLTFSSVRSALRRELTTPPPPDSESKNLKRQITVLSMSGYSGQAISTAVAEHVAYFNDADLIKLDAQDLSVVVGDYLEQDWAYSRGSLSHMGFRAAEMNGKLYKDPDVVARPEEEDNDPDSGVINIRTASGGLEDELSKIKQGNYDPFGKWENLKIDKVLAQILEAAELKQGSTREKPLIIHIHDFVELNMTLEGSMLITRLRNLVDVAWRQGSKIAILGTSSSEQPSEEYQSMIRDISASDFVISRHIHPQRTLMQPKPSGGTQTSDNAFPLQETDIFVENVKNINRMLKALGSHEFLDFSDAHMKIFMHATDTRAQMLKKSILPLPEVYNIASAAKRHEEEAAGAAPGGVYERLLMGPLRQRPGQRYLDEPEQDGKADGEDSQKKAEDSQTGSRVALKLNEYEKRISSGHINRQNLRTTFEDVHVPKETITALKLLTTLALVRPDAFSYGVLAQDKIPGCLLYGPPGTGKTLLAKAVAKESGANMLEISGATINDKWVGESEKLIRAVFTLAKKISPCVVFIDEADSLLANRSMLGARASHRSHINQFLKEWDGLEETEAFIMVATNRPFDLDDAVLRRLPRRLLIDLPMQPDRTAILKILLKGETLEPNVSLEELAKRTPYYSGSDLKNACVAAAMAAVEEENEAAARHTGTEPYEYPKKRILRQDHFDKALRQIPASISEDMQSLKQIRKFDEEYGAKKKGAKKMMGFGVGAEKKLADADEVRIRRGP

SEQ ID NO: 43194 - protein, 625 aa, Staphylococcus aureus subsp. aureus MRSA252
MEAYKIEHLNKSYADKIIFDNLDLSISEGEKIGLVGINGTGKSTLLKVIGGIDDDFTANVMHPNQYRIRYSSQKQDLNEDMTVFDAVLSSDTTTLRIIKQYEQAVQAYADDQSDKLFKRMMDAQDAMDQHDAWDYNAEIKTILSKLGIHDTTKYIKELSGGQQKRVVLAKTLIEQPDLLLLDEPTNHLDFESISWLINYVKQYPHTVLFVTHDRYFLNEVSTRIIELNRGKLASYPGNYESYIEMRAERELTLQKQQQKQRALYKEELAWMRAGAKARTTKQQARINRFNDLENEVNQQYKDDKGELNLAYSRLGKQVFELEDLSKAINDKVLFEHLTEIIQKGERIGVVGPNGAGKTTLLNILSGEDQQFEGKLKTGQTVKVAYFKQTDETLDRDIRMIDYLREESEIAKEKDGTSVSITQLLERFLFPSATHGKKVYKLSGGEQKRLYLLRLLVHQPNVLLLDEPTNDLDTETLTILEDYIHTFGGTVITVSHDRYFLNKVAQSYWFIHDGQMEKIIGTFEDYESYKKSLDKNKSTLKQHSKSSTTVRKKNGLSYKEKLEYEQLMKRIEQAEVRMEEIDVLMIEASADYGKIKELNEEKEQLEIQYDLDITRWSELEEIKEQQ

SEQ ID NO: 43195 - protein, 533 aa, Alkalimonas amylolytica
MAAPNSYSAATLRGDLFGGLTAGIVALPLALAFGVASGAGAAAGLYGAIALGLVAALFGGTRVQISGPTGPMTVVFAAAIAALGGSFQMALAVVLLGGMLQIIFGLLKIGGLVRYIPYPVISGFMSGIGVIIILLQLAPLLGASPSPSPLQALARLPDTLAELNWHALVLGLMTFAIVWFTPMRISRYLPSPLLALCLCTLAAVLLGWQVPVIGEIPTGLPEFHLPQFSLAQWSLIFTLGLTLALLGTIDSLLTSLVADSITRTRHQPNKELIGQGLGNMLCAFIGGLPGAGATMRTVVNVNAGGRTRVSGMVHAVFLLALLLGLAPLAAQIPLAVLAGILVKVGIDILDYRLLKRIQGTPRPEVVIMLSVFALTVLVDLVIAVGVGVVLAMGLVTWRMAKTAHIHLEDDELLDVPNDPEHPGVRLVRLSGPLFFGSMAQMLDRMDKVDQVMQTRDIVLDCRGVDYMDLTAVFAIEDMLQKLQQKKLRPRLLLDDEALRQRLLGLQSNVFTEQTLCTSVEQVLQDCCNASDGR

SEQ ID NO: 43196 - protein, 471 aa, Saccharomyces cerevisiae
MSRSLLVENSRTINSNEEKGVNESQYILQKRNVPRTILGNVTNNANILQEISMNRKIGMKNFSKLNNFFPLKDDVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLAINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 43197 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 43198 - protein, 661 aa, Alkalimonas amylolytica
MLLDGTLIQLLFLLGFMVFMVMLFQRAHIPASIAYLLVGVLLGAHTAGPVISEGYIHKIAEFGIVFLLFTIGLRFSWQQIYQLRHTILGLGTAQVGLTTLLVALLLWAMGVASVVAFVIGAVFAQSSTTIISKQLLEQGEDQSRHGRLGISLSVFQDITAVPFIIVIPVLGVAMAQDIASTLGMALFKAVLATALVVLVGRYLLRHLFHRVSSSDSAELFTLTVLLVCLAAAWLTQSLGLSMAFGAFLAGMVMGETEFKLQVEAAIRPFRDVLLGIFFVSIGMLLDPMLLPEIGHIALAGALLLLLIKIVLVTALVLATGVALETAFRTGLILAVGGEFGFALLALALEGGTLDSRSSQIILTSVLLSMMLAVFLIRYNLQLSRFVVGRWIGQAAVSSEPFDDIEQHGLQQHVVIAGFGRIGQGVAQFLQKEQVPYIGLDLDAARVKNARLADVPVFYADSTDPDTLIAVGLAKARLLVISHEDLSAALTTLRHARTLHPDLPVIVRTRDESHVAELRQAGATEVIPETIEAGMMLTSHVLLMLNVPARRVNQLVQEQRINRYQLLRQQFRGSADLLKTQQQEQLKAVLLAEGSPAIDQSLQMLDLAQYGIQLTELVRAHNRIEQPSLDMVLQENDVLVLFGSAEALEQASLVLTHRLAAD

SEQ ID NO: 43199 - protein, 515 aa, Oryza sativa
EPPRLPWNFELFKMPRRTDNAASANSVEPEKSEECLEFDDDEEEEVEEEEIEYEEIEEEIEEEEVEEDEDVVEEVEEVDEEEDEEEEEESDETEGVSKTKGVHQKDVTEKGKHAELLALPPHGSEVYVGGISSDVSSEDLKRLCEPVGEVVEVRMMRGKDDSRGYAFVNFRAKGLALKAVKELNNAKLKGKRIRVSSSQAKNKLFIGNVPHSWTDDDFRKVVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGGRYGGGGGSSGSSRPGAKRQRGDDNSSSRHKGRRRPY

SEQ ID NO: 43200 - protein, 574 aa, Alkalimonas amylolytica
MEAINLTILVIGVLFLISIVATLISSRIGAPILLVFLIIGMLAGEQGLGGITFNNPQVAFLIGSIALVIILFDGGMRTHPERFRVALAPAAMLATLGVVVTCTVTGLAAAWILGLHWLQGLLLGAILSSTDAAAVFSIFQSRGIRIKDRVASTLEIESGSNDPMAVMLTITLVGVLAEYTALDWSVLIVFLKQAIIGGAVGYGAGRLFVFLCRKLPLSFAFFPLMAVACCISVYAVTTQFEGSGFLAVYLMGYFVGNARLPQVLYILRVHDGLAWLSQIVMFLMLGLLVVPSQLLDHLLPALAIAGVLIFIARPLAVLLSLIPFHFPAKDQLFISWVGLRGAVPIILALFPWLAGVPDEHLYFNVAFVIVIVSLVFQGWSISPVARWLKLEVPKESGPDQTMPLDAIASNEVIEVVSFTLKGDSPMLDKQWQDFTVPHSAEFLGVIRDGEWLLSRDNPVFKLKDSVLVLCKMADVPDISTVLASAASSRTMTASDFFGDFVLNAQITLDELDAFYSITLPEHESHVTLADYITERFHRRVVVGDQVKLDALVLTVRQLDDHGNVKLVGIKPSDS

SEQ ID NO: 43201 - protein, 244 aa, Zea mays
MAAADATRPLLVAISLAVAACCLAQLAVGDTNGVYEPCSDARIQRGDGFTFGVVFAGYNAFFSGNTQLSPCDRRLNLAASGQLAVFRPKVDEISLLTINTTTGFNPASAGGFMVAFAGRKYAARSIPIFVSNTSVTVSSFTLVLEFNKGRLQNLHWKKDGCGACSGKSNFVCLGKQTCAIRTQSCKSQGPVDCSVGIQLAFSGTDKHESVLNSWYEVSNLRQYSLYGLYSNLKDTLSGQFNKIF

SEQ ID NO: 43202 - protein, 403 aa, Streptomyces coelicolor A3(2)
MHNTTAVLIELGAIILALGLLGRIAGRVGFSPIPLYLLAGLAFGHGGMLPMQASEEFTATGAEIGVILLLLLLGLEYSASELVTNLKTQYPSGAVDFVLNAVPGAVAALVLGWGPVAAVALAGVTWISSSGVIAKVLGDLGRLGNRETPVVLGVLVIEDLAMAVYLPILTALLAGVSLAGGAVTLLISLGTVGAVLYLALRHGRLISRAVSSDSAETLLLVVLGLTLVVAGLAQELQVSAAVGAFLVGIALSGEVAEGASSLLTPLRDLFAAVFFVFFGLSTNPADIPPVLVPALLLAAVTALTKVATGWYAAHRAGLRGAGRWRAGGTLVARGEFSIVIAGLAVGVEPRIGPLATAYVLILVVIGPLTARFTEPLARRLTRGPRKAAPATATTPAESTHANA

SEQ ID NO: 43203 - protein, 351 aa, Enterococcus faecalis V583
MYEGLLKQYQAYLPVTEKTPMISLAEGNTPLIPLPNLSKELGIQLYGKYEGLNPTGSFKDRGMVMAVAKAVEEGAKAIVCASTGNTSAAAAAYATRAGIKAYVVIPEGKIALGKLAQAIMYGADIISIPGNFDEALKAVREIAKTEAVALVNSVNPYRLEGQKTAAFEVCEQLGQAPDVLAIPVGNAGNISAYWKGFKEWHEKQGTTLPRMHGFEAEGAAAIVKGQVIEQPETVATAIRIGNPASWQLAEQARDESGGFIDAVTDQEILTAYRKIAAQDGVFIEPGSAASLAGVIQHVKSGKIKAGETVVAVFTGNGLKDPDTAMETEVAISKMSDVEEMRLHLRKGVATL

SEQ ID NO: 43204 - protein, 514 aa, Streptomyces coelicolor A3(2)
MTLSELYVMLLIGGTVLLASIAAARAAHRIGLPSLLLFLCVGLVAGEDGLGLRFDDAQLAQALGAAALALILVEGGLTTRWSDVRKLLAPAGVLATVGVVISVVVTAAGAHWLLGIDWRLALLIGAIVSSTDAAAVFAVLRALPLPRKVSVLVEAESGFNDAPTIILVLLFSTTSDLPGPLPVVGNLLFQLVVGGVLGVVTGRLGVAALRHIALPATGLYPLATVGFGVVAFAAAGALGASGIIAAYLSGLVLGNAKLPHRAATRSFSEGVGWLAQIGLFVMLGLLVDPSELPSAILPALVVGLVLLLLARPVSVLLCLLPFRVPWREQVFISWAGLRGAVPIVLTTFPVVAGVTGARDALNIVFVLVVLFTLLQGPTLPAVARWTGVTRPDALREIQVETAPLDLLDADLLTVSVPPGSRLHGVTVFELRLPHPTAVTLVVRDGASLVPDRDTVLRAGDELLLITTPQVREAAERRLRAVGRRGKLARWLGEHGTPESEPLLPMHPEKHHNAQ

SEQ ID NO: 43205 - protein, 642 aa, Clostridium perfringens ATCC 13124
MNLITLENISKSYSEKILANNVSLGINEGEKIGLIGVNGTGKSSFLKIVAGVEEPDEGTVTKGNRVRIEYLAQTPDYDDNATVLEQVFKGNSEEMRILREYEELLEKIDKGEVKENDSERLIRLQGKIDALNLWDMESEAKNVLTKLGITNFEEKVGNLSGGQKKRIMLAAALITPCELLILDEPTNHLDNETISWLEEYLNSRKGALLMITHDRYFLDRVTNRILELDRGRLFSYDGNYSVFLEKKMERIAIEKASEEKRQNLMRKELAWVRRGAKARTTKQKARLQRFDKLVNQEGFIENENIEISVMGTRLGKKIIEIEHLNKSFGDKKIVDDFNYIVLRSDRIGIVGPNGIGKSTLMGMIEGKVAPDSGEIIKGETVKIACFSQEDTHMHPEMRAIDYIKEAGEYLQTATGERITASQMCEKFLFDGTLQWTMIGMLSGGERRRLHLLRVLMEAPNVLLLDEPTNDLDIETLNRLEDYLDDFGGVVITVSHDRYFLDRICNKIFSYEGNGKIDIYTGNYGDYLLSKEEDAVNNKEKEVAVDKNKKEPSVDKNKNKGKVLKFSFKEQREFETIDEEIMTLEEKIEELDSLMAKHASEYGRLQELMEEKSKVEEELAFKYERWEYLNELAAQIEENKKNK

SEQ ID NO: 43206 - protein, 122 aa, Bradyrhizobium sp. ORS278
MTDTIFIKGVLIHARHGVMEHESEVGQRFVIDLELYTDLSDSSRSDRLADTVSYSDVVETATAAFKDTNYRLLERAAGAVADAILSTFVRIRAVKVTVHKPHAPIAAIFEDVGVVLTRSRHP

SEQ ID NO: 43207 - protein, 260 aa, Enterococcus faecalis V583
MKIGFIGAGSMGGAMIKGLLKAEAVKKEHLYVKGGSSGTAEALQKEWGFQLVTDYALFQECKVIFIATGAKVVLPVLQELAPHFSNESLLISVATGHTIQEAQMALGNKEAKVVHAIPNTPVSVNQGVIGVALAPTIEGQTKDLAMELLATLGLVKEIREAQLETFGTVAGCSPAFVDIFMEALGDAAVLEGLPRDLSYEIVAQMIKGTATLALDTKKHPGALKDEVTSPGGSTIRGVVALEKNGFRYAVMDAVQQANHE

SEQ ID NO: 43208 - protein, 376 aa, Brassica napus
  misc_feature (210)..(210): Xaa can be any naturally occurring amino acid
MSCSVCNSPVFSPSSSLFCSKPSIILSSPQETISLTLSHLKPSSPSAAAASLNSPFRLRLQKPPTGFSPASCTGQSPPGEVLKRKRPTRLDIPIGTTGFVAPATPREEGREVEREGDGYSVYCKRGRREAMEDRFSAITNLRGDRKHAIFGVYDGHGGAKAAEFAAKNLDKNVLEAVAGKRDESAIADAVNAGYLTTDAAFLNENDVKGXGSCCVTAMFSDGNIVVSNAGDCRAVMSVGGVAEALSSDHRPCRDDERTRIETTGGYVDTFRGVWRIEGSLAVSRGIGDAHLKKWVIAEPETKTLRIDQDHEFLILASDGLWDKVSNQEAVDIARPFCLGTEEKPLLLGCKKLVDLSASRGSLDDISVMLIPLDQFI

SEQ ID NO: 43209 - protein, 427 aa, Solanum melongena
MSSSIALRQARHLTTAAAAAAESASAATISISKAKSKLKAEHDPDKALEIYSSVSDRYISPLSSRYAQEYIVKRLAKSHRFSDIENFLESHKNSPKITQEPFLSSIIRSYGVARMFDHALKIYHQMDDLGTPRSAISFNVLLSACMHSKLYDRVAQLFDEIPVKYGFLPDKVSYGVLIRSYCEMGLPEMAMERFKEMEEKGVEITAVAFTTILHSFYKKGKSDEAERVWNEMVSRGCGPDVGAYNVKIMNIQGSKPEGVKALIEEMSNAGLKPDTISYNYLMTCYCKNQLMDEAQKVYEDLKTNGCNPNAATFRTLIFYLCKKGRFETGYKVFRESVSVHKIPDFITLKYLVEGLVKKSRWRDAKGMSRTVKKKFPPNLVKAWIKLEEDLGLAKVEASDNAKVEASDNAKVEASDNAKVEASDNGVQ

SEQ ID NO: 43210 - protein, 599 aa, Streptomyces argenteolus
MAAVGGRLGSSLEVVELTIALHRVFDSPVDPIVFDTGHQAYVHRILTGHANGFGALSGENGFSGYPSRGEGEPDLAGDSHTSAALSYADGLAKAFALREVRRAVVTVVSDAALTGGMCWEALNNIAVAKDRQVVIVVNDNGRSYASAFGGLARHLSVLRLSPAYESLLLGVREGLSGTTPLGDRLFTMLKLVKNGLKDMLSPQALFEDLGIKYIGPVPGHDLRGLEQAMRRAKRFGGPVVVHTVTRKGQGYRPAGDDAIDRPHTPGGFTRSAARQAALPVTRWTDVFAEELVSLARERDDIVGVTTGMSGPTGIAGLARAFPDRVFDVGVAERHAATSAAGLAMGGVRPVVAIRSTFLNRAFDQIIMDVALNGLPVTFVADHAGITGSDGPGHNGIWDLAVFGVVPGMRIAAPRDAVTLRAVLREALAFADGPTLIRFPAGAVLEALPEVGTVGGVDVLHHDDRREFLLVAVGRSAVWESTRRAVWPTKATVPPSSLPAGCFPYRTPWWISPVPTGSFSPSKTACVWGASETPSPGCRDNGVGTPVRTFGILDGRHAHGTREEVLADLGLTADALAETAMKLAVSGQDRPSPAVHPVTT

SEQ ID NO: 43211 - protein, 527 aa, Vitis vinifera
  misc_feature (43)..(43): Xaa can be any naturally occurring amino acid
  misc_feature (239)..(239): Xaa can be any naturally occurring amino acid
  misc_feature (424)..(424): Xaa can be any naturally occurring amino acid
MATESSFPTIGEIVSGIVSNVVSALVKWLWSLKSTTNTAISSXSKMNFEDGYTVETVFDGSKLGIEPYSLEVSTSGELLVLDSENSNIYKISSPLSRYSRPKLVAGSPDGYSGHVDGKLREARMNHPKGLTMDERGNIYIADTMNMAIRKISDAGVTTIAGGKWGRGGGHVDGPSEDAKFSNDFDVVYIGSSCSLLVIDRGNQAIREIQLHYEDCAYQYNGSFHLGKLRLANFVIAITXPWLWRFMRRFSLIAVAGIAVLVAAGFFGYMLAYAACTLFLLMETCQSSFANSFHDKSSDSSTPMKKGMPPESYQRPLKSVRAPLIPTEDEYEKADEGFFGSLGRLFLNTGSTLAEIFGGLFSGSRKKPPHQQIQQQYGQPNVHSNGWPMQESYVIPDEDEPPSIESRAPTPKKTYPFMTPEMEKXHHFRQSRTFYSNGWDGNYQQLQQKQIQQKQQYQQHHQKHYSSNPQTYYEQSCETKNEIVFGAVQEQDGRREAMVIKAVDYGDPVYNHHNIRPRLNYMGYSHAY

SEQ ID NO: 43212 - protein, 328 aa, Glycine max
MANFTSSSPLPLTLTMSHISTPSSSAAFDDSSEDACSICLEPFSTHDPATITSCKHEYHLHCILEWSQRSKECPICWQLLILKDPASQELLNAVEAEKRLSSRTVYSHAFTDSRSPLHRLNNDQDDSDFDEQLTQHLVSAASRARYICRGERQRSPGAGPSEVLVFNSSMHASGMQSTLTTSPSSGVPSTSAFSSVGMVTTNTSSESDMPCKPRVIYSQPSPENARRLNTSEIFSFPESFKSKLSAASARCKESISKNTRGLKEKLIARNASVKELSKGVQREMNAGIAGVARMVERLDLTSKRSSSPLIPVNRLREVCSREWHWGFS

SEQ ID NO: 43213 - protein, 827 aa, Oryza sativa Japonica Group
MPLLHHVLLGFLLILLYLRTPTSSTATDTVSPGHALVGSDRLVSNNGKFALGFFKPGNESYTNHNSYLGIWFNKVPKLTPLWTANGNNPVVDPTSPELAISGDGNLAILDHATKSIIWSTHANITAKDTIAILLNNGNLVLRSSSNSSIIFWQSFDYPTDTLFPSAKIGWDKVTGLNRRLVSRKNSIDQAPGIYSLELGPNGDGHLLWNSTIAYWSSGQWNGRYFGLTPEMTGALMPNFTFFHNDQEAYFIYTWDNETAIMHAGIDVFGRGLVATWLEESQDWLIYYRQPEVHCDVYAICGPFTICDDNKDPFCDCMKGFSVRSPKDWELDNRTGGCIRNTPLSCGSRTDRTGLTDKFYPVQSIRLPHSAENVKVATSADECSQACLSNCSCTAYSYGKSGCSVWHDELYNVKQLSDSSSDGNGEVLYIRLAAKELQSLERKKSGKITGVTIGASTGGALLLIILLLIVWRRKGKWFTLTLEKPEVGVGIIAFRYIDLQRATKNFSKKLGGGSFGSVFRAMLRLFSTTIRGHRSGYPVFKGYLSNSTIAVKRLDGARQGEKQFRAEVNSIGIIQRINLVKLVGFCCEGDNRLLVYEYMPNSSLDVCLFKANDIVLDWTTRYQIAIGVARGLAYLHTSCRDCIIHCDIKPENILLDASYVPKIADFGMAKILGREFSRAMTTMRGTFGYLAPEWISGTVVTSKVDVYSYGMVFFEIISGRRNSSHENFRDGDYSFFFPMQAARKLLNGDVGSLVDASLEGGVNLVEVERACKIACWCIQDNKFDRPTMGEVVQSLEGLLELDMPPLPRLLNAITGGSHPVTPQYFDSL

SEQ ID NO: 43214 - protein, 390 aa, Corynebacterium efficiens YS-314
MGSDCLHRRTPPMTDMFDLIDDWGPEKIVVVHDHRTRMRGVLVIDNTARGMGKGGTRMQPTVSVGEIARLARVMTWKWAGVDLFYGGAKAGIQADPASPDKEAVLRSFVRKLSNEVPEEYIFGLDMGLTEHDAAIITDELGRGTCMGTPYELGGVPYDQLGVTGYGIAEVADEVAQSQNLAGASVAIQGFGAVGHAVAERLHTLGYRVVAVSTARGAIADPNGLDIPELVRLREEVGDDLVSHYPVLRIDPGEELFMDAEILIPAALQDVINARGAERVTARIVVEGANLPTSPQAQQILHQRGITVVPDFIANAGGVVAAAFAMDNRFSPFRTDPEQIYTSVSSKLRLNATTVLGRAAERSQTSHDAARQLSQERVRAAMEVRGMLPSG

SEQ ID NO: 43215 - protein, 359 aa, Rhodococcus sp. RHA1
MSLTLGIVGLPNVGKSTLFNALTNNDVLAANYPFATIEPNVGLVELPDPRLSELARIFGSERILPATVSFVDIAGIVKGASEGAGLGNKFLANIREADAICQVVRVFNDDDVVHVDGRVDPASDIEVIETELVIADMQTLEKALPRLEKEAKKNKELKPIHEEALKAQEVLDEGKTLFSAKDKLDFSLLRELSLLTTKPFLYVFNADEAVLTDDAKVAELRASVAPADAVFLDAKVEQELLELDEEDRQEMLDSIGQSEPGLHALARTGFHTLGLQTYLTAGPKESRAWTIHKGDTAPQAAGVIHTDFERGFIKAEIVSFDDLIAAGSMAAAKAAGKVRMEGKDYIMADGDVVEFRFNV

SEQ ID NO: 43216 - protein, 428 aa, Bacillus anthracis str. Ames
MVAEKGTQTKTQQQREQHFELLNSTQIVISEALEKLGYPNEVYELLKEPIRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRDIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAGGVTVSYFEWVQNNQGYYWTEEEVEQRLEKVMVRSFDSIYETAQVRKVNMRLAAYMVGVRKMAEASRFRGWV

SEQ ID NO: 43217 - protein, 279 aa, Conotrema sp. 2-MW-2004
SIEHGAVNVVAVNDPFIEAEYAAYMLKYDSTHGQFKGEIKVDGNDLVVNGQKVKFYQKKDPADIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 43218 - protein, 487 aa, Mycobacterium tuberculosis CDC1551
MPPLDITDERLTREDTGYHKGLHSRQLQMIALGGAIGTGLFLGAGGRLASAGPGLFLVYGICGIFVFLILRALGELVLHRPSSGSFVSYAREFYGEKVAFVAGWMYFLNWAMTGIVDTTAIAHYCHYWRAFQPIPQWTLALIALLVVLSMNLISVRLFGELEFWASLIKVIALVTFLIVGTVFLAGRYKIDGQETGVSLWSSHGGIVPTGLLPIVLVTSGVVFAYAAIELVGIAAGETAEPAKIMPRAINSVVLRIACFYVGSTVLLALLLPYTAYKEHVSPFVTFFSKIGIDAAGSVMNLVVLTAALSSLNAGLYSTGRILRSMAINGSGPRFTAPMSKTGVPYGGILLTAGIGLLGIILNAIKPSQAFEIVLHIAATGVIAAWATIVACQLRLHRMANAGQLQRPKFRMPLSPFSGYLTLAFLAGVLILMYFDEQHGPWMIAATVIGVPALIGGWYLVRNRVTAVAHHAIDHTKSVAVVHSADPI

SEQ ID NO: 43219 - protein, 346 aa, Novosphingobium aromaticivorans DSM 12444
MTDTVPVVLCGGSGTRLWPRSRKQKPKPFLPLVGENTLFAQTVLRCGRDAGFSPPVVVTGAAHLAHVEEQLPDRASTRIIVEPEGRNTAAAIALAALSLPEDAVMLVCPSDHHIGDCEAFQAAAREAVALAVEGWLVSFGIVPTAPETGFGYLKQGEPIAGTVGRRVQRFVEKPDLARAMEFLASGEYAWNGGIFAFRAGTFIDELGKYRPAILAAVRDAVGRGKWDGMRFHPDAAAFSRVESESVDYAVMENTDKAAMVPAVMAWSDIGNWQALHEALDRDEHGNAVRGPAELRDCSNVLVMSDGPRVSVVGASNLVVVVDGDEVLVCTPEGAQSVGKLSGAANQ

SEQ ID NO: 43220 - protein, 440 aa, Exiguobacterium sibiricum 255-15
MRTYDCIVIGTGSAGNQAAYKFAEKGLNVAIIENFTPGGTCAQRGCDAKKILLTGSEAKDAVERLLGYGLKGLVSIDWRQLMERKNEYTRAIPEQTRNRYDEVGIDYYHGEPRFLSNKKLLVDDIELEADQFLIATGLRPRELSVPGSERFLNSNEFLELRDVPRRLVCIGGGYISFEFAHLARIAGSEVTILLRSGALKQFEQDLVSVLLEATQALGIKILHETEAVSYSDTTLTLSDGTRLEADVVLNATGRVASIEHLQLEKAGVIYEEKGIHVNDYLQSSASNIYAAGDVAVSGNPALTPFAGTEGRLAACNMLEGNTRRLELLPVPSIVFTTPNLAKVGQTEASLKQNNTRYRGKLIDTSSWQTNVRIKDPFARAKVLIGEDDQILGAHFIGVHAAELANYFSFAMQHRIPSSALQKTSFAYPTPASDIASLLED

SEQ ID NO: 43221 - protein, 273 aa, Shewanella oneidensis MR-1
MGVIARLKEDIESIYHRDPAARSAFEILVNYPGMHAIWLHRISHKLWKRDWRLMARCLSTFSRWLTGVEIHPGATIGNRFFIDHGMGVVIGETAEIGDDCTLYHGVTLGGTTWQAGKRHPTLGNNVVVGAGAKILGPITMHDGARVGSNSVVVKDVPKDTTVVGIPGRVVATPSPQSKEKSERRSAMAKKYGFDAYAVSPDNPDPVANAIGQMLDHMHLMDSKVQELCQAIQRLGGDVCTERLPELNVGDFNDVEKAAADKRQSALDEFDPSI

SEQ ID NO: 43222 - protein, 257 aa, Stictis sp. 2-MW-2004
AYMLKYDSTHGQFKGEIKVDGNDLVVNGQKVKFYQKKDPADIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 43223 - protein, 138 aa, Brassica napus
MADYEDETDQQNQPFIPKETALQALNTIIQLHFEKTLEKKRAIDHQKKKLHKLFQLFFIFLALIFFSLSQPSGRLRCRHCWAPIVLLSFSHLFFYVSVAQTLRCINGFKYQRRCHKLTLGLATHKLRFIKSRIAAGDF

SEQ ID NO: 43224 - protein, 357 aa, Streptomyces argenteolus
MNEAGAGGGQRALTEEASVSIDAVLKEMHGYVANARRHMTSAFDELAESWQTSPVRDVVHYALDEPGKMIRPTITLAACQAVGGDPEMFGRVAAGIEYGHLASLMHDDLIDEDATRRRIPSVWNAFGVPSAVIAGDLLLFTAFHALACQQGVPAERIVRTFEAVTRSGVDACFGTSLEMALAGNISISTETYLKMAAGKTGAVLRGCSEGGAVIGGGSPRQIASLRDYGEDLGVAFQIIDDVLPYESDEETMGKPVVSDLRNRRPTLPVLLARDECTEDERDFLETVYSTGIGDGPAAEAAHHRMRAVLRRTGALAGAREMADEYCASALDSLAGLRDNAGVRLLRSLVHLARDRRA

SEQ ID NO: 43225 - protein, 326 aa, Bacillus anthracis str. Ames
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGSKEIYIAKYIVVATEYYDNPNYMNVPGEELKKVAHYFKEGHPYFDRDVVVIGGKNSSVDAALELVKAGARVTVLYRGSEYSPSIKPWILPEFEALVRNGTIQMHFGAHVKEITEHTLTYTVDGEANTIQNDFVFAMTGYHPDHSFLTKMGVRIDEATGRPIYAEDTMETNAANIFIAGVIAAGNNANEIFIENGRFHGDAIAQTIATREI

SEQ ID NO: 43226 - protein, 127 aa, Shewanella oneidensis MR-1
MAYSEKVIDHYENPRNVGSFDKNDPSVVTGMVGAPACGDVMKLQLKIGADGIIEDAKFKTYGCGSAIASSSLVTEWVKGKTIEQAAAIKNTDIAEELALPPVKIHCSILAEDAIKAAIDEYKSKQAK

SEQ ID NO: 43227 - protein, 513 aa, Gibberella zeae PH-1
MFKSGISSFARAARPAVLPRRALRPSALRLPISSRWASTGVGAGKIHQVIGAVVDVKFDGAKLPAILNSLECQNNGQKLVLEVSQHLGESVVRCIAMDGTEGLVRGATVQDTGAPITIPVGPATLGRIMNVTGDPIDERGPIKTDKRLPIHTEAPEFVEQSTSAEVLVTGIKVVDLLAPYARGGKIGLFGGAGVGKTVFIQELINNIAKAHGGYSVFTGVGERTREGNDLYHEMQETSVIQLDGESKVALVFGQMNEPPGARARVALTGLTVAEYFRDAEGQDVLLFIDNIFRFTQAGSEVSALLGRIPSAVGYQPTLAVDMGGMQERITTTQKGSITSVQAVYVPADDLTDPAPATTFAHLDATTVLSRGISELGIYPAVDPLDSKSRMLDPRVVGQEHYDTATRVQQILQEYKSLQDIIAILGMDELSEADKLTVERARKIQRFLSQPFTVAQVFTGIEGKLVDLKETINSFKAILSGEGDNLPEGAFYMVGDFASAKAKGEKILAELEGQ

SEQ ID NO: 43228 - protein, 247 aa, Oryza sativa Japonica Group
MSAKRKLKAMSTCQSLLAACQISRKSDRPRERHARAFDCSFVSPDRAMVDVDVARDGAAARANGEASSSSSSSSSSGGEEAVVVVDMASSLPSVLRGCACADGGRLLRDACHGAARGLAAWTRRGGAARALLVASVGSVALAALTVLLVAAFVLVAAATSAAAVAAVVSLAALSALLAVAYVGALSVAVFVVAATTAATVVAITIATDQIREPTSRPNQWVTRRGFIVDPLAALSLRQTKIELQLRY

SEQ ID NO: 43229 - protein, 385 aa, Vibrio fischeri ES114
MSKSALLVLEDGTVFHGQSIGADGSAVGEVVFNTSMTGYQEILTDPSYSQQIVTLTYPHIGNTGINSEDEESSSIHAQGLVIRDLPLLASNFRSEQTLSEYLKSQNIVGIADIDTRKLTRILREKGAQNGCIVAGTNLDEAFALAQAKEFPGLKGMDLAKEVTTSEAYQWKQGSWTLTGGLPEEKADSELPFHVVAYDFGAKRNILRMLVDRGCRLTVVPAQTSAEEVLAMNPDGVFLSNGPGDPAPCTYAIEATKVFLEKGLPIFGICLGHQILALASGAQTVKMKFGHHGANHPVKDLERDVVMITAQNHGFAADEETLPENLRATHKSLFDGTLQGIHRTDKPAFSFQGHPEASPGPHDAAPLFDHFIELIQQSIADKTNKA

SEQ ID NO: 43230 - protein, 493 aa, Oryza sativa Japonica Group
MLISPKEQLMFTGRGSVFAQSYLEEIYVMLLQGKCLHKPLSMDDMVVSALGRVHLRDGILMRPIAESRRAAIINSTWFEAMKLLKQMLAYANPHNFDLPPDFLHLCNTMENRYEPKGMNIPYHASLLPLHSRQQALLDAFNLLTNRMNFRYASWISCELPHRTEWPQVLHGNNFLRQWFRDKQWLNDDGTIKVPTGIEFLWAHRVLCCHSDDYARKGVCMYTWEQLHLLIHGKNPLVLPDLHLKLMRADRFPSMAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASYNNFPTAAGLASSVAGLVCFVFTLGNLMNVKEDYGELSSIARQGSGSACRSIYGGFVKWCMGKNNDGSDSIAVQLADEAHWNDLVIIIAVVSSKQKETSSTSGMRDSVETSPLLQYRAQRK

SEQ ID NO: 43231 - protein, 335 aa, Streptomyces resistomycificus
MRIAVTGSIAMDHLMSFPGRFAEQLVADRLHSVSLSFLSDRLEIRRGGVAANIAYGLGRLGMSPVLVGAAGADFFDYQVWLGQHGVDTDSVLVVPGEHTARFVCTTDADHNQIATFHAGAMRAAYTIALRDVRARVGELGLVVVSPNDPAAMLRHTEECRGAGLPFVADPSQQLARMDRADVRFLLSQARWLFTNEYEAALLQECTGWGAARVLDRVGTWVTTLGAGGVRLERAGHDPLVVPAVPGVPVADPTGAGDALRAGMLAALALGVPAEPAARLGCALASFALESVGTQTYAPGDRAVAGRVREVYGERALAELAPVPGLTAVTQKARLS

SEQ ID NO: 43232 - protein, 147 aa, Zea mays
  misc_feature (3)..(4): Xaa can be any naturally occurring amino acid
  misc_feature (52)..(52): Xaa can be any naturally occurring amino acid
  misc_feature (125)..(125): Xaa can be any naturally occurring amino acid
  misc_feature (143)..(143): Xaa can be any naturally occurring amino acid
LDXXAEKADTSTPAGLSYVLTETTLALLRHPDCCISAYSSLSIEERGKFDEXTLVNVNSIKRNKGGSQRSSGFSNEYIVITILVAAEGVHKVPVINSSNDLKTALQKMGAIPSRKILAVEVLWTXQNENDTLSERELLEDYPXLRPL

SEQ ID NO: 43233 - protein, 186 aa, Xylella fastidiosa Dixon
MSVLNTEILSFKAIAYKNGQFVEVSEAVLKGKWAVFVFYPADFTFVCPTELEDLADHYEEFQKYGVEIYSVSTDTHFSHKAWHDISPAIGKIKYAMIGDPTHEISRNFNVLRPSGLADRGTFIIDPQGVIQSVEITAEGIGRDAKELLRKVKAAIYVANHPGEVCPAKWEEGGKTLAPSLDLVGKI

SEQ ID NO: 43234 - protein, 334 aa, Arabidopsis thaliana
MATATSHQSVVSFASLRSSPSSTISQCGFKIDSSLSFTSKKTNFCKIKAMASSVSFNNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 43235 - protein, 334 aa, Idiomarina baltica OS145
MSRKITVIPGDGIGPDIVKSALAILEKAGCEFDYEFVDAGLTALEKTGELLPQATLDAIAKNGVTLKGPLTTPVGEGFTSINVSLRKRFGLYANLRPVKSFKGTQARYDNIDIITVRENTEGMYSGLGQKVSEDGSEAEAMSKITRAGAERIVRFAYDLARREGRKKVTAVHKANILKSTSGLFLKVAREIADEYPDIESAEMIVDAACMRLVMNPEDFDVLVTTNLFGDILSDLCAGLVGGLGMAPGANIGKDCAIFEAVHGSAPDIAGKNLANPSSVILAAVQMLEYLEMPEPAEKITRALAEVIESGDRTTRDLGGSHGTTDFTDAIIERL

SEQ ID NO: 43236 - protein, 175 aa, Zea mays
  misc_feature (168)..(168): Xaa can be any naturally occurring amino acid
MDRMRDALERAKMLVGMEFDEESAPPPPEEQSFFDDINRHCTLNTTQRLYGFAICLAAGLTCTFLSMIVFFNPVKFGVTFTLGNAMALGSTAFLIGPKRQVDMMLDPVRIYATAIYIASIIISRFCALVVHSRLLALLAIGLEVGALSWNRLSEIPFARTGVSTARAXCIDAEFW

SEQ ID NO: 43237 - protein, 157 aa, Brassica napus
MATEDVNEALAAAEVPATETTEKQPADKLERKWSFWFDNQSKPKQGAAWGASLRKAYTFDTVQDFWGLHETIFIPSKLTPNAEIHMFKAGVEPKWEDPECANGGKWTFVVTSNRKPALDKAWLETMGIGKKWKEILDVTDKITFTNHDDSRRTRFTV

SEQ ID NO: 43238 - protein, 489 aa, Burkholderia thailandensis E264
MHTDSSFTFVLFGGTGDLSMRKILPALFEAHRANMLSETGRIVAVARHAADRDGYLQWVEEHVKPHAAKAAGRAFDEAAWRSFLERIVYVKLDLGRAEDYALLRDTVGGLSGIRVFYLATGPSLFVPICKALAAVGLNEGARIVLEKPLGYDLRSSNAINDAVGEIFAEDQIYRIDHYLGKEPVQNLLALRFGNALFEPLWRREWVESIQITIAEELGVEARGDFYDNTGALRDMVQNHLLQLLSIVAMEPPHSMDSDSVRDEKLRVLRALKPVDPRDIGKVAVRGQYHAGVIKGAQVPAYATEPGVKADSQTETFVALKVEIENWRWAGVPFFLRTGKRLADRVAEIVVNFRPVPHSALGPTALRAGANRLVIRLQPNESIRLYCLAKQPGEGMNLASVHLDLAFDQFFKEGQMEAYQRLLLDVINGRLALFVRRDEQEAAWRWVEPILNEWARSTKPPKPYAAGTWGPAAASAMLAQHGTCWLEEEN

SEQ ID NO: 43239 - protein, 145 aa, Moraxella osloensis
EPAIAKKATTQAELTPHPRIEHIIVVASGKGGVGKSTTTVNIALALQKLGKRVGVLDADIYGPSIPSMLGVAGQQPQLEHEQFVPIAAQGMPMLSIGSLLSDDTTPIAWRGAKATGALMQLHNQTNWPNLDYLVIDMPPGTGDIQ

SEQ ID NO: 43240 - protein, 279 aa, Stictis sp. 3-MW-2004
SIEHGAVNVVAVNDPFIEAEYAAYMLKYDSTHGQFKGEIKVDGNDLVVNGQKVKFYQKKDPAEIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSSDLNGDNNSSIFDAKAG

SEQ ID NO: 43241 - protein, 324 aa, Bacillus anthracis str. Ames
MKRILVLHTGGTIAMEEDKETGVVQPGEKNPLLKFIPDLEGDVDLIVEDVFHLPSPHMTPSEMLQLQVIIDERVKQDNIHGVVITHGTDTLEETAYFLDLTVQATIPIVVTGAMRSSNELGADGLYNFLSAVKVASSSEAAEKGVLVVLNDEIHCATNVTKTHTSNVATFQSPQYGPIGMVTKRGVVFHHALVHHETYSVNKVSKNVVVLKAYAGMDDTLLAAIENLPVDGIVIEALGQGNLPPRTLPSLERLINKGIPVVLVSRCFNGIVQDVYSYEGGGKQLKDMGIVFTYGLNAQKARIKLLVALENTTSHEAIQNMFMHD

SEQ ID NO: 43242 - protein, 308 aa, Pseudomonas sp. B11-1
MPLDKQIAAVLQQFSELPAPDFSQLDAAQYRQFCDNLLPAIPGDPMIEVRNLRVAAAAGELDARLYRPLEEDNLPLLVFFHGGGFVMGNLDTHDNLCRSLASQTEAVVVSVAYRLAPENHFPAAPLDCYAATCWLVEHAAELGVDGRRLALAGDSAGGNLALAVSRLAAQRQGPKISYQCLFYPVTDARCDSQSYEEFAEGYFLTGAMMYWFWQQYLQDTGQGDDPLASPLRAETLADLPPTTLITAEFDPLRDEGEAFALRLQQAGVSVRVQRCEGMIHGFISMAPFVERAAHALSDAAADLRRALN

SEQ ID NO: 43243 - protein, 540 aa, Corynebacterium efficiens YS-314
MGVFPGGFCMPAGIPPISRWHPRTINPGAPVPVAWWGQSHLSRKDTPMTDPLDVSALLTKVPTGLLIGDTWRDSSDGSTYTVDNPATGQTIATLASATSDDALAALDAACEVQSSWARTPARERSEILRRAFDLINERAEEFATLMTLEMGKPIAEARGEVTYGNEFMRWFSEEAVRTYGRHGQTPEGTHRMLTVRKPVGPCLLITPWNFPLAMATRKVAPAIAAGCTMVLKPARLTPLTAQYFAQTMLDAGLPAGVLNVVSGASASAISNPIMEDDRLRKVSFTGSTPVGKQLLKKAADKVLRTSMELGGNAPFIIFEDADLDLAVEGAMGAKMRNIGEACTAANRFLVHDSIAQDFSRRLAERFNQLTLGNGLDDGVTVGPLVEAKARENVAKLVDDAVTEGATVLTGGTAGEGEGYFYQPTVLVDVAPGARILTEEIFGPVAPIITFTTEEEAIQLANDTEYGLASYLFTRDYARMFRISDQLEFGLLGFNSGVISNAAAPFGGVKQSGIGREGGTEGIDEYTQLQYIGIRDPYTDR

SEQ ID NO: 43244 - protein, 418 aa, Sulfolobus solfataricus P2
MSKKVDELIKEDQEYLMQSFRRWYPFVIDHGFGAIVYDIEGNEYIDFNAGIGVVALGHKNEKIINAVKEQMDKFFHYSLTDFYYEVAIEVAKRLSSLMPFSAKVFYANSGTESVEAAIKIARGHTGRQWIIGFINSFHGRTLGSLAFTSSKAIQRKSFSPLLPSTYLIPYPDRRDPLCKEECTEELLGFIEDWVFKKVVDPNEVAAFIAEPIQGEGGVIVPPKDFFYKLNNLLKKFGILLILDEVQTGIGRTGKMFAFEHFNVTPDLVCLAKALGGGLPLGAVVGRKEIMDLPPGSHANTFGGNPLALAAANVILEEVPKLLDHVSSIGKKIIEELTDTRSPYLYDVRGLGLLIGAELRKNDKPFVEGLEKVLYNSFRRGVLAIGAGESVVRIEPPLIISEELAMKGTKILKEEIEKL

SEQ ID NO: 43245 - protein, 480 aa, Triticum aestivum
  misc_feature (118)..(118): Xaa can be any naturally occurring amino acid
MAVGNGGAKKVVAPMEVSVEAGNTGDAAWMDDDGRPRRSGTFWTASAHIITAVIGSGVLSLAWAIAQLGWVAGPAVMLLFAAVIYYTSTLLAECYRTGDPATGKRNYTYMDAVRSNLXGGPKVIFCGVIQYANLVGVAIGYTIASSISMRAIRRADCFHANGHADPCKSSSNPYMILFGLVQIVFSQIPDFDQIWWLSIVAAVMSFTYSGIGLSLGITQTISNGGIKGSLTGISIGVGITATQKVWRSLQAFGDIAFAYSFSNILIEIQDTIRAPPPSEAKVMKQATRLSVATTTVFYMLCGCMGYAAFGDAAPDNLLTGFGFYEPFWLLDIANVAIVVHLVGAYQVFCQPIFAFVERWAASTWPDSVFISREFRVGPFALSVFRLTWRSAFVCLTTVFAMLLPFFGNVVGLLGAVSFWPLTVYFPVEMYIRQRGVPGRSMQGICLRMLSVGCLIVSIAAAAGSIANVIEALKVYKPFSG

SEQ ID NO: 43246 - protein, 490 aa, Corynebacterium efficiens YS-314
MRMIITMTNPDSLAQIGVVGLAVMGSNLARNFARNGHTVAVYNRSTDKTDKLISDYATDGNFIPTKTVEDFVAALEKPRRAIVMVQAGAATDAVINQLADAMEEGDIIIDGGNALYTDTVCREKEMAARGRHFVGAGISGGEEGALNGPSIMPGGPKESWEALGPLLESIAAKVDGVPCVTHIGPDGAGHFVKMVHNGIEYADMQVIGEAYQLLRFGAGMEPAEIADVFAEWNKGDLDSYLIEITAEVLRQVDAETGKPLVDVILDAAGQKGTGRWTVKEALDLGVPVTGIGEAVFARALSSSLDQRKAAQGNLPTGALTTFEELGLDKAEFVEDVRRALYASKLVAYSQGFDEIKAGSDEHNWGVDPRDLATIWRGGCIIRAKFLNRIVEAYDNDPELPSLLLDPYFKGELEDLMDSWRRIVIYVTQLGLPAPVFTSSLAYYDSLRAERLPAAIIQGQRDFFGAHTYHRIDKPGSFHTLWSGDRSELEV

SEQ ID NO: 43247 - protein, 860 aa, Oryza sativa Indica Group
MEAEHPHQITYTTTTTTSTSSLCPRRRKRGDDEAAHHLVFPMDLDSAAAAAAAAAHHQQQQQQTTSQDKLKALAYEYGHEFRVFSSVTFESMTSNLPAADQEEDDDFYELQPADYFNLVSNRIGALSKTMKLTAEQSKVLKTRKMREAELAAQRAKIKKAVMRVRFPDGYILEADFHPSETVQSLMDFLKKVISRPDLPFYLYTVPPKKRIKDTSLDFYTIGFVPGANVYFSYDLPEGSELNTDSVKSGPYLREEIRMLDGLPIVQEPVHQPIDSTMNSSSAHQSDVSQSDFAPPANKKPAKPKWFKRVLEGDDERSSHRDQEKEVCKASLKSLISEDRLDCKMCADFAVIISEIRSIFRLSSFDVTRKEEGEERKLVGCTAICVLEPGNGEARTHQISPCICPAITLEFFTVGGTEHAGWKGILLKEEEHQPIYHVRRIFTKGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSAEELSAQLGELFDENQLYRIDHYLGKELVQNLLVLRFANRLFLPLWNRDNIDNIQVFCLVAMEKPVSLKPEHIRDEKVKVLQSVNPIKHDEVVLGQYEGYKDDPTVPDDSNTPTFASVVLRVHNERWEGVPFILKAGKALSSRKAEVRVQFKDVPGDIFKCKRQGRNEFVIRLQPSEAMYMKLTVKKPGLEMATEQSELDLSYGMRYQNVKIPEAYERLILDTIRGDQQHFVRRDELKAAWQIFTPLLHDIDEGKVKSIPYQPGSRGPKEADELSERVGYMQTHGYIWIPPTLA

SEQ ID NO: 43248 - protein, 279 aa, Stictis sp. 1-MW-2004
AIEHGAVNVVAVNDPFIEAHYAAYMLKYDSQHGQFKGEIKVDGNDLIVKGQKVKFYQEKDPANIPWSETGAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKLTGMSMRVPTSNVSVVDLTCRLEKAVSYDQIKETIKKASEGEMKGILAYTEDDIVSTDLNGDNHSSIFDAKAG

SEQ ID NO: 43249 - protein, 380 aa, Parvularcula bermudensis HTCC2503
MVAGGRGVRAQTDIPKQYACLGGRPILRRTLEAIAAHPQIDAVLCVIGEPDLAAYADASAGVPKLLPPVTGGRSRQASVRAGLEALAAKAPQKVLIHDAARPFISHKTLTALLETLDHAEGAIAALPVADTLKRQSTAGGIDATVPRDGLWRAATPQGFRFETILNAHRSAEPDAATDDAALLEAENIHVALIPDDPRNFKITYKEDFALAESLIAATRETRTGFGFDVHAFEPGDAVILGGVTIPHSAKLKGHSDADVVLHALCDAIFGGLALGDIGTFFPPSDEKWRGAPSDLFAKAAMAKVAAAGATLVHVDLTIIAEAPKIGPHRDAMRERIADILSLEGDRISVKATTTEGLGFTGRREGIACQAVVTLSVERDS

SEQ ID NO: 43250 - protein, 352 aa, Bacteroides fragilis YCH46
MKELKRLSFVVVTLLLSTMMAFAQKPNIHILATGGTIAGTGGSATSTNYTAGQVAISTLLDAVPELKDIANVTGEQIVRIASQDMSDEVWLILAKKINQLLKRPDIDGIVITHGTDTMEETAYFLNLTVKSNKPVVLVGAMRPSTALSADGPLNLYNAVVTAGAKESIGKGVLIAMNGLILGAESAIKMNTIDVQTFQAPNSGALGYIFNGKVFYNQAPLKKHTTQSVFDVTNLNSLPKVGIVYSYSNIDPDMVTPLLHHDYKGIIHAGVGNGNFHKNILPVLLEARKKGILVVRSSRVPTGPTTMDAEVDDTQYQFIASQELNPQKSRVLLILGLTKTNDWKQIQQYFNEY

SEQ ID NO: 43251 - protein, 231 aa, Legionella pneumophila subsp. pneumophila str. Philadelphia 1
MSISQNINKVRELITQTESSSNRQPNSVLLLAVSKEQSPELIREAFQQGIRHFGENYFQEAQEKILALRDLPICWHFIGPIQSNKTKGIAKYFNWVHSIDRNKTAKLLNQFRSEQLPPLNVCLQINLTGETTKSGIPPEHAIDLALEVKQLPNLQLRGLMTIPPQQNNMQTQYNLFLKLNQLKESINKALHLKMDTLSMGMSDDLVPAIKAGSTIVRIGRAIFGERKGKLL

SEQ ID NO: 43252 - protein, 394 aa, Zea mays
MASAATTLLKSSFLPKKAEWGSKPQLVAAHPRPATVVVSMVARASAYADELVQTAKTIASPGRGILAMDESNATCGKRLDSIGLENTEANRQAYRTLLVSAPGLGQYISGAILFEETLYQSTVDGKKIVDVLSEQGIVPGIKVDKGLVPLAGSNNESWCQGLDGLASREAAYYQAGARFAKWRTVVSIPNGPSQLAVKEAAWGLARYAAISQENGLVPIVEPEILLDGEHGIERTFEVAQKVWAETFFYMAENSVMFEGILLKPSMVTPGAECEEKATPEQVAEYTLRLLRTRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 43253 - protein, 262 aa, Legionella pneumophila subsp. pneumophila str. Philadelphia 1
MNISFIGYGNMAKAIACHLQKQNKYSLSAASPSLSAGISKENIRTHYDNKEVAKDADVIILAVKPAQMREVVNEINPFISSGCLLISVAAGLSLTWFAKYCKKGQAVVRTMPNTPAIVGFAATSMIANEFVNEKQKKWAEQLFSSIGITDWVKDEEDMDTLTALSGSGPAYVFLFLEAMINAGVQLGLEETVAKHFAIQTFSGSLQLAQHSQLSLTELRKKVTSPGGTTAAALEILHGDLDELIFSAMKAAKQKAHELGKVE

SEQ ID NO: 43254 - protein, 143 aa, Shewanella oneidensis MR-1
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAQSIDENAAHGSDSLASAEREIAYFFSAEELCPRTR

SEQ ID NO: 43255 - protein, 478 aa, Sulfolobus solfataricus P2
MPSAVGKKVVTTQNYIASYVGAKVLEEGGNAFDAAIAISATLSVVIPHTSGLGGDGFLLAKTPEGLIAYNASGWAPKELKVDKINSDRGPLTVVVPGLVDLWEFIYENYASKSLHELLIPAISLATNGFMVGRGLHHAIISSFKLSDDWNRVYGSKRFGDEIKLRGIAKVLKEISKDPRSFYEGKIAEELTKGLRERGVPVSYEDFSEFHGEIINPIKMKYKDFMLYELPPNTQGLTTLELLKMIEVTEINKLPFNDVRRVNDHVRLSALAYADRNNYIADPRFVNVPVEMLLSEKYIANKIAEYGFEVKVNVTGDTTFFAVADGENEIGFIQSLFYPFGSGIVVNDIPFNNRGAGFSEGNNKPEPRKRPLHTLSILMAEKDDERIFIGCAGGDLRPQIHAEVFEYYADYNMEIDEAVQAPRFMYLGNKVIAEKRLGVPATQTDYYSPEVGIVQALKYKKGRYIGVADIRSEGIVLPI

SEQ ID NO: 43256 - protein, 141 aa, Zea mays
MTSPWCLSAPPAAPPVAAAPGALGVSTSACALARVPVPGSKRCRWNALVVCAAPDEEKITKRSPLDFPIEWERPKPGRRPDIFPKFSPMKTPLPHPLPADDPLDDDEEEEEEEQAPPQEEPQEDDPDKEEPEEDDPDKPTE

SEQ ID NO: 43257 - protein, 479 aa, Bacillus thuringiensis
MLEKKVGIHFAIKRENNVKKRMGYAMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRRICSENGILFVADEIQTGFSRTGKYFAIDHYNVVPDLITVSKSLGAGVPISGVIGRKEIMNESAPGELGGTYAGSPLGCAAALAVLDVIENEKLNDRAIELGKVVMNRFEEMKNKYHCIGDVRGLGAMCAFEVVQDRKTKAPDKTLTANLCAEANKRGLLLLSAGTYGNVIRVLMPLVITDEQLEEGLTIIEESLQACYEQTNIARV

SEQ ID NO: 43258 - protein, 392 aa, Oryza sativa Japonica Group
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASFNNFPTAAGLASSAAGLACFVFTLGKLMNVKEDHGELSSIARQGSGSACRSIYGGFVKWCMGKNNDGSDSIAVQLADEAHWNDLVIIIAVVSSKQKETSSTSGMRDSVETSPLLQYRAQTVVPERVLKMEEAIKSRNFESFARIISLVEKWNQSEGTPQVAYTFDAGPNAVLIAPNRKNATILLQKLLYYFPPQDNDLSSYMVGDKSILSDAGLKSIEDVEALPAPAETKMPSQKFKGDVSYFICSRLGAGPKVVTDESLALIDSVTGLPKGV

SEQ ID NO: 43259 - protein, 568 aa, Arabidopsis thaliana
MSLVRTVTIVLFIIAFLQNLRLRKDSKVLLSLAVLATDDGRCSVIGMRVLREGGNAIDASVAAALCLGVVSPASGLGGGAFTVVKIAGGKEIAYDSRETAPLRATENMYGGNVDLKKKGALSVGVPGEVAGLFTAWKQHGKLPWKRSVTPAEKLAEGFKISKYLYMQMNATRSDILADKGLSDLFVSNGELKRPGTICHNPKLALTLKLIGEYGPKAFYNGTVGVNLARDIKKSGGIITLKDLQSYRVKIKEPLSAELLGYRVLGMPPPSSGGAAMMLVLNIFLNMGSSVFRPLGVHRLIEALKHAFAVRMNLGDPDFTDVTKVVSDMLSPKFAKDLKSKINDQKTFDPKYYGGMWNQIDDHGTSHLSIIDRERNAVSMTSTINGYFGALMLSPSTGIVLNNEMDDFSIPMKSNGNLDVPPPAPANFIRPGKRPLSSMSPTIVLKDGKVKAAVGASGGANIIAGTTEVYLNHFFLKMDPLSSVLAPRIYHQLIPNRASYENWTTVFNDHFEIPKATRVVLEKKGHVLSPIAGGTIAQFIVQESGENSGGRSELVAVSDPRKGGFPSGY

SEQ ID NO: 43260 - protein, 107 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLS

SEQ ID NO: 43261 - protein, 226 aa, Glycine max
GYDLEETVKPNVECLISFGVGRDCLASIIAQYPQILGLPLKAKLSTQQYFFSLKLKVDPEGFARVVENMPQVVSLHQHVIMKPVEFLLGRTIPAQDVASMVVKCPQLVALRVELMKNSYYFFKSEMGRPLQELVEFPEYFTYSLESRIKPRYQRLKSKGIRCSLNWMLNCSDQRFEERLQGHYIETESVGPRFCMGGKLELPGNGLVSDEEEESDDELLYRRTVSL

SEQ ID NO: 43262 - protein, 425 aa, Streptomyces coelicolor A3(2)
MGLVVQKYGGSSVADAEGIKRVAKRIVEAKKNGNQVVAVVSAMGDTTDELIDLAEQVSPIPAGRELDMLLTAGERISMALLAMAIKNLGHEAQSFTGSQAGVITDSVHNKARIIDVTPGRIRTSVDEGNVAIVAGFQGVSQDSKDITTLGRGGSDTTAVALAAALDADVCEIYTDVDGVFTADPRVVPKAKKIDWISFEDMLELAASGSKVLLHRCVEYARRYNIPIHVRSSFSGLQGTWVSSEPIKQGEKHVEQALISGVAHDTSEAKVTVVGVPDKPGEAAAIFRAIADAQVNIDMVVQNVSAASTGLTDISFTLPKSEGRKAIDALEKNRPGIGFDSLRYDDQIGKISLVGAGMKSNPGVTADFFTALSDAGVNIELISTSEIRISVVTRKDDVNEAVRAVHTAFGLDSDSDEAVVYGGTGR

SEQ ID NO: 43263 - protein, 505 aa, Saccharomyces cerevisiae
MSEGPVKFEKNTVISVFGASGDLAKKKTFPALFGLFREGYLDPSTKIFGYARSKLSMEEDLKSRVLPHLKKPHGEADDSNVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 43264 - protein, 483 aa, Sulfolobus tokodaii str. 7
MKSHIILRLFLHTLTLPNALSSPILSVSKVYQSSRPSSSIRYYTSSLLIISHTVIKNMSVSELLRKNNVEILRFTWVGLDGIIRSKGAYIDEVDNLVKTGIGLTMAMMSFTPMDYISPYGTFGPQDEDVFLTPDLSTLSIFPPSAVVLCYLYKGSSPWMYDPRSTLKKILEKYSEYEFKSSFEIEFYLVKDRKPFDDTKCFDSRAYYNNQIIPEIAKVAGSVGIVPLRVIKEYGPGQYEFDIQHKDAMRSADEVILFKEIARQIASKYNVEANFMPKPFNKMAGSGLHLNFSIWKDGRNLFYDPNDNYGLSDLAYNFIAGIIEHAKALTAIAAPTVNSYKRLVPGSWAPTKITYGYNNKSAMLRIPTPYPGMSMQDRRIEYRVPDATTNPYLLLSAFIEAGIDGIERGLKPPSPVNENAYFRKDIEDVPRNLREALNELKKDTRLIERVGREIVEEFIRVKMAEVEEFESLVTDWEYEVYKYV

SEQ ID NO: 43265 - protein, 140 aa, Arabidopsis thaliana
MADESRVPSSVSVTVAHDLLLAGHRYLDVRTPEEFSQGHVPVGSINVPYMNRGASGMSKNPDFLEQVSSHFGQSDNIIVGCQSGGRSIKATTDLLHAGFTGVKDIVGGYSAWAKNGFLQKLDDSPFTKHLSLSLRLLLLQ

SEQ ID NO: 43266 - protein, 310 aa, Mesorhizobium loti MAFF303099
MVAKCLVLGGGGFIGSNICRRLSAEGLSVTAFGRRKGIAPLPREIAWFEGDFRDNLAVTKALQSHDTVIHLVHSTWPSTADADMAADIRDSVIPSVELLDACVRSGVKRIIYFSSGGTVYGEVDEIPIREDSPTNPVGAYGVSKLMIEHYVRLYERKYGLNSFIVRLANPFGPWQVEAHNQGLVAFAGHLIQSDRQVTVYGDGSARRDYVYVEDVANFVARLINYNGAKRTFNVGGGGNGQSILDVIHAIETSLGKRAMIKREPSRPFDVPSNVLSIERAEKELGWRPATSFPDGIDYTLSWQREFYARP

SEQ ID NO: 43267 - protein, 373 aa, Capsicum frutescens
MSSSIALRHARFLTTAAMPKLKAEHDPDKALQIYSSVSDRYISPLSSRYAQEYTVKRLAKSHRFSDSENFLESHKNSSKITQEPFLSSIIRSYGVAGMFDHALKICHQMDHLGTPRSAISFNVLLSACVHSKLYDRVAQLFDEMPVSMDFYLIKCPMGLKEMDEKDVEITTVAFTTILHSFYKKGKSDEAERVWNEMVNKGCGPDVGAYNVKIMNIQGGDPEGVKALIEEMSDAGLKPDTISYNYLMTCYFRNELMNEVQKVYEDLEANGCNPNAATFRTLIFYLSKKGKYEAGYKVFKESVRVNKIPDFNTLEYLVEGLVKRSKLNEAKRMSKTVKKKFPPNLVKAWTKLEEELGLAEVEDGDNGVQTASLA

SEQ ID NO: 43268 - protein, 451 aa, Streptomyces coelicolor A3(2)
MTPQPSPQAGAAVKAADRAHVFHSWSAQELIDPLAVAGAEGSYFWDYEGKRYLDFSSGLVYTNIGYQHPKVVAAIQEQAARMTTFAPAFAVEARSEAARLIAERTPGDLDKIFFTNGGADAVEHALRMARLHTGRPKVLSAYRSYHGGTQQAVNVTGDPRRWASDSGTAGVVHFWAPFLYRSRFYAETEEQECARALEHMETTIAFEGPGTIAAIVLETIPGTAGIMMPPAGYLAGVREICDKYGIVFVLDEVMAGFGRTGTWFAADLYDVVPDLMTFAKGVNSGYVPLGGVAISAEIAATFAERPYPGGLTYSGHPLACAAAVATINVMAEEGVVEHAARLGAEVVEPALRELAERHPSVGEVRGTGMFWALELVRNRETREPLVPYNATGQAATPMSAFAASAKAHGLWPFVNMNRTHVVPPCNVSEAELKEGLAALDTALSVADEYTE

SEQ ID NO: 43269 - protein, 292 aa, Dianthus caryophyllus
MATSTATNHFLKTLAISITTQKPTSIFPPKSLVLEKPTTNNSQFHYKTHHLCCMCCLQTSDFEQESSPNAVIDEEENVEKTEAAVNWEDASEPQPSSGFGSEDGFSEPSEDVKLYVGNLPFDVDSEKLANMFDAAGVVEIAEVIYNRETDRSRGFGFVTMSTVEEADKAVEMFHSYELNGRLLTVNKAAPRGSRPEKAPREFCPLLSESYVGNLPWDVDNDRLEQLSSEHGKVLSARVVSDRETERSRGFGFVTMASETEMNDATLGALDGESLEGRPIRVNVAEERPRRTF

SEQ ID NO: 43270 - protein, 263 aa, Idiomarina baltica OS145
MSISIKTPEEIEKMRAAGRLAASVLEMIGEHVKPGVTTEELDKICHDYIVDHGAYPAPLNYHGFPKSICTSVNHCVCHGIPGPKKLKEGDIMNIDVTVKLDGYHGDTSKMFVVGKPSILAERLIRTTQESLYKAIKMVKPGIRLGDFAEVIQKFAEQHNYSIVREYCGHGIGAVFHEEPQVLHYGKAGTGEVLEPGMCFTIEPMLNAGKRHTKLMKDGWTVLTKDRSLSAQWEHTLLVTDNGVEVLTLREEETDLPRVIQHSE

SEQ ID NO: 43271 - protein, 748 aa, Nocardia farcinica IFM 10152
MAVLSDHAPPSSPAPAEGGPAAGRGKLVSIVRHDLPASIVVFLVALPLSLGIALASGAPVAAGLIAAVVGGIVVGCLGGSVLQVSGPAAGLTVVVAESIAQFGWRVTCFIVVAAGALQILFGLSRIARAALAVAPVVVHAMLAGIGVTIALQQVHVLLGGSSHSSAWHNITALPGRLTSMNTGAALVGVLVVAVMLGWKYLPEKVRVVPGPLVAVVAATVLSLVLPLDVERIVLSSSLFEAIELPQIPDGGWAPVALMVLTIALIASVESLLSAVAVDKMHSGPRTNFDRELVGQGSANMLSGMLGGLPVTGVIVRSATNVQAGARSRASAVLHGVWLLLFSVALVGVVEQIPKAALAGLLIVIGIQLVKIAHIKLASRTGDLLVYAVTILGVVFLNLLEGVIIGLVLAFALLLWRVVRVTIVAEQIPQSQRWLVRIDGSCTFLALPRLSGELAKVPAGADVTVEMTVDFLDHAALEALQDWVRQQESGGGSVEFVEIGSVRMADALAGPPARGFARAMWEEILGPWRRDEKHLDPVTAGVAAYHRSHAHVVRRHLDELVHRQDPDSFFLTCSDSRIVPNVITNSGPGDLFTVRNVGNLVPATGDASVEAALVFALEELNVRCVVVCGHSSCGAMGALYGGGDAAPGIEPWLAHARPSLERFRAGHPVAEAARAAGFGEVDQLSMVNVAVQLETLQRHPAVRRAVAERGVTVAGLFFDIASARVVEITADGIVHIDEARGRRQVPEPV

SEQ ID NO: 43272 - protein, 516 aa, Cryptococcus neoformans var. neoformans JEC21
MFRSSLPQRTSHNSASEAGPSIPTPIPTDGDAVTLENASNTTGEATLSSSGSSEGESLISKMMADNPYFSAGAGLMGIGVALTALRRSITLGATMAQRRMLVTLEIPSKDRSYPWFLEWMAHQSAAQTRGNVKPPGLFGWGQGMRSHELAVETSYKQHENGASEAIFNLVPGPGTHYFKYGGAWFQVKRERDSKLMDLHSGTPWETLTLTTLSTSRDLFSSLLEEARTLAEASTEGKTVVYTAWGVEWRPFGKPRRRREMGSVVLGKGIAEEIESDLKGFLGRGKWYAERGIPYRRGYLLHGPPGSGKTSFIQALAGSLNYNICLMNLSERGLTDDKLNHLLGLVPERSFVLLEDIDSAFNRRVQTSEDGYKSSVTFSGLLNALDGVASSEERIIFMTTNHYDRLDPALIRPGRVDIQQLLDDAAGEQAKRLFVKFYGNSVNEDGTKGRVLREGELPLNDEEVESLGNSVQRIVDDERAHGKVVSMASLQGHFIRTGAKESLDGIRELCRPREGQA

SEQ ID NO: 43273 - protein, 164 aa, Shewanella oneidensis MR-1
MRRIISVLLENQSGALSRVVGLFSQRGYNIESLTVAPTDDNTLSRLNISLVADEKVLEQIEKQLHKLVDVLKVSNVTESAYIERELALVKVRAQGELREEIKRTADIFRGQIVDVTANLYTIQLVGTTEKLDAFIHSMGEVTKVVEVSRSGVVGLARGEKAMKA

SEQ ID NO: 43274 - protein, 445 aa, Oryza sativa
  misc_feature (143)..(143): Xaa can be any naturally occurring amino acid
  misc_feature (169)..(169): Xaa can be any naturally occurring amino acid
  misc_feature (272)..(272): Xaa can be any naturally occurring amino acid
MEGKEEDVRLGANKFSERQPIGTAAQGSDDKDYKEPPPAPLFEPGELKSWSFYRAGIAEFMATFLFLYITVLTVMGVNNSTSKCATVGIQGIAWSFGGMIFALVYCTAGISGGHINPAVTFGLFLARKLSLTRALFYMVMQCXSAAICGAGVVKGFQKGLYETTGGGAXNVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAAXLAAIYHQVVIRAIPFKSQVVTCISYYHCQDANPEQAVSDGRGCFPLPALLVIIVESTFLFKFVVLLFLSEHRLVISVLSCVSLFYYVQIKLSSSYWSSVQKKKKKKKNPIVFLFFQLETRARRWLIPPNLLGTRPHLPKLVDYSSHCIIFASPLLHALAVHADWGLYLENLPV

SEQ ID NO: 43275 - protein, 374 aa, Legionella pneumophila subsp. pneumophila str. Philadelphia 1
MSIFMINKSAILALADGTVYEGLSVGASGDSVGELVFNTSMTGYQEMLTDPSYARQIITLTTAHVGNTGCNMEDMESTKVWAAGLVMRNCTAIPSNYRAEQSFPDWLSKNGVVAISGIDTRALTLKLREKGSIGACISTNVEKPEIVVAKAKSFAGLQGADLALEVTRQTIERWHEGRGMWSLDKQPQQLHVVAYDFGVKHNILRILHDKGCHITIVPAKTSAEEVLAMNPNGVFLSNGPGDPQACDYAIKATQVFLDNNIPLFGICLGFQILALACGGITKKMKFGHHGSNHPVVETTGKKRVFITSQNHGFAVDEDSLPNCLEVTHRSLFDNSLQGIRHKTKPAFGFQGHPEASPGPHDIDILFNEFLNLMK

SEQ ID NO: 43276 - protein, 276 aa, Stictis sp. 1-MW-2004
HGAVNVVAVNDPFIEAHYAAYMLKYDSQHGQFKGEIKVDGNDLIVKGQKVKFYQEKDPANIPWSETGAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKLTGMSMRVPTSNVSVVDLTCRLEKAVSYDQIKETIKKASEGEMKGILAYTEDDIVSTDLNGDNHSSIFDAKAG

SEQ ID NO: 43277 - protein, 804 aa, Bacteroides thetaiotaomicron VPI-5482
MKKQRHIQTTRSLLSRFRYWGRKNYAAFASMGREFQIGHLHTNVVDVALRKQNAKVTIPYHTFMTLQEIKDQVLAGFDISSAQATWLANMADSEALYAAAHEITITCASHEFDMCSIINAKSGRCPENCKWCAQSSHYKTQAEIYDLLPAEECLRQAKYNESQDVNRFSLVTSGRKPSPKQISQLCDAARLMRKHSSIQLCASLGLLNEEELRALHTAGITRYHCNLETAPSYFPTLCSTHTQEQKLATLDAARRVGMDICCGGIIGMGETMEQRIEFAFTLAELNVQSIPINLLSPIPGTPLENEKALSEEEILRTIALFRFINPTAFLRFAGGRSQLTPEAMRKALFVGINSAIVGDLLTTLGSKVSDDKKMILEEGYHFADSQFDREHLWHPYTSTTDPLPVYKVKRADGATITLEDGRTLIEGMSSWWCAVHGYNHPVLNQAAKDQLDKMSHVMFGGLTHDPAIELGKLLLPLVPPSMQKIFYADSGSVAVEVALKMAVQYWYAAGKPDKNNFVTIRSGYHGDTWNAMSVCDPVTGMHSLFGSSLPVRYFVPAPSSRFDGEWNPDEIIPLRETIEKHSKELAALILEPIVQGAGGMWFYHPQYLREAEKLCKEHDILLIFDEIATGFGRTGKLFAWEHAGVEPDIMCIGKALTGGYMTLSAVLASNQIADTISNHAPKAFMHGPTFMGNPLACAVACASVRLLLDSGWAENVKRIEAQLKEELAPARKFPQVADVRILGAIGVIQTERSVSMAYMQRRFVEEGIWVRPFGKLVYLMPPFIISPEQLSKLTSGVLKIVREM

SEQ ID NO: 43278 - protein, 483 aa, Bacillus thuringiensis
MDKKATFVSIDKKAMYINGEWITLQEQIEVNNPATKEIFATVPKGGVTEAKQAVDAAHEAFKTWSKLTAADRATKLKKWFMLIDKNKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDSRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGVANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 43279 - protein, 415 aa, Anabaena variabilis ATCC 29413
MQAANISLEISSFDTMNTQDYIELEQQYGADNYHPLDVVITKGEGVWVWDIEGKKYLDFLSAYSALNQGHCHPKILQAMIKQAQQVTLTSRAFRNDQLGKFYQKLCQISGLPKVLPMNSGAEAVETAIKAIRKWAYKVKGIPENQAEIIVCSNNFSGRTISLISFSTEEQYQDGFGPLTTGFKVIPFGDAQALEQAITPNTAAFLVEPIQGEGGIIVPPHGFLKQAEQICRHHHVLLVFDEIQTGLGRTGKMFAHQYENVKPDGITVGKALSGGFYPISAFISTEEVMGIFQPGDHGSTFGGNPLAAAIGIAALDVLIEEKLPEKALKLGEYFIEKLQSIESTYIKEVRGKGLLIGMELYPEAGGARRFCKALAKEGLLAKETRDNVIRFAPPLVISEDEIDWALEKIERVLTTT

SEQ ID NO: 43280 - protein, 122 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 43281 - protein, 585 aa, Shewanella oneidensis MR-1
MKFPSLVSFMPGLALMLQYEKQWLRDDVRAGLSVAAVALPVAIAYAQLTGVNAAVGLYSCVLPMLVYALFGTSRQLIVGPDAATCAVIAAVVTPLAAGDSMKHWQLVMTMTAMTGFWCLIASRFRLGVLADFLSKPILMGLLNGVAITIIVGQFSKIFGFTFDERYLIERLSGAPSYLTKTHWPTLLMGLVTLLTYALVKRYRPQWPASMCAMAVAAFLVWAFNLTSFNINVVGEVSAGLPSFQAPVFDIGIARELVVPALNLAMVSFVSMMLTARSFAAKNGYDIDADKEFRALGIANIASALSQGFAVSGADSRTAVNDANGGKSQLVSIIAAVLIALVALFFTAPLKYIPSSALGVVLVIASISLIDLKALWNLRVRDRSAFLLACTTLFSVLFIGVIPGITLAVLLGLFQFLATVMRPTDQVLGLDHKGVIRSVDDSGKAKSVPGVFIYRFNSPLTYFNATYFKRRLLEKFIREPDPVDCIIIDAVPCFTHLDLSVMAMLADLHQLLKKRGIRLVLAGRKRQMLGWFEQAGMQSGEGGILIRPDLYLALKMNQSYKQALAEGQAPVIKKAPEDDVLLYSHL

SEQ ID NO: 43282 - protein, 116 aa, Zea mays
LFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 43283 - protein, 389 aa, Burkholderia xenovorans LB400
MKIHEYQGKEILRKFGVAVPRGKPVFSVDDAVKAAEELGGPVWVVKAQIHAGGRGKGGGVKVAKSLEQVREYANQILGMQLVTHQTGPEGQKVNRLLIEEGADIKKELYVGLVIDRVSQKIVVMASSEGGMDVEEVAEKTPELIHKIAVDPATGLKDAEADELATKIGVPAASLPQARAILQGLYKAFWETDASLAEINPLILTGDGKVIALDAKFNFDSNALFRHPEIVAYRDLDEEDPAEVEASKFDLAYISLDGNIGCLVNGAGLAMATMDTIKLFGGEPANFLDVGGGATTEKVTEAFKIMLKNPNLTAILVNIFGGIMRCDVIAEGVIAASKAVSLKVPLVVRMKGTNEDLGKKMLAESGLPIIAADSMEEAAQKVVAAASGKA

SEQ ID NO: 43284 - protein, 428 aa, Aspergillus nidulans FGSC A4
MVEGRKGKLCEVLESPSFFGTLPVFNRYLFAKSLLYRPNSLIHHAATVIMTDNRKPEDYTIEMDKLGQNKNYQAPPPPPQPRSSTASSISNNAALSVLAYCGSSILMTVMNKYVLSSDFNLNFFLLCVQSLVCIIAIQLCKACGLITYRDFNLDEARKWFPITLLLIGMIYTGSKALQFLSIPVYTIFKNLTIILIAYGEVLWFGGSVTNLTLFSFGLMVFSSIIAAWADIKHAIESSGDATSKVSTLNAGYIWMLINCLCTSSYVLGMRKRIKLTNFKDFDTMFYNNLLSIPVLIVCSGILEDWSPANVARNFPSADRNGIMFAMILSGLSTVFISYTSAWCVRVTSSTTYSMVGALNKLPIALSGLIFFDAPVTFPSVSAIMVGFVSGIVYAVAKIKQNAKPKVGILPTTNPVSASSQSMRDSLRS

SEQ ID NO: 43285 - protein, 181 aa, Triticum aestivum
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKA

SEQ ID NO: 43286 - protein, 159 aa, Prosthecochloris aestuarii DSM 271
MKHIISVLVENKFGTLNRVAAMFSARGFNLESISIGETEDSEISRMTIITKGDDRIISQILKQLNRLIDTIKVTDLTHQPHLSRELLLITLKLGRSSQHEIFELINVFKGKVVDIKQKSITIEVVGSPDKINTSIDMFRPFGIKEIARSGTVALHRGEN

SEQ ID NO: 43287 - protein, 353 aa, Prosthecochloris aestuarii DSM 271
MFKIVSIPGDGIGPEVVASAIRVINTLARQHGLEITIEEHLFGGASYDVHGEMLTQETLEACRKCDAVLLGAVGGPKWENLPHEKKPEAALLGIRKELGLFANFRPAKVYDALVNASSLKPEILAGTDFMVIRELTGGIYFGEPRGYDDTRGWNTMVYEHYEVERIARLAFDAAMKRKKQLVSIDKANVLESSQFWRNIVHEVHKDFPEVELIDMYVDNAAMQIVRDPKQFDVIVTKNLFGDILSDISGMITGSLGMLPSASIGSSHALYEPIHGSAPDIAGQNKANPIATIASAAMMFEHSFCMKNVADEIYSAIEKTLASGFRTADIANPEDTIVSTTEMTDAIVANLEAS

SEQ ID NO: 43288 - protein, 347 aa, Aspergillus nidulans FGSC A4
MSGNQTPEQTLATLDVMISRMQGLKRKMENLQQEEKKIHHQSRKRIQHLNQLYQIPSLTDVKYDQWSRVRLDRLVIDHMLRSGYSESAQRLARAKNIEELVDLNVFVQCQRIAESLRNGETKDALQWCNENKAALKKSQYNLEFELRLQQYIEMIRTRDRAKFVDAMVHARRYLAPYDETQSAEIRRAAGLLAFPPNTRAEPYKSMYASERWVYLSELFIRTHHELLSLPSRPLMHIALSAGLSALKTPACHSAYTSSSSNSHSTATSVCPICSTELNELARNLPYANHTKSSVENDPVVLPNGRVYGLHRLLDMSKKLSSLEAGKVRDPTTGEIFNESELKKVYIM

SEQ ID NO: 43289 - protein, 479 aa, Burkholderia thailandensis E264
MEEAKHFIAGAWAPPAGGETIAVIDPSDGEPFARLARGTAPDVDAAVRAARAAFDGPWGAVSAAERGRALYRLSMLVAACREELALTESRDTGKPLTQARADADALARYFEFYAGAADKLHGQTLPYRDGYTVLTLREPHGVTGHIVPWNYPMQILGRSVGAALAAGNACVVKPSEDACLSVLRVATLAAEAGLPAGALNVVTGYGHEAGAALARHPGVDHISFTGSPDTGRLVAQMAAEHHAPVTLELGGKSPQIVFADADLDAALPVLVSAIVQNAGQTCSAGSRVLIDKAVYEPLVERLATAFNGLKVGPGQADLDCGPLISAKQQRRVWDFLSDAQHDGIAMAAHGEVVPDAPETGFYQAPALLRDVPHTHRLAQEEVFGPVLAAMKFADEDEALALANGTPYGLVAGIWTRDGARQMRLARKLRAGQVFVNNYGAGGGVELPFGGTGRSGYGREKGFEALYGFTVLKTIALRHG

SEQ ID NO: 43290 - protein, 483 aa, Pseudomonas fluorescens
MKTKLFINNAWIDSSDQQTFEGKDPVNSEVMTERANATVTDAIKAAQVAEEAFKTWKDVGPSECRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFIPATHALITQCVQEAGMPAGVLNYLNSSPDRSPEIADALISAKEIRRINFTGSTRVGSIIAQKAAQHLKRCLLELGGKSPLIVLDDANIDAAVKAAVFGSFLFQGQICMYTERLVVDEKIADEFVSKFVEKTKRLSAGDLCVTGDCIIGPMVSLNSGYRINGLFKDAIDKGSKVVCGGMVQGAVMPSTILDHVKSDMRIYDEETFGPITVVIRCKGEAEAIRIANDSVYGLSSGVFGRDINRALRVGMSIEYGCVHINGSTVQNEVQAPYGGTKNTGYGRFDGRAVVDEFTELKWLTIEPFEQQYPF

SEQ ID NO: 43291 - protein, 297 aa, uncultured archaeon GZfos17F1
MADIIGIGALNVDKLYLVERIGAAGEEIGINSVSEQPGGSAANTIAALTRLGIKTGFIGRVGDDADGAYLRSELVKEGVDTRGIEVARGRTGSAIVLVDPGGERSMYVHPGVNDVLSLTPENISYAKNAKYLHLSSFVGETVIDVQREILDRSKAEISFAPGMLYARRGVDTLRKIISNARVVFLNRDEIEMLTGSGYSEGAGELNDIGAEIVVVTLGGDGCYIRTSDAEISIPGLAARVVDTTGAGDAFCAGFLYGLLIDKPLSVCGRLGNFVAAKCIEAVGAREGLPRKIEIVEG

SEQ ID NO: 43292 - protein, 263 aa, Petunia integrifolia subsp. inflata
MKQFIGACMEPALMLVTELMRGGTLQKYLWSMRPHCPDLKLSLSFALGISRAMEYLHAIGIIHRDLKPSNLLLTEDKTKVKLADFGLAREEEETEMTTEAGTYRWMAPEMFSIDPIKIGVKKHYNHKVDVYSFSMVLWELLTNSTPFKGRSNIMVAYATATKLRPSMDNIPRDIEPLISSCWAEDPAERPEFEQISDFLVNILRNVCPTQITSPNLFETEIPSSKELAISPGTNCLMDKDAENNKKKTRTSCCCFISAYNDSL

SEQ ID NO: 43293 - protein, 1066 aa, Coccidioides immitis RS
MAAGKAWEFPDCIATFLRTGAPESKMTPSDASHRSLKTPELSEYQSCSSRYERTDCNEISEDDSRPKPTIGQFSFAPTTQTTIVTTTTTTMTKFPPLIMHPPRVLQSLDPKQYPLAAAPTPESLRDIRFNLNGKSIVLHEPDDAPGALAEQGQEELKTSAGNTRSATATTNPSAPISSSRGRILGSRHRPFRNTKRAVSPVPFAGSSQASNPSPSRSLVSDSLICRHPRRRHLSSAQDPCHVTEVGLATPETESASFALDSEIYNPERTSQPRPPVKRQNENPPAAGESRRRSVDDGEASPLVEKPSEFPSESFGSSISSEADNPPTQDRRLRPLVSRLLATDQSRGENIPLPSPRLSPVTAMNSLQQETSFDSAEDPATDTDSVADQFPKESNLAGNRRAGPKNAVGKADTDQTSPSMSLMDMPVVLGYFDSIPDELKSYFMYQLLRRCPKPTLQLVADVVNPALKCDFLALLPLELCLNIVKFLDVVSMCRASQVSKKWRHIINSDEKTWKAHFDAAGFTLPEGELQRAIEEGWGWQYADDYERDLRLLSRPTSEQSADSPESILQLKDSSSLACPRRPKRKAESSSPSRRQVKKQSPKDNTSRSPGISDWLHDSKVAEVPYAAASAAALAVPYPNVGLPSLQSLHLYKSLYQRHHLIRKRWMDPNAKPQHLAFQAHDRHVVTCLQFDTDKILTGSDDTNIHVYDTKTGALRATLEGHEGGVWALEYHGNTLVSGSTDRSVRVWDIEKAECTQTFHGHTSTVRCLQILLPSQIGRRSDGSPEMMPKEPLIITGSRDSSLRVWRLPQPGDPKYFQAGPDDSSCPYFVRALNGHTHSVRAIAAHGDTLVSGSYDCTVRVWKISTGEAVHRLEGHTLKVYSVVLDHKRNRCISGSMDHSVKIWSLETGTLLYNLEGHSLLVGLLDLRADKLVSAAADSTLRIWDPETGQCKSTLTAHTGAITCFEHDDQKIISGSDRTLKMWDIKTGECLKDLLSDLSGMWQVRFNDRRCVAAVQRDGLTYIEMLDFGASRDRVPIDRLGRRIVVDRYGGEVQEENEGTGDRDGSDE

SEQ ID NO: 43294 - protein, 799 aa, Salinibacter ruber DSM 13855
MTPTNQIVGRFWRMWKIGGCGKKRWQKTEESVLAVAFFVASKDPKEPSHSAALLTSLSRGHCASAPVTGLLIQKPVFPSRSRTDHSLSSVVKQFVVANAPLVAGIASLLALAFAFYLVRYILRQDAGNERVQELSRDIQAGAKTFMTREFRYLAIFAVVVAVVLYSMPETGLPTTVGFLVGTVASGLAGWIGMWIATKSNGRTAHAAQTSFAKALNIAYSGGSTMGFSVVGLGLLGLAVIYALFPEHSHAWLGYAFGSSCVALFLRVGGGIYTKSADVGADVVGKVEAGIPEDDPRNPGVIADNVGDNVGDVAGMGSDLYESYVSAVAATMFLGAEVDFAAAFPNLGFEDLGLMIAFLFGVLGIVSSIIGYFFVNAGEGTDVSYEQQAANARSALNRGTTVANVLTSLLALGLIFWLVPAGESAAAVIDDAAASMDVRWALFLTILSGLITGVVIGKATEYYTSEYAPVKQIAESAETGAATTIIEGLGTGMLSTVVPALAVSVATLLAYYLGGLFGIALAALGMLLTLGVVLSTDAYGPITDNAQGISEMANLGQDVRERCEALDSAGNTTAAIGKGFAIGSAALAALAWLATYFSEAAAQNLLSLEAGVNLMNPAVLVGLLLGAMLTFYLSSVGIHAISRGGAAVVNEVRRQFDEIDGVRSGDTKPDYARCVDITTGAALREMMLPGVVVLVAPVVVGALPGLGVEALAGLLAGVLMSGFLTAIFMSNAGGAWDNAKKYIESGVHGGKGSEAHKASVVGDTVGDPLKDTAGPSLNVLIKLMGKVAVIFLPLFAYLLG

SEQ ID NO: 43295 - protein, 323 aa, Coccidioides immitis RS
MGSPIFRRYLNRHFIRTLKRSYSTAAHPENIPTPGGLPPLIRGTQDAPSSGALTNKPSLEDYCFYRDTLPPKPSQLEYADHFFAASKHSPVYLWGSSLFRTIPVSSIPEIAFIGRSNVGKSSIINGLVGEDICASSSKPGRTKLMASIGVGGTKGGGSKIALVDTPGYGKGSHTEWGQEIHKYLEKRKQLRRIFLLIDAGVGLKTRDHQVLNFLRRFAIPYQLVLTKLDHALSFNGHKNKTKPNDSRSDLIRFSQTVQDILSSAQPVNPILDGPGPLNDVIACSVQMQSKKQKKSVAGLSSLRWAILLATGFDQIPKGFKLKR

SEQ ID NO: 43296 - protein, 367 aa, Sulfolobus solfataricus P2
MFDPASFVEEIGPQLRQKLGNEKVLAAVSGGVDSTTAAVLAYNLLGDKVIPVLVDTGFLRKNEAEKIKDYLSNILPNLIIVDKKETFISEIEGIDDAEMKRKRFRELFYSTISSLMKKFNARYLMQGTIAADWVETQGGIKTQHNVLVQIGIDTEKEWGFTLIEPLADLYKNEVRELARYLKLPKEISERQPFPGPGLLVRAVGKLTREKLEVVREANDIVEKYLDPFNYSQYFAVSFESYGNLVNLDGIDAFLYKARATGVKGDVRAYGNIAKIECSNINNVKNIIDTLVKYDITHVLCTLDERNSGKYSVAIRAVTTEDFMTADYVRIPKEILSKISSEILQKIPNVKEVLYDVTSKPPATIEFE

SEQ ID NO: 43297 - protein, 270 aa, Oceanobacillus iheyensis HTE831
MNQTIAFMGAGSLAEAIISGITKAQIVPNENILVTNKSDINRLKRIEEGYDIQGNTNKQEVIKQADIIILAMKPKDAATSLSFMKEYIRPDQMVISVIAGLTTERMEAILEKEIPVIRTMPNTSALIGYSATAIAKGSYVTDEQLAVAEQLFQTVGMTTIIKEKDMHTVTAIAGSGPAFFYYMVEAMEQAAVEAGLDAEMASQLIAQTVIGAGKMLELSGDPITLRKNITSPGGTTEAGVQQLMSEDFASIVQSCVQRARERSMELAAKS

SEQ ID NO: 43298 - protein, 277 aa, Nostoc sp. PCC 7120
MFRLETPSMSFTNKTIVLTGASAGIGRMLAISLSQQDANLVLAARNQEALEQTMTACTNYPGKVIAVHTDVTQAEACQQLIERAIATFGQIDILINNAGIGMLTRFDEVTDISIFEQVMQANYLGAVYCTHYALPYLKASQGQLVAISSICGKTGVPTRTGYVASKHAMQGFFDTLRIELHSTGVDVLVVSPGFVATDIRQRALGADGKPLGKSPRDETQGNMSVDECVRQIIWAMERRKREHIMTLKGKVIPWAKLILPGFVDRIVAATIRKTTST

SEQ ID NO: 43299 - protein, 514 aa, Bacteroides thetaiotaomicron VPI-5482
MKELIKNLEELNRKAEKGGGDARIEKQHSVGKLTARERIDLLLEKGSFIELDKLVTHRCTDFGMEKQKFSGDGVVTGYGMIGKRLVYVFAQDFTVFGGALSETHAKKICKVMDMAMQMGAPIIGLNDSGGARIQEGVRSLAGYAEIFLRNSMASGVIPQISAIMGPCAGGAVYSPALTDFILMVKNSGYMFITGPDVVKSVTQEEVSKEDLGGVGIHMTKSGVAHLSAENDIECINYIRELISYLPGNNMEEPPFVVTNDSPTRLTPELSDLVPTNPNQPYNIKEMIEAVADDNNFFELQAEFAANIVTGYIRLNGKTIGVVANQPLVLAGTLDINASIKAARFVRFCDAFNIPLLTLVDVPGFLPGVDQEYGGIIRNGAKLLYAYCEATVPKVTVITRKAYGGAYDVMSSKHIRGDVNLAFPTAEIAVMGPDGAVNILFKKEIEKSQTPEERRKELQSDYREKFANPYRAAELGYVDEVIDPAVTRLRLIRSFEMLANKRQSNPPKKHSNIPL

SEQ ID NO: 43300 - protein, 411 aa, Salinibacter ruber DSM 13855
MSPSGERITVDDGTLHVPDTPIIPYIEGDGVGADIWAAARPVFDAAVETAYDGERAIEWTEVLAGEKAKEHTGDLLPENTVETIREHRVAIKGPLTTPVGAGFRSLNVALRQKLDLYANVRPTYYIDGVPSPMKNPEQMDMVTFRENTEDVYAGIEWEAGTEGAEQVRAFVEDQMGFDDTIHDGPVGIGIKPITEFGTKRLVREAIDYALESDGHQFVTLVHKGNIMKFTEGAFRDWGYEVAREEYGDAVITEDTLWEERDGDPPEDAVVVNDRIADNMLQQVQTRTDQYDVLAMPNLNGDYLSDACGAQIGGLGVAPGANFGDAACLAEPVHGSANKYAGQDKVNPSALILSGRLMFEYMGWDEASAVILESLAETIQQKRVTYDFERNLEDAELLKCSEFGQAVVENMR

SEQ ID NO: 43301 - protein, 422 aa, Legionella pneumophila subsp. pneumophila str. Philadelphia 1
MHIHKIQAREILDSRGNPTIEADVTLTTGIIGRASVPSGASTGSREACELRDNDPKRYAGKGVQKAVKHVNNEINQALQGLSVEDQENLDRILCQLDNTENKSHLGANAILATSLACARARALSLNQPLYMTLNQGDMMTMPVPMMNILNGGAHADNNVDIQEFMIMPIGAPDFPVALQMGTEIFHVLKSVLKKQGLNTAVGDEGGFAPNIQSNRQALDLLSEAIEKAGFRLGEDIVFALDVAASELFNEGFYHMYSENQKFDSHQLIEYYANLISSYPIVSIEDGLDEKDWSGWKQLTTHLGNKVQLVGDDLFVTNPKILREGIAQGIANAILIKVNQIGTLSETRQAIKLAYDNGYRCVMSHRSGETEDTFIADLAVASGCGQIKTGSLCRTDRTAKYNQLLRINELASLPYAGKNILKR

SEQ ID NO: 43302 - protein, 322 aa, Legionella pneumophila subsp. pneumophila str. Philadelphia 1
MTSRRLTMHWFAQAPANIALIKYMGKKDENSNLPDNSSLSYTLSNLLSSVKLEKLPTKKDIWEPLTIPGAPEFNLSVEAQKRFIDHLVRLKEYFGYVGGFLIQSSNNFPHSSGLASSASSFAALTKCASIALSELTQKPLPSIDEQAQLSRLGSGSSCRSFYAPWALWTGDKVSAIDLPYKDLLHQVIVISSQEKEIPSRVAHKLVKTSPFYETRSERAEANLKLLLNAFENKDWTSIYQICWHEFLDMHQLFKTCEKPFSYITDNTLHILSVIEKFWNEKGDGPVVTMDAGPNVHLLYRSDQTDLARQFKSDHLVGNYDVL

SEQ ID NO: 43303 - protein, 568 aa, Xylella fastidiosa Dixon
MSSSSIEDIKGKSHRLRGSLLESLANPTTGALRESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLISRAHADLYTDAAHLSEHLLPNTRAYYEIWLDEKKVAGAGEEEEPIYGPHYLPRKFKIGFAAPPINDVDVFANDLGFIAVIVDKTLLGYNVTIGGGMGTTHGDPDTWPRIGNIIGFITRADLITISTAIVTTQRDFGNRTLRKRARFKYTIDDRGLDCIVGEIQQRAGITLQPARPFVFEHNGDRYGWIEGEDGHWHLTLLLPAGRIADTEGSTLLSGFREIAQLGIGEFRMTPNQNVVIAGISPGQRAAIDALVTQYGLDTGNRAPTALARHAMACVALPTCGLAMAEAERYLPDFNAKLQPILEKYGLAETPILLRISGCPNGCSRPYLAEIALVGKAPGRYNLMLGGDQRGQRLNTLYRENITETEILAALEPLLGRYQQKRLPSEGFGDFLHRTGIIALPPYPTHRHVISSTLQA

SEQ ID NO: 43304 - protein, 374 aa, uncultured archaeon GZfos17F1
MDEKTIGSTLYDLKSKDTPYERVLSSMCTYPHPVAVAAHQQFIETNLGDPGLFAGTAEIEHEVVRMMGTLFGNPDAHGYVTTGGTESNIQAIHAIKTARKVRDPNIIVPASAHFSFDKVADILGIDVLKADLDPEFRADISSVEDLINETTIGIVGIAGTTEFGQIDPIKELSDLALSKNIFLHVDAAFGGFVIPFLTEKYEFDFTLPGVTSIGADPHKMGFATIPSGGLLFQDSSYLNRLSVDTPYLTVNSQQTLSGTRSGASAASAYAVFKHLGRTGYERIVQRCMELTYELVARASESGIEPLIDPVTNVLVLDVPDADSVRSALKKRGWDVSITRDPRALRLVIMPHISSENLNLFADDLADVVKWMSAN

SEQ ID NO: 43305 - protein, 121 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEML

SEQ ID NO: 43306 - protein, 298 aa, Sulfolobus tokodaii str. 7
MMSSNPFRISSPQPQKQPRDLRKVNQQVQAADLKIQMKMKTVKYKIAVLSGKGGVGKSFVSSNLAMALAAAGRSVGIVDVDFHGPSVPKMLGVRGQYLTADDKGGINPVIGPFGIKVVSIDFLLPRDDTPVVWRGAIKHTAIKQFLGDVNWGELEYLIIDMPPGTGDEALSVAQLVPNLTGMIIVTIPSEVSTLAVKKSINFAKTINAKILGVIENMSYFLCPSDNKPYYIFGEGKGKQMAEEMGVPLLGQIPLDPIVAQANDLGEPFFLKYPDNPASKEFMRIAEQVIHIVENSNQQ

SEQ ID NO: 43307 - protein, 821 aa, Saccharomyces cerevisiae
MENITQPTQQSTQATQRFLIEKFSQEQIGENIVCRVICTTGQIPIRDLSADISQVLKEKRSIKKVWTFGRNPACDYHLGNISRLSNKHFQILLGEDGNLLLNDISTNGTWLNGQKVEKNSNQLLSQGDEITVGVGVESDILSLVIFINDKFKQCLEQNKVDRIRSNLKNTSKIASPGLTSSTASSMVANKTGIFKDFSIIDEVAGQGAFATVKKAIERTTGKTFAVKIISKRKVIGNMDGVTRELEVLQKLNHPRIVRLKGFYEDTESYYMVMEFVSGGDLMDFVAAHGAVGEDAGREISRQILTAIKYIHSMGISHRDLKPDNILIEQDDPVLVKITDFGLAKVQGNGSFMKTFCGTLAYVAPEVIRGKDTSVSPDEYEERNEYSSLVDMWSMGCLVYVILTGHLPFSGSTQDQLYKQIGRGSYHEGPLKDFRISEEARDFIDSLLQVDPNNRSTAAKALNHPWIKMSPLGSQSYGDFSQISLSQSLSQQKLLENMDDAQYEFVKAQRKLQMEQQLQEQDQEDQDGKIQGFKIPAHAPIRYTQPKSIEAETREQKLLHSNNTENVKSSKKKGNGRFLTLKPLPDSIIQESLEIQQGVNPFFIGRSEDCNCKIEDNRLSRVHCFIFKKRHAVGKSMYESPAQGLDDIWYCHTGTNVSYLNNNRMIQGTKFLLQDGDEIKIIWDKNNKFVIGFKVEINDTTGLFNEGLGMLQEQRVVLKQTAEEKDLVKKLTQMMAAQRANQPSASSSSMSAKKPPVSDTNNNGNNSVLNDLVESPINANTGNILKRIHSVSLSQSQIDPSKKVKRAKLDQTSKGPENLQFS

SEQ ID NO: 43308 - protein, 176 aa, Wolbachia endosymbiont of Drosophila ananassae
MHLFCFGYGYVAKFLSKKLLNLGWKVSGTSRSKNIQDVILFNYEKVSQDLLKSATHVLISIPPDGDDVVERYGDCLQNVKWLGYLSATSVYGDHSGNWVDEESETRPIEIRGEKRLKSEKKWLNSKLPVHIFRLAGIYGPGRNVLFDLQLAKQKCEKERHFFLVFTLKIYRIFYFS

SEQ ID NO: 43309 - protein, 154 aa, Brassica napus
MVALTAEKQDHNLLSRMAAGDGHGENSAYFDGWKAYEENPFHPIDRPDGVIQMGLAENQLCGDLMRKWVLEHPEASICTAEGVNQFSDIAIFQDYHGLPEFRQAVAKFMEKTRNNKVKFDPDRIVMSGGATGAHETVAFCLANPGDGFLVPTPY

SEQ ID NO: 43310 - protein, 384 aa, Picea sitchensis
MSTQGQVITCKAAVAWEPNKPLVIEDVEVAPPQAGEVRIKILYVALCHTDAYTWSGKDPEGLFPCILGHEASGIVESVGEGVTEVQPGDHVIPCYQAECRECKFCKSGKTNLCGKVRSATGVGLMLSDMKSRFSIKGKPIYHFMGTSTFSQYTVVHDVSVAKVNEQAPLEKICLLGCGVPTGLGAVWNTAKVEAGSIVAIFGLGTVGLAVAEGAKAAGASRIIGIDIDSNKFATAKNFGVTEFVNPKDSDKPIQQVIVDMTDGGVDYSFECVGNVSLMRAALECCHKGWGTSVIVGVAASGQEISTRPFQLVTGRVWKGTAFGGFKSRSQVPWLVEKYMKKEIKVDEYITHNMTLDQINEAFHLMHGGKCLRIVLKMHAELGNL

SEQ ID NO: 43311 - protein, 260 aa, Enterococcus faecalis V583
MTETQKFIQTIQSWLFEAADVIRMNLESELTVQQKNGRTDLVTNMDEQTQEFLMNKIQTNFPEDQILGEEKGYNTLKSFAGRVWIIDPIDGTMNFVMERENFCIMLAVYEDGIGKLGFIYDVMREELYWGGKGLGVYRNNQLLKAPTMKALADGLWGMNAYMHGKNIHHATEIGQASMGVRISGCAGLEIIAMLKGNHHGYLSNLSPWDYAAGLVLLEEFGFKYSGITGKPLTFAGREYFIAATPETYDEVFTRYLNESE

SEQ ID NO: 43312 - protein, 240 aa, Triticum aestivum
MTVVDAETRFHVLAVDDSVIDRKLIEMLLRTSSYQVTTVDSGSKALEVLGLRDEGDDSSSSSSPPSSSAPDHHQEVGVNLIITDYCMPGMTGYDLLRRVKGSSSLKDIPVVIMSSENVPARISRCLEDGAEEFFLKPVKLADMKKLKSHLVRRKQPQLQPQTHEKPQPQPQQQQQKPQPEQQLKAEQAPAEPAAEEEAVTAGGITGDCGGGSRKRKAAMMEQDGASTSLSSGSSGLAVET

SEQ ID NO: 43313 - protein, 179 aa, Pyrococcus furiosus DSM 3638
MAQKILVEQVVKRKAIVVQPKDTVDRVAKILSRNKAGSAVVMEGDEILGVVTERDILDKVVAKGKNPKEVKVEEIMTKNPVKIEYDYDIEDVIELMTEKGVRRVLVTKFGKPIGFVTAADILAALASHNHEEEEEEREEESEVYGICEVCGQYGALYKVYHEGRELWVCETCKDLIEGR

SEQ ID NO: 43314 - protein, 322 aa, Zea mays
METLLAGNPANGVAKPTCNGVGALPVANSHAIIATPPAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMLIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 43315 - protein, 429 aa, Salinibacter ruber DSM 13855
MASIQRVTARQILDSRGTPTVEVDVTTGEGVLGRAAVPSGASTGAYEAVELRDGDADRYHGQGVLRAVGHVNDAVADALHGMSVLEQVAIDDTLRALDGTEDKSNLGANAILGASLAAAKAGAATLGVPLYRHLGRATARTLPVPLMNILNGGEHADNNVDMQEFMIAPAGADSFSEALRTGAEVFHTLASVLQDRDYSTAVGDEGGFAPDLGSNEEAVELILDAIEKAGYTAGSDVFVALDPAAAEMVEDEAYVFWKSDPDTERSSEDMVEYWAEWVDRYPILSIEDAMDEDDWDGWAMLTDAIGDEVQLVGDDLFVTNTKRLTRGVEEGCGNSILIKPNQIGTLTETLNAIETAHTHGFTAIISHRSGETEDTTIADLAVATGTGQIKTGSASRSDRVAKYNQLLRIEEQLGATAHYPRLDAFPLTN

SEQ ID NO: 43316 - protein, 523 aa, Hordeum vulgare subsp. vulgare
MARGGGNGEVELSVGVGGGGGGAAAGAAEPAVQISLGRLILAGMVAGGVQYGWALQLSLLTPYVQTLGLSHALTSFMWLCGPIAGLVVQPCVGLYSDKCTSRWGRRRPFILTGCVLICLAVIIVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLSLALVITLIFAKEVPYKAIAPLPTKANGQVEVEPTGPLAVFKGFKNLPPGMPSVLLVTGLTWLSWFPFILYDTDWMGREIYHGDPKGTPAEANAFQEGVRAGAFGLLLNSVVLGFSSFLIEPMCKRLGPRVVWVSSNMLVCLSMAAICIISWWATQDLHGYIQHAITASKEIKAVSLALFAFLGIPLAILYSVPFAVTAQLAANKGGGQGLCTGVLNIAIVIPQVIIAVGAGPWDELFGKGNIPAFGMASVFALIGGVVGIFLLPKISRRQFRAVSGGGH

SEQ ID NO: 43317 - protein, 213 aa, Oryza sativa
  misc_feature (204)..(204): Xaa can be any naturally occurring amino acid
PLSYFRCCVREREMATSEEVVAAAPEAAAPEAGLKHKLERKWTFWCDNQSKPKQGAAWGTSLRKVYTFDTVEEFWCLYDQVFKPSKLQINADFHLFKTGIDPKWEDPECANGGKWSITSNSGRKANLDNMWLETMMALIGEQFEDAEDICGVVASVRQWQDKLSLWTKTAANEAAQMSIGRKWKEIIDVNDKITYNFHDDSRSXGSTKGRYTV

SEQ ID NO: 43318 - protein, 165 aa, Prunus serrulata
ILPSSKTEIAVKRVSHESRQGMKEFVAEIISIGRLRHRNLVPLLGYCRRKGELLLVYDYMPNGSLDKYLYDQPVVTLNWRQRFIVIKGVASGLFYLHEEWEQAVVHRDVKASNILLDSEFNARLGDFGLAILYDHGKDPKTTRVVGTLGYLAPENARLGRATTHT

SEQ ID NO: 43319 - protein, 99 aa, Nostoc sp. PCC 7120
MASYQVRLINKKQDIDTTIEIDEETTILDGAEENGIELPFSCHSGSCSSCVGKVVEGEVDQSDQIFLDDEQMGKGFALLCVTYPRSNCTIKTHQEPYLA

SEQ ID NO: 43320 - protein, 366 aa, Brassica napus
YGEWHPKNKETILTSSEDGSLRIWDVNNFLSQTQVIKPKLARPGRIPVTTCAWDREGKRIAGGIGDGSIQIWSLKPGWGSRPDVYVGKAHTDDITSVKFSSDGRILLSRSFDGSLKVWDLRQMKEALKAFDGLPNYYPQTNVAFSPDEQIILTGTSVEKDSTIGGLLCFYDRTKLEIVQKVGISPTCSVVQCAWHPRLNQIFATSGDKSQGGTHILYDPTQSERGACVCVARAPRKKSVDDYQPEPVIHNPHALPLFRDAPSRKRQREKTLKDPLKAHKPELPMTGPGHGGRVGTTGSGLLTQYLLKQGGMIKETWMEEDPREAILKYADVAVKDPKFIAPAYSQTQPETIFAKSDDEEEAGDAKK

SEQ ID NO: 43321 - protein, 830 aa, Oryza sativa Japonica Group
MDSSTVGAPGSSLHGVTGREPAFAFSTEVGGEDAAAASKFDLPVDSEHKAKTIRLLSFANPHMRTFHLSWISFFSCFVSTFAAAPLVPIIRDNLNLTKADIGNAGVASVSGSIFSRLAMGAICDMLGPRYGCAFLIMLAAPTVFCMSLIDSAAGSSALVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGRRPPLEHLDPPDRRRRAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGSPWAPSATCSARATAAPSSSCSPRPPSSACRSSTSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGQLRRRAQAAALLHVVEWGSMFLPPNAGAEEEHYYGSEWSEQEKSKGLHGASLKFAENSRSERGRRNVINAAAAAATPPNNSPEHA

SEQ ID NO: 43322 - protein, 113 aa, Zea mays
SGPVVPLPRGHRRVHRHAALPLHHRDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 43323 - protein, 165 aa, Prunus serrulata
ILPSSKTEIAVKRVSHESRQGMKEFVAEIISIGRLRHRNLVPLLGYCRRKGELLLVYDYMPNGSLDKYLYDQPAVTLNWRQRFRVIKGVASGLFYLHEEWEQVVVHRDVKASNVLLDRELNGRLGDFGLARLYDHGTDPQTTHIVGTLGYLDPEHTRSGRATTST

SEQ ID NO: 43324 - protein, 197 aa, Parvularcula bermudensis HTCC2503
MAKEPQQGGRGRGRGKGRDEERDEFTDRLVAINRVSKTVKGGKNFGFAALVVVGDQKGRVGFGKGKAREVPEAIRKATQEAKRSLVRVPLRDGRTLHHDAYGRHGAGKVVLRTAPPGTGVIAGGPMRAVFEMLGVQDVVAKSLGTSNPYNMVRATVDALKNQHNPRSVAAKRGMKVSELVNRRAAVQPDAAASADAA

SEQ ID NO: 43325 - protein, 116 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLV

SEQ ID NO: 43326 - protein, 487 aa, Oryza sativa Japonica Group
MAAHGRAAAHGDERDAEAASCHGGRAGEGNGGVRWRPWSRRWRCSGVGRATATEVEGGGGRGRTVRRRDVAGHGARRDGEEFPWRQGSAAWGGNEARKGGSTGGGSEPRLVKAATEQLNKLPFYHSFWNHTTRPSLDLAKELISMFTAREMGKVFFTNSGSEANDSQVKIVWYYNNALGRPKKKNIISRTQSYHGTTFISASLSGILICQDVLFCTQTALTTGASISLSAFFDEINDFCGRQIAAFIAEPVIGAGGVILPPKTYFEKIQAVVKKYDILFIVDEVITGFGRLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 43327 - protein, 374 aa, Geobacter metallireducens GS-15
MKAVLALADGRIFEGKSFGATGEATGEVVFNTAMTGYQEVLTDPSYRGQMVTMTYTQMGNTGINPEDIESKQLYLSGFIVKEYHDCYSNWRATMSLDAYLKENGVVGIQGLDTRALTRHLRDKGAQNGIISTVDFDHESLVKKARAVPSMAGLDLASGVTCDKPYHWTEKLWDLEAGYNAAKQEDLKYKVVAYDFGIKYNILRCLVSAGCDVTVVPATFPAEEALAMNPDGIFLSNGPGDPEPMTTVIENIRKFVGKKPIFGICLGHQLLGLALGGKTMKLKFGNHGSNLPVMDMDTRKVEITAQNHGFSVDIVSLGHACELAHENLNDQTVEGMKHKDLPIFSVQHHPEASPGPHDSHYLFGRFVELMEKHKS

SEQ ID NO: 43328 - protein, 190 aa, Zea mays
ARGDGDQLNGVHEKGVHDLWRVLKDEICLPLMISLCQLNGLRLPPCLMALPADLKTKVLGFLPGVDLAKVECTCKEMMNLASDDSIWKKLVSKFENYGEGSRLAGKNAKAIFVEAWQANKRRQKRPNPTFWNYGWGNSPYSRPLRLPLIGGDSDRLPFIGNHGSVGRHFGNQRRNISPNCILDGHRHNFL

SEQ ID NO: 43329 - protein, 549 aa, Hordeum vulgare subsp. vulgare
MAAAATRRAASSLVSRCLLSRPAASPAAVPSALRRADGARGLLPGLLQRFGTAAAAEEPISPSVQVGETQLLINGKFVDAASGKTFPTLDPRTGEVIARVSEGDAEDVDRAVVAARKAFDEGPWPKMTAYERSRILLRFADLIEKHNDEIAALETWDNGKPYEQAAHIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIISGFGPTAGAALAGHMDVDKIAFTGSTDTGKVILELSARSNLKAVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDDMKIAQEEIFGPVQSIFKFNDLNEVIKRANASQYGLAAGVFTNNLDTANTLTRALRAGTIWVNCFDIFDAAIPFGGYKMSGIGREKGIDSLKNYLQVKAVVTALKNPAWL

SEQ ID NO: 43330 - protein, 185 aa, Haloarcula marismortui ATCC 43049
MFDRLKADIRTALTKDPAATSAMEVALTYPGLHAIWAYRVAHWLWANDRALLARLISHVARFLTGVEIHPAAEIGERVFIDHGMGIVIGETAEIGDDVLLYHGVTLGGTSMRREKRHPTVKDGATIGADASIMGPITVGENASVGAGAVVVDDVTPDTTVVGNPAEPVGAAGVASPNPDPIIADG

SEQ ID NO: 43331 - protein, 390 aa, Anabaena variabilis ATCC 29413
MQFAKRLEKIPPYLFAEINRKREALIAQGVDIINIGVGDPDKPTPAHILQAMREAIDEASNHNYPPYEGTQEFREAAVKWMERRFGVVDLNPNTEVVSSIGSKEAIHNTFLAFVEAGDYTLIPDPGYPVYRTSTIFAGGEPFTMPLKAENKFLPDLDLIPEEVARKAKMLWVNYPNNPTGALATLEFFEELVAFCQQHSILLCHDHAYSEMAYDGYKPPSVLQIPGAKDIAIEFHSLSKSYNMTGWRIGFAVGNAYAIQGLSQVKTNVDSGVFKAIQKAAIAAYNTDEVELQAVMSVYQNRRDIIVKGLQSLGWPIEPPKATLYVWVPVPPGYTSTEFTTLLLDKCGIVVPPGVGYGVSGEGYFRIALTICEERLHEAIQRMQDAGIRYS

SEQ ID NO: 43332 - protein, 118 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEY

SEQ ID NO: 43333 - protein, 453 aa, Saccharomyces pastorianus
QTAKVIADVTSRYPEGDTTITGPIIATTLALLCGIISAAVGFLRLGFLVEFISLNAVAGFMTGSAFNILWGQVPALMGYNKLVNTRVATYKIVIDSLKHLPDTTLDAVFGLIPLFILYTWKWWCGTYGPKLNDRFNSKRPRLHKIVKWTYFYAQASRNGIIIIVFTCIAWAITRGKSAADRPISVLGSVPSGLKEVGVFHVPPGLMSKLGPNLPASIIVLLLEHIAISKSFGRVNDYKVVPDQELIAIGVSNLLGTFFNAYPATGSFSRSALKAKCNVRTPLSGLFSGSCVLLALYCLTGAFFYIPKATLSAVIIHAVSDLLASYQTTWNFWKMNPLDFVCFIVTVLITVFSSIENGIYFAMCWSCAIFILKVAFPAGKFLGRVEIAEVTDAYVRADSDSVSFTSENNNRILTLEEDTTDGEKEGRTGYIINSSKKLDTKVQTKGFESPSPSI

SEQ ID NO: 43334 - protein, 119 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYE

SEQ ID NO: 43335 - protein, 253 aa, Xylella fastidiosa Dixon
MSESSEKTSTTHFGFRQVAAKDKKTLVAEVFTSVSRRYDLMNDLMSLGIHRAWKRYFVATAQVKSGDRVLDLAGGTGDIAMLLKNRVGAEGSIVLGDINASMLSVGRDRLIDRGVVARLEYVQCNAEALPFQDKCFDLVTMSFGLRNVTDKDTALREMFRVLKVGGQARVLEFSTVTAEWFKPIYDFHSFQVLPRLGWLFARDAASYRYLAESIRKHPPQEELQAMMGAAGFERCGYRNLTGGIVAIHSGYKY

SEQ ID NO: 43336 - protein, 361 aa, Xanthomonas oryzae pv. oryzae KACC10331
MTGLVIDDATICRLPCNASAVPTITPNSQAIYLCRLVFFVKLRCPADDFVNADFDAYCAASHMHGRSRRDFAAPSAWRCTANVLQKTSAWIVQIHAESAIIAFMSVNLKTKEEIELMRVAGRLAAEVLDVVARYVQPGVTTAELDRICHDHIVNVQGTIPANVGYRGFPKSVCTSVNNVICHGIPSAAKVLKDGDIVNIDVTVIKDGWHGDTSRMYYVGTPSVMAKRLVDTTYEAMWRGIRAVKPGATLGDVGHAIQKFAESERFSVVRDYCGHGIGKVYHDEPQVMHYGRPGEGLVLKPGMTFTIEPMINEGTYHHKTLPDGWTVVTKDRKLSAQWEHMVAVTEDGVDVLTLSANSPAPV

SEQ ID NO: 43337 - protein, 356 aa, Saccharomyces cerevisiae
MSVSYKGTISKTHSVFKPEKGRYYIYGALGCPFTHRAILARSLKKLEPVLGLVLSHWQLDSKGARFLPAPHRPEKYKERFFTATGGIASAKLDESEELGDVNNDSARLFVDGAFDPVENISRLSELYYLNDPKYPGTKFTVPVLWDSKTRKIVNNESGDIIRILNSGVFDEFIQSEETNVIDLVPHDLIDEIDKNIKWVHPKINLGVYKVGLAENGKIYETEVKTLFENLQKMECVLKENYKRLEEQFSGNKQKILAKYFVLGQRLTEADIRLYPSIIRFDVVYVQHFKCNLKTIRDGFPYLHLWLINLYWNYAEFRFTTDFNHIKLFYIRMEVSRNKINQFGIVPLGPKPDISRL

SEQ ID NO: 43338 - protein, 507 aa, Saccharomyces cerevisiae
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGADPFGSILAQPENLNKTDITDYKVEGIGYDFVPQVLDRKLIDVWYKTDDKPSFKYARQLISNEGVLVGGSSGSAFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 43339 - protein, 143 aa, Burkholderia thailandensis E264
MSGDRDDKRYPYPKDDAELRRRLTPMQYEVTQHAATERPFTGEYTDTEDAGIYHCVVCGTALFESGAKYHSGCGWPSYFKPIDAEVIDEKMDYTHGMTRVEVRCNQCGAHLGHVFEDGPRDKTGLRYCINSAALNFEAKPEWK

SEQ ID NO: 43340 - protein, 295 aa, Anabaena variabilis ATCC 29413
MGKNIMTLSVAHLGPPGTYAEQATIFYVKWLSHSSGLEASLRPYSSIAQSLQALAQGETQLAVVPVENSIEGSVTMTMDTMWQLDSLQIQSALILPIAHALISCADSLDGIKTVYSHPQALAQCQGWLRAFLPNVQLIPSNSTTEALEKLEYDLSIGAIASSRAAELYNLPILASRINDYAENCTRFWVISQAESDITHQLPLQKLTHTSIAFSVPANVPGALLKTLQVFAHLDINLSRIESRPTKRSLGEYLFFIDLEADVNTPQMKSALLELTTYTEVLKIFGSYSVLSANDQ

SEQ ID NO: 43341 - protein, 525 aa, Aspergillus nidulans FGSC A4
MNGQLQSNPDILSTLKDIPSASHNGNWVVQKFGGTSVGKFAHNIIDQVVLPSLSHNKVAVVCSARSSSTKAEGTTNRLLRAARDAENSQSKQYLSFVEAVRLEHVDVVESQINSAELRTQLTSAINAECERVLKVLEAAQTLGEISARCVDKVISTGEKLSCRLMAAFLQDRGVDSEYVDLSEIVDFHISGQGLDQEFYDNLAAALGRKVHACENKVPVITGYFGTIPGGLLDQIGRGYTDLCAALVAVGVQAGELQVWKEVDGIFTADPRKVPTARLLPAITPAEAAELTFYGSEVIHPFTMEQVIRAKIPIRIKNVMNPKGDGTVIFPDSTYELERTTPGHDPRLFRTRSPSLLQRPKRPTAVTIKHNILVINVHSNKRSLSHGFFAGIFSVLDRWKLSIDLISTSEVHVSMALHSERPLLNGVGRDEYQIIDEDLKGALSDLQRYGTVDIIPGMAILSLVGKQMKNMVGVAGRMFSTLGENNVNIEMISQGASEINISCVIEERDADRALNIIHTSLFTFLD

SEQ ID NO: 43342 - protein, 503 aa, Panax ginseng
MAIRIPTRQLFIDGEWREPAKKNRIAIINPATEQIIGNIPAATSEDVDIAVEAARRALARNGGSDWASASGAYRAKYLRAIAAKITERKSELAKLETLDCGKPLEEAAWDIDDVAACFEYNADLAEALDGKQKSPISLPMETFKSYILKEPIGVVGLITPWNYPMLMATWKVAPALAAGCAAILKPSELASVTCLELGEVCKEVGLPPGILNILTGLGPEAGAPLASHPHVDKIAFTGSTATGSKIMTAAAQQVKPVTLELGGKSPILVFEDVDLDKAAEWTIFGCFWTNGQICSATSRLLVHESIAAEFLDKLMKWTKNIKISDPLEEGCRLGPVVSGGQYEKVMESISTAKKEGATILCGGARPKHLEKGFFIEPTIISDVTTSMQIWREEVFGPVLCVKTFRTEDEAIELANDTRYGLGGAVISNDLERCERVTKALQSGIVWINCSQPCFCQAPWGGKKRSGFGRELGEWGLDNYLSVKQVTQYVSDEPWGWYQSPSKL

SEQ ID NO: 43343 - protein, 414 aa, Saccharomyces cerevisiae
MAKTTKVKGNKKEVKASKQAKEEKAKAVSSSSSESSSSSSSSSESESESESESESSSSSSSSDSESSSSSSSDSESEAETKKEESKDSSSSSSDSSSDEEEEEEKEETKKEESKESSSSDSSSSSSSDSESEKEESNDKKRKSEDAEEEEDEESSNKKQKNEETEEPATIFVGRLSWSIDDEWLKKEFEHIGGVIGARVIYERGTDRSRGYGYVDFENKSYAEKAIQEMQGKEIDGRPINCDMSTSKPAGNNDRAKKFGDTPSEPSDTLFLGNLSFNADRDAIFELFAKHGEVVSVRIPTHPETEQPKGFGYVQFSNMEDAKKALDALQGEYIDNRPVRLDFSSPRPNNDGGRGGSRGFGGRGGGRGGNRGFGGRGGARGGRGGFRPSGSGANTAPLGRSRNTASFAGSKKTFD

SEQ ID NO: 43344 - protein, 540 aa, Brassica napus
MNTFTSNSSDLTSTTTQTSPFSNMYLLTTLQAFAAITLVMLLKKVFTTDKKKLSLPPGPTGWPIIGMVPTMLKSRPVFRWLHSIMKQLNTEIACVRLGNTHVITVTCPKIAREILKQQDALFASRPMTYAQNVLSNGYKTCVITPFGEQFKKMRKVVMTELVCPARHRWLHQKRAEENDHLTAWVYNLVKNSGSVDFRFVTRHYCGNAIKKLMFGTRTFSENTAPDGGPTAEDIEHMEAMFEALGFTFSFCISDYLPMLTGLDLNGHEKIMRDSSAIMDKYHDPIVDARIKMWREGKRTQIEDFLDIFISIKDEQGNPLLTADEIKPTIKELVMAAPDNPSNAVEWAMAEMVNKPEILHKAMEEIDRVVGKERLVQESDIPKLNYVKAILREAFRLHPVAAFNLPHVALSDATVAGYHIPKGSQVLLSRYGLGRNPKVWADPLSFKPERHLNECSEVTLTENDLRFISFSTGKRGCAAPALGTALTTMMLARLLQGFTWKLPENETRVELMESSHDMFLAKPLVMVGELRLPEHLYPTVK

SEQ ID NO: 43345 - protein, 387 aa, Sulfolobus tokodaii str. 7
MKFIQLYGDRGLTIVKGEGQYVWDISGTKYLDLHTGIGVAFLGHRNRRVIEYLSRQMENIMTLSTSFSTPIRDEMLKELDPLKPDKMDNIILLNSGTEAVEAALKTARKITGRKKIIAFKNSFHGRTAGSLSVTWNKRYREPFEPLMSPVQFLTYNNIDELKNIDEQTAAVIVEPIQGESGVIPANEDFMKALREQTQKVGALLVVDEVQTGFGRTGKVWAYQHYGIIPDLLTAGKAIGGGFPVSALFLPDWIAEKLEEGDHGSTYGGNPMAMAAVTAASKVLKEDNVVEQASIKGEIFKKILREKLSDLKSVREIRGKGLMIGIEIRFPPAIALKVMQDERVLALKAGSTVIRFLAPYMITQSDMEEASNAARKGIIETENKRAIT

SEQ ID NO: 43346 - protein, 176 aa, Burkholderia thailandensis E264
MRTTLKQTIGAIAEDCRRNAFFKTRCVVVFFRIANYLACRSKLTLALGAPVIALYIVVCDWIMGVEIPVKTKIGKGLTLYHGTGLVINGYCEIGERCVVRHGVTIGNTLRPDGSYSGVPTVGDDVEFGAHSIALGEIRIGHRARIGAGAVLLRDVPDGGVAVGVPARVLEKEKSAA

SEQ ID NO: 43347 - protein, 421 aa, Zea mays
MTDGSDEYKRDESVILLVIVSLAALSLLSLIAAFAYYCYITRKVSRRLQSLHLPKRSSSPPPPPPPRALPPPQQQGKDSPFSSSASDGAAAAAAAMSVVVAGERGVQVFSYRQLHAAMGGFGRAHMVGQGSFGTVYRGVLPDGRKVAVKLMDRPGKQGEEEFEMEVELLSRLRSPYLLGLIGHCSEGGHRLLVYEFMANGGLHEHLYPTRGSCGGISKLDWDTRMRIALEAAKGLEYLHERVNPPVIHRDFQSSNILLDKDFHARVSDFGLAKLGFDRAGGHVSTRVLGTQGYVAPEYALTGHLTTKSDVYSYGVVLLELLTGRVPVDMKRPPGEGVLVNWALPMLTDREKVVRILDPALEGQYSLKDAVQVAAIAAMCVQPEADYRPLMADVVQSLVPLVKNRSNQKACNPNVQSSKPLD

SEQ ID NO: 43348 - protein, 397 aa, Corynebacterium efficiens YS-314
MARRLIHEGFVPQDETEAWDATPGGHVLVRGGAVVAWWVPENASPDSGFRIIGSHTDSPGFKLKPRADLHSHGWQQAAVEVYGGPIYASWLDRELSLAGRVALCDGSIKLLNTGPIMRIPHVAIHLDRTVNSNLTLDPQEHLQPVLAVGDPELSVADVLAESAGVDPKDIIAHDLITVDTQAPEIFGAHGDFIAAGRLDNLSSVQPSMTALIAAAQSEDTGDDILILAAFDHEEVGSNSTTGAGGPLLEDVLHRTAHALGADEDQRRRMFTRSTMVSADAAHSIHPNHAGKHDPVNHPVIGGGPVLKVNANQRYTSDAVTSGMWIRACQAAGVPHQVFASRNNVPCGSTIGPISATRLGIPSVDVGIPLLSMHSAREMAGVKDLGWFEQALEAYLVH

SEQ ID NO: 43349 - protein, 371 aa, Streptococcus pneumoniae TIGR4
MALTAGIVGLPNVGKSTLFNAITKAGAEAANYPFATIDPNVGMVEVPDERLQKLTEMITPKKTVPTTFEFTDIAGIVKGASKGEGLGNKFLANIREVDAIVHVVRAFDDENVMREQGREDAFVDPLADIDTINLELILADLESVNKRYARVEKMARTQKDKESVAEFNVLQKIKPVLEDGKSARTIEFTDEEQKVVKGLFLLTTKPVLYVANVDEDVVSEPDSIDYVKQIREFAATENAEVVVISARAEEEISELNDEDKKEFLEAIGLTESGVDKLTRAAYHLLGLGTYFTAGEKEVRAWTFKRGMKAPQAAGIIHSDFEKGFIRAVTMSYEDLVKYGSEKAVKEAGRLREEGKEYIVQDGDIMEFRFNV

SEQ ID NO: 43350 - protein, 120 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEM

SEQ ID NO: 43351 - protein, 399 aa, Bacteroides thetaiotaomicron VPI-5482
MPTISIRGNEMPASPIRKLAPLADAAKQRGVHVFHLNIGQPDLPTPQAAIDAIRNIDRKVLEYSPSAGNRSYREKLVGYYAKFNINLTADDIIITSGGSEAVLFSFLSCLNPGDEIIVPEPAYANYMAFAISAGAKIRTIATTIEEGFSLPKVEKFEELINERTKAILICNPNNPTGYLYTRREMNQIRDLVKKYDLFLFSDEVYREFIYTGSPYISACHLEGIENNVVLIDSVSKRYSECGIRIGALITKNKEIRDAVMKFCQARLSPPLIGQIAAEASLDAPEEYSRETYDEYVERRKCLIDGLNRIPGVYSPIPMGAFYTVAKLPVDDSDKFCAWCLSDFEYEGQTVFMAPASGFYTTPGSGINEVRIAYVLKKEDLTRALFILQKALEVYPGRTE

SEQ ID NO: 43352 - protein, 310 aa, Sinorhizobium meliloti 1021
MKVFAGNSNRLLAEAICNYLNLPLGKATVRRFADQEIFVEIGENVRGEDVFIVQSTSFPTNDHLMELLIMIDAVRRSSARRITAVLPYFGYARQDRKPGPRTPISAKLVANLITEAGADRVLTLDLHAGQIQGFFDIPTDNLYAIPILARDVKENYNLKNVMVVSPDVGGVVRARALAKRLDCLLAIVDKRRDRPGESEVMNVIGEVNGKDCLLIDDIVDSGGTLCNAAEALLKNGATSVTAYITHGVLSGGAVARVTSSMLKELVITDSIQPTTAVQSAHNIRVISTAALLGEAISRTSQEESVSSLFD

SEQ ID NO: 43353 - protein, 502 aa, Sinorhizobium meliloti 1021
MLHQKIVENPYKQKYGNFIGGEWREPVAGRYFDNTTPITGGTLCEVARSDAADIEIALDAAHAAREKWGRTSTTERSNILMKIAARMEDNLELLARAETWDNGKPIRETMAADIPLAIDHFRYFAACIRAQEGSIGEIDHDTVAYHFHEPLGVVGQIIPWNFPILMAAWKLAPALAAGNCVVLKPAEQTPGSILVWAELIGDLLPPGVLNIVNGFGLEAGKPLATSPRIAKIAFTGETTTGRLIMQYASQNLIPVTLELGGKSPNIFFADVASEDDDFFDKALEGFAMFALNQGEVCTCPSRALVQESIYDRFMERAVKRVEAIRQGNPLDEATMIGAQASSEQLEKILAYIEIGKEEGAEVLTGGGRNVLEGDLSGGYYVKPTVFHGHNRMRIFQEEIFGPVVSVTTFKTEAEALEIANDTLYGLGAGVWSRDANRCYRFGRAIEAGRVWTNCYHAYPAHAAFGGYKQSGIGRETHKMMLDHYQQTKNMLVSYSPKALGFF

SEQ ID NO: 43354 - protein, 280 aa, Legionella pneumophila subsp. pneumophila str. Philadelphia 1
MNIKQNDTSTTPPILYGTAWKEDDTKRLVLQALNSGFRGIDTANQRRHYFEEAVGDAIDQFLTTSQKTRSDLFLQTKFTSVHGQDHRKPYDEFDSLTNQVKQSFASSLEHLQTDYIDAYILHGPSLSHGIIDADLEIWQAMEELVCSRKVKFLGISNVNMVQVEELYRKVSIKPSFIQNRCFAITQWDQDVRTFSQKNKIIYQGFSLLTANQRYLLNPHMQSLAVKYDKTIPQIIFRFANQVGILPLTGTTNQQHMDNDLNIYDFELTQEEIQYIENIGL

SEQ ID NO: 43355 - protein, 543 aa, Burkholderia xenovorans LB400
MPHSCLPGPICAVRKTALQRAFMSFDSLGLSEPLVRAVHELGYTTPTPIQTQAIPAVLNGGDLLAGAQTGTGKTAGFTLPILQRLNSSPAVANGSGKRAVRALILTPTRELAAQVEESVRAYGKYLKLKSTVMFGGVGINPQIGALRSGVDIVVATPGRLLDHMQQKTIDLSHLEILVLDEADRMLDMGFIHDIKRVLAKLPPKRQNLLFSATFSDEIKTLADNLLDSPALIEVARRNTTAETVAQKIHPVDRDKKRELLTHLIKQHNWFQVLVFTRTKHGANRLAEQLTKDGISALAIHGNKSQSARTRALAEFKDGTLQVLVATDIAARGIDIDQLPHVVNYDLPNVPEDYVHRIGRTGRAGATGEAVSLVCVDELQLLKDIEKLIKRPVPQEVVAGFEPDPTAKPEPILRRGQGGGGGGGGRSPRQGQGAPKRDDARRDGAGSAKPAQRSGQRPANGQQQPKPQGAKPAGNGGQPRRDGQRHDDRPRAVAHEGSAAQHAPRKPQAAKPQGGNPGALLGGTKPRNDAPRGGQPTRSGQRGR

SEQ ID NO: 43356 - protein, 323 aa, Xanthomonas campestris pv. campestris str. 8004
MGLLVDGKWQDRWYDTDKSDGRFERSQSHFRHWVTADGRAGPHGEGGFQAAPGRYHLYVSLACPWAHRTLIFRQLKGLASLIDVSVVHWLMGTQGWTFEHGPGVVGDSIHHAKYLYEVYLKADPQYSGRVTVPVLWDRERDTVVSNESADIIRMFNSAFDAVGAAEGDYYPEALRAQIDTINQRVYDTVNNGVYKAGFATTQAAYEEAVVPLFDTLDWLDTCLSTQRYLSGDYLTEADWRLFTTLIRFDAVYVGHFKCNLRRIADYPQLSGFLRELYQMPGIAETVNFQHIKSHYYQSHAMINPTGIVPMGPVLDLDAPHGRG

SEQ ID NO: 43357 - protein, 140 aa, Anabaena variabilis ATCC 29413
MAQTQETTTKTHTLPLPTTITSRSVAATELRPWGSFTVLEEGRGYKIKRIEVKPGHRLSLQMHHHRSEHWIVVSGTARVVCGEKEILLSNNQSTYVPQCTAHRLENPGVIPLVLIEVQNGEYLGEDDIIRYQDDYSRTSN

SEQ ID NO: 43358 - protein, 545 aa, Burkholderia xenovorans LB400
MTGFNWQNPYPTPRLPVFARNIVSTSHPLAAQAGLRMLWKGGNAVDAAIAAAAAITVVEPVSCGLGSDAFALVWDGKKLHGLNASGVSPAAWNVDYFKRKYGEENGLAKQPKRGWDAVTVPGVIAGWEALHQKFGTLPFADLMEPAIEIAERGHAVASIVAYKWAAAVPELKDLPGFAQTFMPRGRAPEVSELVRFPGHAKTLRKLAEQGPRAYYEGEIAERIAAFSREGGGALTAEDLRNYRADWVEPIGKDYRGYTVHEIPPNGQGIAALIALGILEKFDVKELAVDNVESQHLQIEAMKLAFADVYRYVADPRSMDVTPEQMLDDAYLTSRAKLIDHKRATQFDFGMPKAGGTIYMSVADERGMMVSFIQSNYMGFGSGIVVPDSGIAMQNRGCGFSMDPKSPNVVEGGKRPFHTIIPSFLTQQVNGQQEAVMSFGVMGGDMQPQGHLQSIVRMLDYGQQPQAACDAPRWKVNRDFTIDIESTLDPKTAEALQKLGHTIKSVDDPYMDFGSGQYIWKLDRNEPERGYVAASDSRRDGLAAGF

SEQ ID NO: 43359 - protein, 394 aa, Aspergillus nidulans FGSC A4
MSEPIRNKKADFPVAPTPQNTPANNAPISSHAQQPGVSSIKEESLDHATAASLFARNPGLVSMIQGKLGSLVGRSSGYIESLPVSVRRRVAGLKGIQKEHAKLEAQFQEEVLELEKKYFAKFTPLYERRATIVNGATEPTETEIEAGKGEEEEIDAKDEDLKQGEDEKESAVTGIPEFWLSAMKNQISLAEMITDKDEEALKHLIDIRMEYLDRPGFRLIFEFSENEFFTNKTISKTYFYKEENGYGGDFIYDHAEGTKIDWKPEKDLTTRVVKITVPTESFFNFFAPPQPPADDDDTVATDIEERLELDYQLGEDIKEKLIPRAIDWFTGEALQFEELGDDMDPDEFDEFDDEDDEDDDEDEDGRGSDQDVDDSDEEDGTSKPKKEAAECKQS

SEQ ID NO: 43360 - protein, 396 aa, Streptomyces coelicolor A3(2)
MTSMSSSARPLLNRRLAEFGTTIFAEMSALAVRTGAINLGQGFPDTDGPEEVREAAVRALRDGRGNQYPPGPGVPELRAAVAGHQQRRYGLSYDPDTEVLVTAGATEAIAAALLALLEPGDEVVALEPYYDSYAACIAMAGGTRVPVTLRPHEGTFRLDLDELRDAVTDRTRLLLLNTPHNPTGTVLTRDELAAIAELAVERDLLVVTDEVYEHLVFGTAEHIPLASFPGMRERTVTIGSAGKTFSFTGWKVGWVTAAPALLTAVRSAKQYLTYVASGPFQYAVAEALALPESYFAAYRQDMEAKRDLLAAGLAEAGFGVYRPAGTYFVTTDIRPLGERDGFAFCRSLPERAGVVAVPNAVFYNHREEGAPFVRFAFCKRLPVLEEAVGRLKTLSA

SEQ ID NO: 43361 - protein, 261 aa, Sulfolobus tokodaii str. 7
MIVIKAGGRVIKNNLDGIIESLSNVGEQAIFVHGGGDQVTETSKKLGIEPVFVTSPEGIRSRYTSKEELEVFIMVMSLISRQIVSKLAYKKKVISLTGADGNSVIAERKKKIIIIDERGRKRIVDGGYTGKIKKVDSLVISDLLKSFDLLVFAPLAYDPEEKTLLNVDGDQMAFAIATAMKADTLILLTDVEGVLVDGKVINKLTSKEAKELSKRIGPGMNRKLLMAGETIENGVKKVIISSGLVQDPISNALQLRGTVIM

SEQ ID NO: 43362 - protein, 1347 aa, Staphylococcus aureus subsp. aureus MW2
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNVKSDAIKSNAETLVDNNSNSNNENNADIILPKSTAPKRLNTRMRIAAVQPSSTEAKNVNDLITSNTTLTVVDADKNNKIVPAQDYLELKSQIKVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYINPSENSLTNAKLKVQAYHSSYPNNIGQINKEVTDIKIYQVPKGYTLNKGYDVNTKELTDVTNQYLQKITYGDNNSAVIDFGNADSAYVVMVNTKFQYTTSESPTLVQMVTLSSDNSKSASMGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTSKYSLGDYVWYDSNKDGKQDSTEKGIKDVKVTLLNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 43363 - protein, 1141 aa, Staphylococcus aureus subsp. aureus MW2
MINRDNKKAITKKGMISNRLNKFSIRKYTVGTASILVGTTLIFGLGNQEAKAAENTSTENAKQDDATTSDNKEVVSEAENNSTTENDSTNPIKKETNTDSQPEAKEESTKSSTQQQQNNVTATTETKPQNIEKENVKPSTDKTATEDTSVILEEKKAPNNTNNDVTTKPSTSEIQTKPTTPQESTNIENSQPQPTPSKVDNQVTDATNPKEPVNVSKEELKNNPEKLKELVRNDSNTDHSTKPVATAPTSVAPKRVNAKMRFAVAQPAAVASNNVNDLIKVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKSRLTLYSYIDKKTVPNETSLNLTFATAGKETSQNVTVDYQDPMVHGDSNIQSIFTKLDEDKQTIEQQIYVNPLKKSATNTKVDIAGSQVDDYGNIKLGNGSTIIDQNTEIKVYKVNSDQQLPQSNRIYDFSQYEDVTSQFDNKKSFSNNVATLDFGDINSAYIIKVVSKYTPTSDGELDIAQGTSMRTTDKYGYYNYAGYSNFIVTSNDSGGGDGTVKPEEKLYKIGDYVWEDVDKDGVQGTDSKEKPMANVLVTLTYPDGTTKSVRTDAKGHYEFGGLKDGETYTVKFETPTGYLPTKVNGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVTVTLQNEKGEVIGTTKTDENGKYRFDNLDSGKYKVIFEKPAGLTQTVTNTTEDDKDADGGEVDVTITDHDDFTLDNGYFEEDTSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 43364 - protein, 280 aa, Triticum aestivum
  misc_feature (193)..(193): Xaa can be any naturally occurring amino acid
  misc_feature (230)..(230): Xaa can be any naturally occurring amino acid
  misc_feature (253)..(253): Xaa can be any naturally occurring amino acid
MHPTRWELSHMVDLQAAALVISSGRPGRSGILQYDGELKLPSKYLVSPPLIERTSGEYLVKNGVRTFACSETVKFGHVTFFWNGNRSGYFDETREEYVEIPSDSGITFNEQPKMKAPEIAERTRDAILSGKFDQVRINLPNGDMVGHTGDIEATVVACKAADEAVKMVLDAVEQVGDIYLVTADHGNAEDMVXRNKAGQPMLDKSGSIQILTSHTLQPVPVAIGGPGLHXGVRSGSDIQTPGLRNVCGTVMNXHGLQALADYRRPSSNRRQVKKHALFEA

SEQ ID NO: 43365 - protein, 341 aa, Picea sitchensis
MDHAADAYRTDLMTITRFVLNEQSKYPESRGDFSILLSHIVLGCKFVCSAVNKAGLAKLIGLAGETNVQGEEQKKLDVLSNEVFVKALVSSGRTCILVSEEDEEATFVEHSKRGKYCVVFDPLDGSSNIDCGVSIGTIFGIYLVKDGAEPTVGDVLKPGKNMVAAGYCMYGSSCTLVLSSGSGVNGFTLDPSLGEFILTHPDIRIPKKGKIYSVNEGNAKNWDEPTRKYVERCKFPQDGSSPKSLRYIGSMVADVHRTLLYGGIFMYPADKKSPNGKLRVLYEVFPMSFLMEQAGGQAFTGNIRALDLVPTKIHQRSPVFLGSYDDVEEIKALYAAQEGKA

SEQ ID NO: 43366 - protein, 471 aa, Desulfovibrio vulgaris str. 'Miyazaki F'
MSANIGKIVQVIGAVVDVEFPSGNLPNILSALDIKNPNNSDAPQLVCEVAQHLGDNVVRTIAMDATEGLVRGMEAVDTGKPIMVPVGKASLGRIMNVVGRPVDEMGPIKTDKYLPIHRPAPEFTEQNTKVELLETGIKVVDLLIPLGKGGKMGLFGGAGVGKTVILMEMINNIAKQHGAISVFAGVGERTREGNDLYHEMKDAGVLEKAALIYGQMNEPPGARARVALTALACAEYFRDIENQDVLLFVDNIFRFTQAGSEVSALLGRMPSAVGYQPTLGTDLGGLQERITSTVKGSITSVQAVYVPADDLTDPAPATTFSHLDGTLVLSRQIAELGIYPAVDPLDSTSRILDPNVVGPEHYSVARAVQQVLQKYKDLQDIIAILGMDELSDEDKLTVARARRIQRFLSQPFHVAETFTGTPGVYVKLEDTIKAFRGILNGDFDHLAEGDFYMVGGIETALEKYKKRQEQQ

SEQ ID NO: 43367 - protein, 559 aa, Oryza sativa Japonica Group
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLRAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMVMIAKALEYEDFDKFDRVRVPKIRYAGMLQYDGELKLPSHYLVSPPEIERTSGEYLVKNGIRTFACSETVKFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 43368 - protein, 668 aa, Coprinopsis cinerea okayama7#130
MSSPESKSDSSLDVSLLKEIAKKDLINALNSVNGAKTLALDSALAGPLGLVTEVALLKQHGVDKMFWLEPGPLTSNTTNIVYLCRPKIKYVKIIADQIKRHVKESRKHTYTLLLVPRVSTLVSRILEEEGVLGEVTISAFNLQFIPLADDVISLEHDNAFKELWVDGDETIVFDSAQALTSLQKLFGPFPQIVGKGDYAKASLLNCLLSSSSTEPVLSSSANIDSLIVLDRRVDLITPLLTQLTYEGLIDELIGIRNSHVELPASLVNPPAPNAPNTASGSASTSAAPIVSVKKDAKKKHHLTASTDPLYAELRDLNFSSVGRKLNTVARRLDEDYKTNLQAKSVAQLRDFVGKLGGLQTEHQSLRLHTGLSELILPLTRTEVFNKSLEIQQNLLASYETTAQISAIEELIAQGADLQIVIRLLCLASITIGGIKAKTLDNIKREILQTYGYEHLPMLLSLASPSVSMLVPNPLPPSAPAVPKYPFSSLRKSLRLLIDDNPEALEEVENDISFVYSGWAPLSIRLVQCVAQKGGVLSNPAEKEQTADEQSKSSIGKVQAHPIVGWKGFEDIVATIPGQTVEAVQRTFEDTGPGNSPMSTGSPLREQTSTTVVFFLGGCTYTEIAALRWVGRQNKGRRFLIATTGIISGASLVEGIATAPTTEPKVGAA

SEQ ID NO: 43369 - protein, 540 aa, Prochlorococcus marinus str. MIT 9301
MSKISSKNIKSLSVPQSPVVLAILDGWGYRKEKSDNAIKSASTPIMDSLWHAYPHTLISASGSDVGLPDGQMGNSEVGHLTIGSGRIIQQELVRISNIVKNNQLGLVNELKEMAASLKKNNSTLHITGLCSDGGVHSHIDHLLGLIKWASDNKLKKVAIHIITDGRDTPAKSALKYLNQIESCIKKYNVGEIASICGRYWIMDRNLLWDRTEKAYTNLTDPDIQITNFSPKDYIEKSYAKNITDEFIEPIRMSENYLKDGDSLICFNFRPDRARQIVKALSLNQFSDFERKNYPNLEFVTFTQYDPNFPVKVAFPPESLNNFIGQIVSENGLKQYRTAETEKYPHVTYFFNGGVEIPLPGEERHLIPSPRVATYDMKPEMSAEELTISCSKAIKSGNYAFVVINFANPDMVGHTGNMDATIKAIEKVDKCIGQIVNATGEMGGSIVITADHGNAEVMKGSEGEPWTAHTINKVPLILIEGEKRKIPNMGNEINLRENAGLADIAPTLLQLLNLPVPGEMTGKSLIQEIELKGYNKVVQHV

SEQ ID NO: 43370 - protein, 336 aa, Avicennia marina
MAHGGGGAPDFDLPDEILSVMPTDPYDQLDLARKITSMAIASRVTKLETEAGTLRQRLREKDELIQELEDKVSQLDGAHQDAELRLKILREDNMKLLKERDSLALTANKLNRDLAKLEAFKRQLMQSLNEENSKQQTETVDIGTYDQTVPKAYYTGDEPNGYTKHHSYSGSTESASLNDDVSKQTGQKHSITPYISPRLTPTGTPKVISTSVSPRRYSAAGSPQKTSGITSPTRHEGRGSLSSWYPSSQQSSAANSPPRARPLPARAPGIDGKEFFRQARSRLSLEQFGSFLANVKELNAQRQSREETLRKAEEIFGMDNKDLYISFQGLLNRNIH

SEQ ID NO: 43371 - protein, 197 aa, Arabidopsis thaliana
  misc_feature (29)..(29): Xaa can be any naturally occurring amino acid
  misc_feature (53)..(53): Xaa can be any naturally occurring amino acid
  misc_feature (76)..(76): Xaa can be any naturally occurring amino acid
  misc_feature (105)..(105): Xaa can be any naturally occurring amino acid
  misc_feature (127)..(127): Xaa can be any naturally occurring amino acid
KTITVASSMVSSATMVASPAEATMVAPFXGLMSSVAFSATRKVNNEITSITTXNRRANCMQEWPPIVKKKFETLSXYLPDLTESELLNEVEYLIRNNCIPCVEFXWSTFLCTRRSTVTHPYTMMDGXNNVRTFPCSVAPSPIKCCINRDRAIIDTPMASLRSSRSNSCVKLRASSSLSTSHQASPEKFSLLLRNLKT

SEQ ID NO: 43372 - protein, 134 aa, Vitis vinifera
MEKPPTPSVIPSSQPPPRTQKRKLPTPKELIAHYESQGMEPQEASLKVIDDLQTALFRVISSGRGKKDRFTMDASRKLDTANARLAILEMKLDSKPGYPQTLALGVASAGIASALPHVFGAFSQIWSSVRSASK

SEQ ID NO: 43373 - protein, 653 aa, Ralstonia metallidurans CH34
MADTLIATSTGSSAQSVAQRAANRHWRGALAGAMVSLLAASLSGCGTVDKEAGTSAASTDPATGTVPASTGAVASAGLPPAAEVASGYRPGMTTTYAQKHMAAAANPLATEAGREMLRAGGSAIDAAVAMQAVLTLVEPQASGIGGGAFIMYWDGKRVQTYDGRETAPAGATENLFMRADGKPMEFSAGQIGGRSVGVPGVLRALELAHRQHGRLPWARLFEPAIALADKGFPISQRLYTQVAADKFLTGSPEMKAYFLDDQGKPKPVGTLVRNPQLAQTLREIARHGPNVFYNGPIAHDIVAKVNAHANPGSLSVADLKGYKAKERPPVCTNYKAWKVCGMPPPSSGGIAIAQILGNLEALEKRDPRYALAKLKPAQVNTPAGFEANPLAVHAISEADRLAYADRGLYVADADFVPVDVGALVNPQYLAERAELIGEKSMGKAEPGTPPGVNVAFAPDRSPPRISTSQVAAVDDRGGALSMTTTVESYFGSHIMVRGFMLNNQLTDFSFNPTENGKPVANRVQAGKRPRSSMAPTLVFDRKSGRLVAALGSPGGSQIIEYVSKTLVGLLDWNMDVQQAVSMANFGSRNGPTEVERGLVTPQLVQALKDQGHQVAEIEMTSGTQAIMRKAGPNGRPVWAGGADPRREGVALGD

SEQ ID NO: 43374 - protein, 367 aa, Sinorhizobium meliloti 1021
MGFKCGIVGLPNVGKSTLFNALTKTAAAQAANYPFCTIEPNTGEVAVPDPRMRKLADIAKSKEIIPTRISFVDIAGLVRGASKGEGLGNQFLANIREVDAVVHVLRCFEDDDITHVEGRIHPVEDADTIETELMLADLDSLERRAEQTRKRATGKDKESMAQLPIMEASLKLLQEGKPVRTLLSKLDADELRILQSLNLLTSHPVLYVCNVAESDAATGNEHTRAVEKMAREQGAETVVISAAIESEVAQLPEEEAKEFLAALGLEEAGLDRLIRAGYKLLDLITYFTVGPKETRAWTIPRGTKAPQAAGVIHSDFERGFIRANTIAYDDYIGYGGENGAKEAGKARDEGKEYVVQDGDVIHFRFNT

SEQ ID NO: 43375 - protein, 134 aa, Brassica napus
IAPKKRALSSMMPLIITQDNELVGVIGASGGPYIFPAVIQVFLNHFIFKMSPLEAVQRPRVYPKLKPNTVLYEDMTVYNGDHIKLTEETREFLKGRGHELVVTSVGGIVQVWLSVTFLFEMLKWMKKLGTYFQK

SEQ ID NO: 43376 - protein, 180 aa, Sinorhizobium meliloti 1021
MTAVQSELISAIRSIPDYPKPGVMFRDITTLLGNPRAFRRAIDELVHPYAGTKVDKVAGIEARGFILGGAIAHQLSAGFIPIRKKGKLPHDTVRIAYSLEYGVDEMEMHRDAVAPGDKVILVDDLIATGGTAEGAAKLLKQMGADIVAACFIIDLPELGGRKKLEALGVNVRTLIEFEGH

SEQ ID NO: 43377 - protein, 268 aa, Parvularcula bermudensis HTCC2503
MTPSLIETVDHLLREASADFVLPRFQSLSAADIETKSGPNDLVTVADREAEAWLTPRLAALVPGSTVIGEEAVAADPARLRHLETAGPVWLVDPVDGTANFVKGQPQFGLMVALIDEGVTKAGFIFAPIEDAMAVAIKGEGARLNGAPLSARPQRQFSEAVGDYSSRYVRAPLRQKLTCAVERAQATRQGHCSAYAYLDTARGKIDFVLQYLMNPWDHAAGALLVEEAGGAVRFLQDGRPYTPENRAPEAMLAVGVAEDWSDYSECLK

SEQ ID NO: 43378 - protein, 387 aa, Saccharomyces cerevisiae
  misc_feature (360)..(360): Xaa can be any naturally occurring amino acid
  misc_feature (371)..(371): Xaa can be any naturally occurring amino acid
  misc_feature (382)..(382): Xaa can be any naturally occurring amino acid
MSAPTPLAEASQIPTIPALSPLTAKQSKGNFFSSNPISSFVVDTYKQLHSHRQSLELVNPGTVENLNKEVSRDVFLSQYFFTGLRADLNKAFSMNPAFQTSHTFSIGSQALPKYAFSALFANDNLFAQGNIDNDLSVSGRLNYGWDKKNISKVNLQISDGQPTMCQLEQDYQASDFSVNVKTLNPSFSEKGEFTGVAVASFLQSVTPQLALGLETLYSRTDGSAPGDAGVSYLTRYVSKKQDWIFSGQLQANGALIASLWRKVAQNVEAGIETTLQAGMVPITDPLMGTPIGIQPTVEGSTTIGAKYEYRQSVYRGTLDSNGKVACFLERKVLPTLSVLFCGEIDHFKNDTKIGCGLQFXTAGNQELLMLXQGLDADGNPLXALPQM

SEQ ID NO: 43379 - protein, 509 aa, Burkholderia xenovorans LB400
MTQGSRYDLLVVGGGINGAGIARDAAGRGLSVLLCEQDDLAAHTSSASTKLIHGGLRYLEYREFGLVRKALQERETLLRAAPHIMWPLRFVMPHMPDLRPAWLIRAGLFLYDHLAKRELLPGSRGIVMRNHPAGAPLVDSIKRGFVYSDGWVNDARLVVLNALDAKERGAKILTRTKLLSAVRAGGEWRAQLKREDGTILDVRAASIANAAGPWVGELLQGALGRAASHSVRLVKGSHIVTRRLFEHDHAYIFQNPDKRIIFAIPYEHDYTLIGTTDLEYRGDPSQVAINAEETQYLCDSINRYFKQKISPADVRWTYSGVRPLLEEEGADNPSAVTRDYSLELDAPAGEAPLLSVFGGKITTFRKLAEEAVDQLAHALHHDTSSWTAGAPLPGGDIPGANFERFLSEFRQQHAWLPAGLAHRLARAYGTRVEHVIGNARSVAELGRAFAPGLYEAELTYLRDTEWARSAQDVLWRRSKLGLHVEPGTLDSITRDIDAWFAREPARQSA

SEQ ID NO: 43380 - protein, 261 aa, Vitis vinifera
MESIALDNVYVRLYVDQGCFYFQKLLLETGALGVKCNTQMAIGSLCRTVSSNLHPVAAKPEQKLLMNLEETSVGTSKGPQISSLKSSVDIVIETPGRLKDLIEMGMCWLTEVSFVVLDEVDRMLDMRFEPEVLLYIKPDMSYSPNGKGNTTNPKGTMIVFVWYKKEAGHVENVLQRKGFSLKILKLLSMERGFAEKHHEDLSSKPFFNVLVENIIYGPIVAMIWECKNVVTTGSKIIGATNPSNSALASSVVTLLLTLAGM

SEQ ID NO: 43381 - protein, 117 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVE

SEQ ID NO: 43382 - protein, 587 aa, Picrophilus torridus DSM 9790
MFHDITMVATNQNIASDVTEDKKLKKALSTWDLLFLSLGGIIGSGWLFAAAASAGTAGPSAIYAWIIGGVLIIFIALVYAELGGMLPRSGAIVRYGHYSHGGLAGLIFGWAYFLSAVSVPAVEAEGVITYAASYTPKYHIILATTSTNPITGVPLLILTPLGILLAAILIVAFFMLNYAGVRLMGKTNTGMTWWKLIIPAATIVILFVVGFHTYEFTDIASGGFLPYGWPAVFAAVSTDGIVFSYLGFRQAVDYGGEAKTPQKSIPIAVIGSVLIGIFVYVLLQVVFIGHLNLGAIGNNWSILTAPPTSNAYATSISSAPFATLATSAGLVALTYILYADAYVSPSGTLNVYAGTSARTLFGLGENGYLPESIKRVNKRTKVPVLSIILSMIIGLVFLAPFPSWYALVSLITSSTAFTYIVGGSALMVFRREAGELKRPFKLAGASILAPIAFIGATLIVYWSGWPTVGILSIAIFLGLLVYFILLLLARYNIVHGIENIFTNKTIKAGIWVPAYILILDLLSYIGEKDYGGIGILKFPIDFLVVIVVGIIFYVISYYSGYRTEEISNIIESGTQYIGEETETAGAK

SEQ ID NO: 43383 - protein, 243 aa, Azotobacter vinelandii
IPPIPPVDFAKYGEIEEVPMTRLMQIGATNLHRSWLNVPHVTQFESADITELEAFRVAQKAVAKKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTISSLGHIGGTAFTPIVNAPEVAILGVSKASMQPVWDGKAFQPRLMLPLSLSYDHRVINGAAAARFTKRLGDLLADIRAILL

SEQ ID NO: 43384 - protein, 549 aa, Glycine max
MKDIKPKTSSQASHTMLSEVEKISNLPRVAAKDRKSYPENASSAVEKELVKPRTKKLKMQLASTNHIGLPDASDEKLCLKPLSTQDQDMESKDDVISACDRNTPAYNGNITIASSSRLGEVKISLNCDSALGQPNFSIPNLDIVMKFMDKKYIRSCNAVEPQFSMAKLLDDLCRIYLKLGYRKGSNSKRANLQQYVNQGERNPFRFISDITKGSEKVKISLIDETGSEDLPKFNYIPCNITYQSANVNISLARISDEGCCSDCSGNCLSSPLPCACAQETGGEFAYTPHGLLKEEFLTACVSMKNEPQDHHYVYCQECPLEKSKNEYMPERCKGHMVRKFIKECWRKCGCDMQCGNRIVQRGIACKLQVFSTREGKGWGLRTLEDLPKGTFVCEYVGEILTNMELYERIMQDTGNERHTYPVTLDADWGSEQGLKDEEALCLDATKNGNVGRFINHRCYDANLIDIPVEIESPDHHYYHLAFFTNRTVSANEELTWDYGIDFDDHDHPIKAFRCCCGSVFCCDKKQKGKGKIENQINVTRGMSELKQLE

SEQ ID NO: 43385 - protein, 244 aa, Burkholderia xenovorans LB400
MSVSTMSFATFPAPSTIADSAFLDLPLLDADAVPPRIAAALQAMREGRAVVLQDDHDRENEADLIVSAERLSVETMALLIRECSGIVCLCLPDEKIRALELPPMAVNNESRHGTAFTVSIEAREGVTTGVSALDRVTTIRAAIADTAKPADIVRPGHVFPLRAQPGGVLARRGHTEGTVDLAILAGLKPAGVLCELMNPDGTMTRGADVERFAAQHNLPMLTIAELVEFRQALAQARECVADEA

SEQ ID NO: 43386 - protein, 132 aa, Picea sitchensis
MGMESSISRVVVARVAFLTMGFIMLITLAYTIYIDGSPFRTDLLTPWMDATLIDFYLNVAAIATWVCYRESTWIGAFTWTVLLICFGSMTTCWYIAIQLFKMSPRDPLYFVLLKERHARWLSSQISDPCEIS

SEQ ID NO: 43387 - protein, 242 aa, uncultured archaeon GZfos18B6
MKEEKMELIKDGKRLSGRGFEELRPIKIDVGVLKRADGSCYFELGNNKAIAAVYGPREMHPRHFQNAKMAVVKYRYNMAPFSVDDRKRPGPDRRSQEISMVSRKALDPVILRELYPKTAIEVYVEVLQSDAGTRTAGINAASVALADAGIPMKDLVSSVAIGKIDGEVVLDLDAKEDNFGEADMPIAMVARTNTITLLQMDGRLKKEEFERGLQLAMTGCRKIYELQKAALVEKYSKSGNEE

SEQ ID NO: 43388 - protein, 238 aa, uncultured archaeon GZfos18B6
EGRWARILDFRDIIVERDLIKKAEGSTRVQIGDTVVLVGVKVEPGAPFPDTPNKGVLMTNAELVPLASPEFESGPPGENSIELARVVDRGIRGSETIDLEKLCIEEGEKVWMIFIDIHTLDNDGNLVDAAALGAIMSLLNVTIPYEQYGLTGEDTLQIRDTPVAVTVVEIGGNLLVDPNVYEESAATSKLTVISNADGSISGLQKSGSSGLTEEKIVKMTEIGIEKAREIREKYLPKI

SEQ ID NO: 43389 - protein, 337 aa, Triticum aestivum
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 43390 - protein, 249 aa, Aspergillus nidulans FGSC A4
MSVMSGPAEPIPSPAQEVGPVYRSDRGKPTATVSKSISHENVHVLPQTPQLIALLTMIRDQNTGRADFIFYSNRIIRLLVEEGLNHLPVVENSVTTPVGRSYLGVKFEGKICGVSIMRAGEAMEQGLRDCCRSVRIGKILIQRDEETCMPKLFYEKLPTDISNRWVLLLDPMFATGGSATLAVETLKAKGVPEERILFLNLIASPSGVADFAQRFPKLRVVTAFIDQGLDEKKYIIPGLGDFGDRYYTL

SEQ ID NO: 43391 - protein, 465 aa, Idiomarina baltica OS145
MSLVLSQQYAETFPNLVSQHRVKPLDSARIRLFNQSLATEFGLADRTVNALREWCLGNVAQVGHAQKYVGHQFGVFNPDLGDGRGVLLGELSNKAGELSDLHLKGAGPTAYSRGGDGRAVLRSSLREYFASETLHHWNIATTRALALVSSHQGIQRERIEPGAMLARVAKTHVRFGHFEYCYSERLVSEQKQLWQHVMQRCWPALVDAEPVEQFRAVVKATAEMIADWQAFGFIHGVMNTDNMSICGETFDFGPYTVFDTFIPQQIFNHTDQRGRYSFLRQPSVGLWNLQRLSQALSLIFPVDALAPVLNDYEDFLQQYYLKRMRKRLGLAPGDDADAFKLVGEWMGLMQRFEWDFQGSFIMLQNILRGEQAMPNDTLFKAWYDNYMGYNERQPELSTMAQSNPHVSLRNHHLVEVITQAEQGNWAPAESYLAALTGEPLSAEELGHWQQPPMEGEQVNSLSCSS

SEQ ID NO: 43392 - protein, 224 aa, uncultured archaeon GZfos18B6
MHRKEQIRGNVKRLLAELPKEVVLEAAAKTRTTEETLAAIEAGITIVGENYIQEAERAFEVIGRVVNWHFIGHLQRNKVKKAVELFDLIETIDSFPIAEEINRVSSKIGKIMPILIEVNSGREPQKFGVFPEDVEELVVKISALASVKIVGLMTMGPYEEDIEKSRSYFRAAKEIFERIKKSGIPSVDMRFLSMGMSDSYNIAIEEGANIIRVGTGIFGPRGRV

SEQ ID NO: 43393 - protein, 376 aa, uncultured archaeon GZfos18B6
MEERGISKQELESFLKEQKQRDLTYRKVLSSMCTYPREIAVYAHNLFLDSNLGDSGLFPGTKEIEDELIRMIGALLGNENAHGYISTGGTESNIQAIRAIRNRKRKEGLQQMNIIVPKTAHFSFDKIEDLLSLEVKKAGLDDELRVDVNLVEELIDDNTISIVGIAGTTEFGQIDPIKELADIAHNSDIFLHVDAAFGGFVIPFLDAEYQFDFSLDAVSSISVDPHKMGMSTIPAGCILFRDESYLADLAVNTPYLTTNEQCSLIGTRSGAPVAATYAVLKYLGRNGLRAIVDECMLLTRMLVRGAKAMDIYPVIEPVTNVVTLRFPDVDRVAKALEARGWRVSTTRAPKALRLVIMPHVTEDTIELFLNDLACVT

SEQ ID NO: 43394 - protein, 430 aa, Oryza sativa Indica Group
MANARFQKQALLPPRSPFPAAVGAAPSPSPHAELGPIARPRDAPHRHGHQRTSSESVLIDEQPSWLDDLLDEPEAPARPHGRPGHRRSSSDSFTLFDGGASAAAAGMYDNVFDGMRGRGGGGQQVGSWGAAPEFFPEQSSFGRPQGQGGRPWDSRLMLRQGGGGGGGMPVPMNGGHHGPPSAFGDHGHGSLPNGVDRKGPGDSAHDQRMGAERKEGAHLRHSQSEADTKRAKQAYLVAITTWLEIELMPKILACTLFKLNLPCYTVAFTCNLVYWYILNIMSYAFNKLLPTTHFRQYAQRSRVRKLQYIAELERRVQALQTEGVEVSAEMDFLGQQNIMLDLENKALKQRLESLSQEHLIKRFQQEMFEREIGRLRSLFQQQQQQQHIPQQQGPTHSRSNSRDLDSQFANMSLKHSDPNSGRDAVPGLRI

SEQ ID NO: 43395 - protein, 160 aa, Mycobacterium avium 104
MSPAAGVPEMPALDASGVRLGIVASTWHSRICDALLAGARKVAADSGVENPTVVRVLGAIEIPVVAQELARNHDAVVALGVVIRGQTPHFEYVCDAVTQGITRVSLDASTPVANGVLTTDNEQQALDRAGLPDSAEDKGAQAAGAALSAALTLRELRARS

SEQ ID NO: 43396 - protein, 300 aa, Nostoc sp. PCC 7120
MWDYTDKVLELFYDPKNQGVIEENGEPGVKVATGEVGSIACGDALRLHIKVEVESDKIVDSRFQTFGCTSAIASSSALTEMIKGLTLDEALKVSNKDIADYLGGLPEAKMHCSVMGQEALEAAIYNYRGIPLAAHDEDDEGALVCTCFGVSENKVRRIVIENDLTDAEQVTNYIKAGGGCGSCLAKIDDIIKDVKENKAATNLNNKGGSKPTNIPNSGQKRPLTNVQKIALIQKVLDEEVRPVLIADGGDVELYDVDGDIVKVVLQGACGSCSSSTATLKIAIESRLRDRINPSLVVEAV

SEQ ID NO: 43397 - protein, 365 aa, Coprinopsis cinerea okayama7#130
MAESAHRLDLRVGGKYRLGKKIGSGSFGDIYLGINIISGEEVAIKLESVKAKHPQLEYESKVYKTLAGGVGVPFVRWFGTECDYNAMVLDLLGPSLEDLFNFCNRKFSLKTVLLLADQLISRIEYIHSRNFIHRDIKPDNFLMGIGKRGNQVNVIDFGLAKKFRDPKTHLHIPYRENKNLTGTARYTSINTHLGVEQARRDDLESLAYVLMYFLRGALPWQGLKAATKKQKYDRIMEKKMTTPTDLLCRGFPNEFGIFLNYTRALRFDDKPDYSYLRKLFRDLFVREGYQYDYVFDWSVQRGAQEDQAASSSKVPVGRRKVVQEADEDHRASDRMLRSHTRQAQQAGGSGMPQARAGRGRDAEVW

SEQ ID NO: 43398 - protein, 523 aa, Triticum aestivum
MAFLAVLLLVLAALLVVAATRLLEYGVVRLVWRPYSMSKWFGQQGIHGPSYSFLKGCNEDVRSMKEETDRLVLEVGDHKYLPRIAPHYLKWRALYGEPFLYWHGPQARICIFDYELARQILSSKSRHFVKNDAHPTLLALVGKGLGFMEGADWVRHRRIINPVFTIDKLKMMTKTMMDFAESMAKELEDQASQKEKRETKVDINKLFSELTVDNISYAIFGSSYKLGKEVFRAQTDLLGITMETFLDVPIPGFKYLPTERNRRKWMLERNLKSLLTQIIQPRLATSEYGNDLLGVMLDSCIETKQGGKQVDLSLSMEEIIHECKLFFFAGHENTSLLLTWSLYLLSIYPEWQERLRKEVLKEFGRESPNPNALNKLKEMTMVLFETLRLYPPALFMQRKTVADITVGSIKLPKGMAIVIPIPIMHRDKEVWGDDADEFNPLRFKNGITGAAKVPHGLLAFSMGPRSCIGQNFSMLEAKSTLALMLQKFSFTLSPDYVHAPVDLFTLKPKFGLPVFLRPLDKCN

SEQ ID NO: 43399 - protein, 389 aa, Ralstonia metallidurans CH34
MAESNLAPLNPPPSRLPNVGTTIFTVMSALAAEKNAVNLGQGFPDFDCDPRIVDAVTHAMRTGHNQYPPMAGVPQLRQAIAAKIAKLYEHTYDWNTEITVTAGATQGLLTAILCAVHPGDEVIVLEPCYDSYLPAIELAGATAVPVTLEAPLFRIPFDKLAAAITPRTRMIMINTPHNPTGTIWREEDMQQLADLLAGTDILLLSDEVYEHMVYDGQQHESVARHPELARRSFVVSSFGKTYHVTGWKVGFVAAPAALSNEFRKVHQFNVFTVNTPVQYGLADYMADPAPYLNLSAFYQAKRDYFRAGLAGTRFKLLPSDGTYFQCVDYSAISDMSEADFSMWLTREIGVAAIPVSAFYSTPRESGVVRFCFAKKEETLKLALDRLAKL

SEQ ID NO: 43400 - protein, 108 aa, Prochlorococcus marinus str. MIT 9301
MPEYNIKVQFEQKTFNFLCSEDQDIISAAKMNGIDLPSSCCSGVCTDCASMILEGSVDQEDAMGLNDDLREKGFALLCVAYPKSDLNIVIGKEVEDDLYNDQFGKYQK

SEQ ID NO: 43401 - protein, 313 aa, Parvularcula bermudensis HTCC2503
MADKQFGSDGFTAEHLPDLTGKTFAITGANSGIGLEAARYLGGRNATVLMLCRNASKAESARNALRQSAPGGKYETISLDLADFSTLSPATDAIRQATDRLDGLILNAGVMMLPRRQITKDGFEMQYQVNVLSHFALAAALADLVETASGRFVWLSSIAHHYAKHPKLTDLGYAAGYSPTSSYAKSKLADLMLGLELHRRLSAAGKSAGSYIAHPGYSDTNLQSAGPGAILGTLIKPFTMIFSQPAEKGALPTVLAAAYPKAQPGVLYGPTGFQEMKGPVGEAAIKPWAKDPQVAKQLWSVCEEATGREWSMA

SEQ ID NO: 43402 - protein, 322 aa, Streptococcus pneumoniae TIGR4
MSFSDLKLFALSSNKELAERVAQEIGIELGKSSVRQFSDGEIQVNIEESIRGKHVFILQSTSSPVNDNLLEILIMVDALKRASAESVNVVMPYYGYARQDRKARAREPITSKLVANMLEVAGVDRLLTIDLHAAQIQGFFDIPVDHLMGAPLIADYFERRGMVGSDYVVVSPDHGGVTRARKLAEFLKTSIAIIDKRRSVDKMNTSEVMNIIGKVEGKTCILIDDMIDTAGTICHAADALAEAGAVEVYASCTHPVLSGPATDNIQKSAIKKLVVLDTIYLPEERLIDKIEQISIAHLLGDAIVRIHEKRPLSPLFDIEKKI

SEQ ID NO: 43403 - protein, 839 aa, Pseudomonas putida
MKFGFIAHPTSTGLLHQVKLVDMLDRTLEEQAWGYQAERWQQRNLVPFIDFGRIVSACGAECSGMLQFVPLTAEQMLRQPRAIAERVLQGVAALKAEGAELVGLGGFTAIVGNRGVATMQQAEVAVTTGNSLTAFAAYANLMDSLRLLGIAAADAEVAVLGYPGSIALAVARLLAEQGCRLRLVHRGNAQQAQAHLEYLPSQYHAQVTLHDNLEDCYAQVRFYVAATSSGGLIDPRRLLPGSVVLDAALPKDVMDVPHQRRDILLVDAGLVSASPAVHLGLRSLGLEPKRSLNGCLAETMILALEGRAEPFSLGRELPVHKVLEIGRIAERHGFSPSPMTHDGEVLASEAFDRLHRHHHPRRALRASDATDEPLALRREVLNSFAEHINPVLREFYRFNHIERVFSQGQGCWLTDLDGRRFLDFVAGYGCLNTGHNHPAISQALQGYLQAQFPTFIQYLSAPLHASLLAQRLAALAPGGLNRVFFSNSGTEAVEAALKLALAASDKRSVVYCDNGYHGKTLGALSVTGRAKHRTPFEPLLPRCDSLPFGDLHALRRRLEQGDVAAFIVEPIQGEGGVILPPPGYLAGVRALCDEFDCLWILDEIQTGLGRTGKLFACEWDNTAPDIMVLSKSLSGGLVPIGATLSRDAVWERAYGDIDSFALHTSTFGGGNFAAAAALAALDVLEQDGLCANAAEVGAFLQAGLQHLVDRYPFLVAVRGRGLMLAIEFHQDMRGGVQALVKELAGRIPGQAMATYRMLSGAARAHLEAAAQALEQNLEDMFVLRFMTKLSEEHGVLTFVTANNNRVMRIQPPLVLTREEAECFLSAFASVCEDLATFQS

SEQ ID NO: 43404 - protein, 535 aa, Shewanella oneidensis MR-1
MIKDFILPDIGEGVVECELVEWLVKEGDTIVEDQPIADVMTDKALVQIPAPFAGVVTKLYYAKGDIAKVHAPLYAVQIEAEEPSSQVAPQTVEHSAPNQAAISAASSSIEQFLLPDIGEGIVECELVEWLVQEGDIVVEDQPIADVMTDKALVQIPAIKAGKIVKLHYRKGQLAKVHAPLYAIEVEGGVIPAVSAHETTNVAVANTATSAACATASVSQEPARQGKALASPAVRRMARALDIDLSRVPGSGKHGRVYKEDISRFQAQGSATPVVAPVATASTQQSSVTQSAVPITVASAARADIVEPIRGVKAVMAKLMVESVSTIPHFTYCEEFDLTDLVALRESMKAKYSSDEVKLTMMPFFMKAMSLALTQFPVLNSQVNADCTEITYKARHNIGMAVDSKVGLLVPNVKDVQDKSILEVAAEITRLTNAARSGRVAPADLKEGTISISNIGALGGTVATPIINKPEVAIVALGKLQTLPRFNAKGEVEARQIMQVSWSGDHRVIDGGTIARFCNLWKQYLEQPQDMLLAMR

SEQ ID NO: 43405 - protein, 282 aa, Vibrio sp. Ex25
MQWAILFVSKRPAERKRCLRGIRMTDTSLQSNTALENETTHFGFSTVAKDEKVTKVAEVFHSVATKYDIMNDLMSGGIHRLWKRFTIDCSGARPGQRILDLGGGTGDLTAKFSRIVGDEGHVILADINNSMLNVGRDKLRDNGIVGNVHYVQANAEELPFPDDYFDAITISFCLRNVTDKDKALRSMFRVLKPGGRLLVLEFSKPVLEPLSKVYDAYSFHLLPRIGELVANDSESYRYLAESIRMHPDQETLEGMMQDAGFENTKYYNLTGGIVALHRGYKF

SEQ ID NO: 43406 - protein, 76 aa, Triticum aestivum
KVAGVVTSSSSPSKRSSERRRASTSTQYVVRDNAKEKPTYILAPKRDDHTHREKIIAGTSGGTTLKKLFIVISLLL

SEQ ID NO: 43407 - protein, 140 aa, Brassica napus
MEVQSSNNGGHSSFSSLRVYLNSLSSTPSRLARRAVSVSTSSDEMSRVRAVSGEHMRRTLRWYDLIGLGIGGMVGAGVFVTTGRASRLYAGPSIVVSYAIAGLCALLSAFCYTEFAVHLPVAGGAFSYIRITFGEFPAFF

SEQ ID NO: 43408 - protein, 330 aa, Sinorhizobium meliloti 1021
MGRLVNGVWQDVWYDTRATNGHFKRSESQFRNWITADGSPGPSGEGGFEAEAGRYHLYVSLACPWAHRTLIFRKLKKLEDLVSLSVVDPLMLANGWEFKGEDGEGENGGTADHLFGSRMLWEVYLRADPVYSGRVTVPVLWDKRKNTIVSNESAEIIRMFNSAFDRLTGSTEDFCPQELRPEIDALNARIYDAVNNGVYKAGFATSQAAYEESVTALFAMLDELENRLASKRYLTGDRLTEADWRLFTTLVRFDPVYVGHFKCNIRRIADYPNLYGYLRELYQVPGVAETVNMHHIKAHYYRSHTTINPTGIVPVGPALDLEAPHGRDRL

SEQ ID NO: 43409 - protein, 71 aa, Glycine max
MIIPVRCFTCGKVIGNKWDTYLDLLQSDYSEGDVLDALGLVRYYWRRMLMTHVEIIEKLLNYNTRDKSDPS

SEQ ID NO: 43410 - protein, 689 aa, Sulfolobus tokodaii str. 7
MDGITRKNAGVSIGDKVIVRKASPKIATSVKLAPSNFSITVDPGFISYVKKKLKDYPLVEGDTVLIPVLGQAIPFTVVQVRPQGIVIVSDETSITISEKPAEQARYPRVTYEDIGGMKHIIQKIRELVELPLKHPELFKRLGIEPPKGILLYGPPGVGKTLLAKAVANETEAYFTSINGPEIMSKFYGESEQRLREIFEDAKKHAPAIIFIDEIDAIAPKRDEVIGEVERRVVAQLLTLMDGLESRGNVIVIAATNRPNAVDPALRRPGRFDREIEIPLPDKQGRLEILQIHTRNMPLSKDVDLEKLAEMTHGYTGADLSALVREAAMNALRRYLQVIDLNQDKIPPEILEKMEVNMDDFLKAFKEIVPSGLREIYVEVPEVHWSDIGGLEDVKEELREVVEYPLKYREAYENVGIEPPKGILLFGPPGTGKTMLAKAVATESGANFIAVRGPEILSKWVGESEKAIREIFRKARQAAPTVIFFDEIDAIAPMRGLTTDSGVTERIVNQLLAEMDGIEKLENVVIIAATNRPDILDPALLRPGRFDRLIYVPPPDKRARAEILKVHTRNVPLAEDITLDELAEKTEGYTGADLAALVREATLRAIREEMTECMKKADENCKRNDNECRDKIVKDCMKGKGVLVEKRHFDIALKKVRPSVTMDMIQFYQNWLEKARQQLPRANLKPSTFT

SEQ ID NO: 43411 - protein, 468 aa, Oryza sativa Indica Group
MVQIEPLEVSLEAGNQADSALLDDDGRPRRTGTFWTASAHIITAVIGSGVLSLPWATAQLGWVGGPAVMVVFGGVTYFTATLQAECYRTGDEETGARNYTYIGAVRAILGGANAKLCGIIQYANLVGTAIGYTIAASISMQAIKRAGCFHANGHNVPCHISSTPYMLIFGAFEIVFSQIPDFHEIWWLSIVAAVMSFTYSGVGLGLGIAQTVADGGFRGTITGVTNVTATQKAWRSLQALGNIAFAFAFSNVYTEIQDTIKAPPPSEAKVMKQASLLSIVATSVFYALCGWMGYAAFGNAAPDNLLTGFGFFEPFWLVDAANVAIAVHLIGAYQVYCQPVFAFVERKASRRWPDSGFVNSELRVGPFTISAFRLAWRSVFVCFTTVVAMALPFFGVIVGLLGAISFWPLTVYLPTEMYIAQRGVRRGSALWIGLRALAVAGFVVSAAATTGAVANFVGDFMKFRPFSG

SEQ ID NO: 43412 - protein, 160 aa, Zea mays
MAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEM

SEQ ID NO: 43413 - protein, 688 aa, Xanthomonas oryzae pv. oryzae KACC10331
MRQIAAGIRDCNAPERHGAHFRHFPPTAEPVCLPGLRMGRTIRLQINDTMMIDTTRYPRLSRIHTPDDLRRFDEAELTVIAEELRSYLIESVGKSGGHFAAGLGVIELTVALHYLYQTPVDQLVWDVGHQTYPHKILTGRRDQIHTVKQKDGVAPFPKREESVYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPRLVGALKTLQTLKGPQLLHVITTKGKGYELAEGDQIGYHAVSPFDPSKGLVAKGGAKKPTYTDVFSDWVCDMAAAEPKLLVITPAMREGSGLVRFSKEYPQRYFDVAIAEQHAVTLAAGMATQGAKPVVAIYSTFLQRGYDQLVHDVAVQQLDVLFAIDRGGVVGPDGATHAGNLDLSFLRCVPHMVVMAPADEAECRQMLSTGMQYQGPAAVRYPRGTGPGAALDSSLATLPIGKAQLRHSGTRIALLGFGATVDAAEAVGRDLGLTVVNMRFVKPLDKAMLLELAKTHEGFVTIEDNVVAGGAGSGVSELLNAEAITLPMLHLGLPDSFQHHASREDLLAEAGIDQAGIRTAVLKRWPQLMTGKTPSLNAAAG

SEQ ID NO: 43414 - protein, 412 aa, Sulfolobus tokodaii str. 7
MSDEFIDINNYIAIVYTYKTVGISKLYEHYVKDQELLLLKGLIKGEISVLQTCNRAETYLYTYNKEEFKDFLQKLDEIHGKQISKDAMILKGEDAVKHLFEVASGLDSLAIGEYEILRQLKESIEKSKKLGLSSEKLEFLFKNAIKVGRKIRQQTEISKGKTGIYALAVEYAKHVSNNNIGNVKIAIVGAGEIGNKLALMLKNEGAQNVTIFNRTYEKALEVANKYGFKAEPLDFYKINNYDIVFVAIYYDKKINLPNPKLVIDLSVPQIVLGNNVITLENLRSISDKIMETKILSLQKAEELIHIEIENFKNEIIKYNQNRLISKFMKRIEDIREAEINRAYAEILKHANDKEEIKNIIDKMTNSMLKKIFSPLFETVRKNEDMANYINNIFEILSNGNISNSKTEEAKEK

SEQ ID NO: 43415 - protein, 599 aa, Idiomarina baltica OS145
MKSINTSHWILSSIAAALLAACSPAQSGASATAAPQDSEPKQEAREPEMATGFADKKAVVTDQFMVTAANPHAVEAGYKVLKEGGSAVDAAIAVQAMLGLTEPQSSGIGGGAFILYWDNEQQKLYTIDARETAPKEATEALFLDQDGNAPPWIEAVVGGRSVGTPGVLRGLELAHDKWGKLDWQPLFKDAIDLAETGFEVSPRLAKLVKSEINPGVKKLPIIANYLFPNGEPVKAGSTLVNKDYAESLSLIAEQGADAFYQGPLAEKIVDAVRHSAIAPGVLSTKDLAEYQAIIREPVCDAYRQYQVCGMGPPSSGGLTTLQTLGILQNYDVSSWQVNGEEFAHYFTQASRLAFADRNQWIADPDFVSVPVEGMLNDEYLSKRAKQIGREDMVKAKPGLYLKPEYQQDIAYERPNTSHMSIVDSEGNVISMTTSIEMAFGSTVMVEGFILNNQLTDFSLTPMDEAGRKIANRVQPGKRPRSSMSPTIVLNQSGDQVVHALGSPGGSRIINYVTQTLVGLIDWNLNMQQAIDLGHVTNRNDYTALEKGRDIATLKAVLEKRGHEIKVIDLNSGIHGITRLPNGQLQGGADPRREGIVMGQ

SEQ ID NO: 43416 - protein, 494 aa, Staphylococcus aureus subsp. aureus MW2
MEKKNKQIDRGDLKQNLSEKFVWAIAYGSCIGWGAFILPGDWIKQSGPIAASIGIVIGTLLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 43417 - protein, 511 aa, Oryza sativa Indica Group
MAIFIGCICSLALLLLCSHVFQLLSDARRPLPPGPRPLPVIGNLLDVAGELPHRSLSRVAQRYGPLVTLRLGTTLAVVASSPATAREVLHRHGASITDRGTPDAWRTDGHETNSIFALPTRHHRWRALRRLGAEQLFSPRRVEKQRPLRRDAVRGLLRHVSELAAASGGGTGTAVVDVGRAAFAAMASLLFGSLFSVGIDAATSCRFRDAAREFALLTLTPNVSEFFPVVAMADLQGLRRRTARHITWMYQLIDGHVERRMRGRETAGAHGEKEKDLLDVMLDISEKQEQNDDSLTINRGVIRAFLADLLTAGSETSSAVIEWAMAELLQNPQTMRKLQEELKKVIGSKTYIDEEDIDQLPYLQAVIKETHRLHPAIPLLMYKAAVPVEIQGYKIPKETTVVVNTWAIHQNSEVWIEPDKFIPERFLQKEISLSSGSTNMELVPFSAGRRFCLGYPVANRMLHLMLGSLVHQFQWTLPEVVKKNGGVDMAEKFGLTLSMATPLHAIAKNIV

SEQ ID NO: 43418 - protein, 390 aa, Pseudomonas putida
MTLLPLVEPAAELSREEVNRYSRHLLIPDIGVLGQRRLKNARVLVIGAGGLGSPTLLYLAAAGIGTLGVIDFDRVDESNLQRQVIHSVDTLGELKAESARQAIARLNPLVKVHTHTERLEADMAVELFSGYDLILDGTDNFATRYLVNDACILADKPYVWGSIFRFEGQASVFWENAPGGRGLNYRDLYPEPPPPELAPSCAEGGVLGVLCAAIASIMATEAIKLLTGIGEPLLGRLMVYDALQMSYRELPLRRLPQRQPVTALGDYQALCGLDRPAASDAAPVPQISAVQLKSLQDAGRAPVIIDVREPTEWDIVRIDGAVLMPKSAQVATQIVERYGHDTDLVITCKSGMRSKAVAGDLQRLGHGRVRDLQGGVLAWVREVEPALPSY

SEQ ID NO: 43419 - protein, 904 aa, Oryza sativa
AFFSSLKRSVWWWKDWILIPPIRFPSGKIQPCQLSIPQRGSTRSYQSAMAEAVDGGSWEDMLRRILPPGSPIPEAPPNLDYSIALEYDGPPVAYDLPRVDPVEIPTAEPVSGPQRLGNGGGLPVVEPIPLPVSRIARCAEPVSAQVGGGSSDSVNSVLQNEEFDDDDDDSRSLSHDSAQSSPGPQDRSRRTQEGRRGATVTFGFTPDSKCESKEFEEMSEQYVVVTKKEKRRRACYRCGKRKWESKEACIVCDARYCGYCVLRMMGSMPEGRKCVTCIGQPIDESKRSKLGKNSRTLSRLLSPLEVRQILKAEKECQANQLRPEQLIVNGCPLGPDELTDLLSCSRPPQKLQPGKYWYDKESGLWGKEGEKPERIISSNLSFTGKLQANASNGNTQVYINGREITKIELKILKVANVQCPRDTHFWVYDDGRYEEEGQNNIKGKIWESALTRFACALFSLPVPPANSDEPKDEAPYSARTVPDYLDQKRIQKLLILGSPGAGTSTIFKQAKLLYGTRFTQEELDSIKLMIQSNMFKYLGILLEGRERFEEEALSRSNNPSSEDEETQQDENKANGSNSCIYSINPRLKKFSDWLLDIIAMGDLDAFFPAATREYAPFVDEMWKDPAIQATYKRKDELHFLPDVAEYFLSRAIEVSSNEYEPSEKDVIFAEGVTQGNGLAFIEFALDDRSPMSEPYIENPEAHSQPLTKYQLIRVSAKGMNDGCKWVEMFEDVRMVIFSVALSDYDQVGPPVYGSSRPLLNKMMQSKELFEATIRQPCFCDTPFVLVLNKYDLFEEKINRAPLTTCEWFNDFSPVRTHHNNQSLAQQAYYYVAVKFKDLYYEHTGRKLFVWQARARDRQTVDEAFKYVREILRWEDEKEENLYGGGEDSFYSTTEMSSSPFIRAE

SEQ ID NO: 43420 - protein, 389 aa, Streptococcus pneumoniae TIGR4
MDLTKRFNKQLDKIQVSLIRQFDQAISEIPGVLRLTLGEPDFTTPDHVKEAGKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPATFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 43421 - protein, 336 aa, Shewanella oneidensis MR-1
MTIRVAINGYGRIGRNVLRALYESEKAYPIKIVAINDLGDASINAHLTKYDSVHGRFNAKVEHDAEAIYVNGDKILTFQERDPGKLPWNDLQVDVVFECTGIFTSKESVQPHLAAGAKKVIISAPGKNVDATVVYGVNNNVLTSDMTVISNASCTTNCLAPFAKPLNDEIGIESGLMTTIHAYTNDQRLSDVYHTDLRRARAAALSMIPTKTGAAAAVGLVVPELQGKFDGLAVRVPTVNVSLVDLSFIASRDTTVEEVNAIIERAASVAPLSEVLAVNKEPLVSIDFNHNAFSSNFDATQTRVNGRLVKVMAWYDNEWGFSNRMLDNAVALMNAK

SEQ ID NO: 43422 - protein, 397 aa, Zea mays
  misc_feature (188)..(188): Xaa can be any naturally occurring amino acid
MSRPSKRKDDKEPSEVSSDSGSESGGRPRVLREDGGLGVCRDGGALLASKKRKHSPGFHDTNVSKLRARDEVWRRGPDAIATELPLPSPPPMSAVGGNMGDSADWNEDNTALVCELFAEQVKAHNHSGTHLNKIGYKNVMDKFKEKTRLSYTKMQFKNKWDKMRIEYTNWKRLSKETGLGWDTAKKTXSATNERWKNLNKQYKGIAKFKDGPLLHEEEKAIMYEDIRNTGDDHWAPSSGTTPQILEGETTENTDDKDGDYEANDEKDEDFEECEEVSPTTAKGKCHVSVGRKDKGKKPRSLGGHWVQDQLSKLVTASEKSTASVESLARKEDNGCSIRDVMALVKECGAVPGTKEHFIASQVFIKRAEREMFMTLDTPEERFNWLTMKHDWVTWMSH

SEQ ID NO: 43423 - protein, 397 aa, Shewanella oneidensis MR-1
MIFSQVVLAPADPILGLTDTFKADPRQDKVNLGVGIYKDEAGQTPVLQSVKKAEAILLEQEKTKNYLGIEGVQTYNRVVQELLFGEGSELVASGRAATAQAPGGTGALRIAAEFLLRNTPSRTIWVSNPTWANHQNIFETAGLTVKEFGYYNASAHDIDFDGMMTDLANAQAGDIILLHGCCHNPTGIDLTLAQWDLVANLCADKQLVPLFDFAYQGFGTGIEEDAAGLRLVASKVPELLVANSFSKNFGLYNERIGAVTVVAHNADEAVRAFSQVKRTIRANYSNPPAHGALIVSTILSDAALKALWVQELTEMRERIALMRTLFVQSLKDEGVTQDFSFISRQNGMFSFSGLNKSQVARLKDEFGVYIVGSGRISVAGMTKANMPAICKAIAQVV

SEQ ID NO: 43424 - protein, 338 aa, Zea mays
  misc_feature (88)..(88): Xaa can be any naturally occurring amino acid
MGKIKIGINGFGRIGRLVARVALQSEDVELVAVNDPFITTDYMTYMFKYDTVHGHWKHSDITLKDSKTLLFGDKPVTVFGIRNPEEIXPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWSANEWGYSNRVVALIRHMFKPP

SEQ ID NO: 43425 - protein, 435 aa, Oryza sativa
TWPTEAEMEEAYLNNKQRKLKRKLPRGTSEYQAAWIVDDTDDEDGDSENDNQDGAGMVIDEQDHSDNGGDGSDMDVVSHFTEKFDEETIGGTEMADDENLTKEQIEAEIKKIKEANAEDEEFPDEVETPLDVPAKRRFAKYRGLKSFRTSSWDPKESLPQDYARIFAFDNFTRTQKHVLAKMAERDEGTLKDCAQRGSFVRLHLKNVPTEIASKLVHPSRRLPVVVSGLLQHESKISVLHFSIKKHDSYEAPIKSKDSLIFNVGFRQFTARPLFSTDNINCNKHKMERFLHHGRFSVASVYAPICFPPLPLIVLKSRDGEQPAIAAVGSLKSVDPDRIILKKIVLTGCLPVVCVGELMKRENLGLRTSACALYPQRVSKLKAVVRYMFYNPEDVKWFKASAMKCIFNSSVQQHDTVCMSLYKRAYPKWPEQLYQI

SEQ ID NO: 43426 - protein, 219 aa, Physcomitrella patens subsp. patens
MTSNGTATSNEAAPAKQPTFRSSPLNARILSGMERRTVAAHPWHDLEIGPEAPAIFNCVIEIGKGSKVKYELDKKSGLIKVDRILYSSVVYPHNYGFIPRTLCEDEDPIDVLVIMQEPVLPGCFLRARAIGLMPMIDQGEKDDKIIAVCADDPEYRHFKDIKELPPHRLAEIRRFFEDYKKNENKSVAVDEFLGHEAAIDAIGHSMDLYASYIVESLRQ

SEQ ID NO: 43427 - protein, 1074 aa, Oryza sativa Japonica Group
MAAYASYSFAQCSLKAAADGHGWWGFRAGENRRSRPIQNGNIAVPIGMNKLINLRHLIAHEKVHSAIDSVGKLTCLQKLIFKVQDADSFEIGQLRAMNDLVILGISQLENVKTKKEARSARLMDKEHLKELSLSWNDNMSSGPTEENTRYDVLEGLEPHGNLKHLQLTGYSGATSPTWFASKVTSLQVLHLENCTEWRIVQYLEMLPLLRKLKLIRMWNLVEVSIPSYLEELVLVNMPKLENCVGTYGIELTSRIRVLMVKDCPQLNEFVLFHRDHFHAEQKSWFPSLNKLMIGHCYRIIMWKILPLEEMRALKELELMDVPIVEELPVPSLEKLVLIQMRSLQICSGITASPVQVSTSQVDQNEWISSLRELTIYDCSSLVVSLPIPPSPLMSYSSIKRLSAFPTMEINNRKFTIESDELSELDGRILSFHNLKGVTSIYLRRCPNLTRISTEGFNQLITLECLVIQKCPNLFQLQISDQANNTSSATNIPALPSLKSLTISSCGIAGRWLTQMLHHVNSLEKLDLFDCPQIKFLLTNQPTEREVTSSLASAEITSAGDEQLLQIPCSLLHSLMWLSISECPDLEFCGGSGGFAGFTSLVQLQIKNCPKLVSALVSETNDNGLLPMSLQDLSLSPLSVSENLQSFSPEGLPCLRRLSLCRSQHLKSMQLHSCTSLEYLKISGCRSLVVLEGLSSLRRLDIQMNPELSAAWHLKLQEQEQGGNQAQVFPPSLVELHISNLEGSISSQFLCLPSVTKLAVRDSPALKSIQLKHCMTLEKLEIINCKLLASIEDFHSIRNLRSLKVLGTRSLSPYLQQEASGMWFRLESLMIDDAAVLSVHLCIQLTSLRILQFWSMGMASLTEEQERALQLLTSLRQLGFSRCQKLESLPANLRSLDFLEDANGLGMRAIPGEDYCRIVIQYPSDTDSKWKDPKTGEPEGLSFEFNLCEAVASWEQDEVLFGVQKGTHFTTWESILSNDGMSWCDPGRVVKWLPTKDTIEAARAASEKLLKRPGAGSEGPLSSCTMIKKLEKVKTAKRSVVHDAALNHLEYIRGSTRYPLERNAGGGYFCMINDR

SEQ ID NO: 43428 - protein, 672 aa, Oryza sativa Japonica Group
MAIPGAYAHAVQALATGILFVVVSLVLDHVEGRHHKCPSFSCGHLKGVSAPFRRAADPPGCGSKSYELVCSDTNATILIDNATYHVNEINYDYRRFWVVDANIAGSTCPLPQWNHLLDQYKRKVSGHRIEIELAPGAYNHAYFVRCSREVKDNGIYRPVTCASSNYSFIYVLLSSDSDNPGYIESLEPSCGYLAMTLLGDWSTTVPRNASYEDVKKFMREGFAIRFPRIYGAGSINECLMDSISELRNGIEPRSSTGTAISDRLIVISIIDLHFWFCLIGYPSGILIAFGMWIVKCIAVLCRFVLVPLAILTFLAHKYWKTRLAIDAVEKFLQMQQVLGPTRYAYTDLTAVTSHFRDKLGQGGYGSVYKGVLLSGDVHVAVKMLNGASTYDGEEFISEVSTIGRIHHVNVVRLVGFCSEELRRALVYEYMPQGSLDKYIFSSERSFSWDKLNEIAIGIARGINYLHQGCDMQILHFDIKPHNILLDDNFVPKVADFGLAKLYPRNKSFVSDRALRGTVGYIAPEMVSRSFGVISSKCDVYSFGMLLLEMAGGRRNADPNTNPNASQSYYPSWVYGQLTGEQVGETSGAADMHELQKKLCLVGLWCIQMKSHDRPTMSETIEMLEGDVNALQVPPRPFFCDGDFMPNVMDSYLHSSELTAISEDDGAIEFASN

SEQ ID NO: 43429 - protein, 328 aa, Staphylococcus aureus subsp. aureus MW2
MADLLNVLKDKLSGKNVKIVLPEGEDERVLTAATQLQATDYVTPIVLGDETKVQSLAQKLDLDISNIELINPATSELKAELVQSFVERRKGKATEEQAQELLNNVNYFGTMLVYAGKADGLVSGAAHSTGDTVRPALQIIKTKPGVSRTSGIFFMIKGDVQYIFGDCAINPELDSQGLAEIAVESAKSALSFGMDPKVAMLSFSTKGSAKSDDVTKVQEAVKLAQQKAEEEKLEAIIDGEFQFDAAIVPGVAEKKAPGAKLQGDANVFVFPSLEAGNIGYKIAQRLGGYDAVGPVLQGLNSPVNDLSRGCSIEDVYNLSIITAAQALQ

SEQ ID NO: 43430 - protein, 381 aa, Magnaporthe grisea 70-15
MSTVGKTITCKAAVAWEAGKDLSIEDIEVAPPKAHEVRIEIYHTGVCHTDAYTLSGKDPEGAFPIVLGHEGAGIVESVGEGVTNVKVGDHVVALYTPECKECKFCKSGKTNLCGKIRATQGKGLMPDGTSRFKCKGKDLLHFMGTSTFSQFTVVADISVVAVQPEAPMDRTCLLGCGITTGYGAARVTANVEEGSSLAVFGAGCVGLSVVQGAVINKAGKIIVVDVNPAKEEWARKFGATDFVNPTKLPEGKTVVDALVELTDGGCDYTFDCTGNVQVMRAALEACHKGWGESIIIGVAAAGQEISTRPFQLVTGRVWKGCAFGGIKGRSQLPGLVDDYLQGRLKVDEFITHRKKLVEINNAFETMKQGDCIRAVVDMRAV

SEQ ID NO: 43431 - protein, 560 aa, Ashbya gossypii ATCC 10895
MVFNACGRRSGNLVSSALRTGRRYSGTLHKLYTQLKPQELLPDNTPDYVRMILRSSVYDVIEESPMSEAKLLSAKLDTNVCLKREDLLPVFSFKLRGAYNMISNLDEYQKSAGVIACSAGNHAQGVAFSARELGIRAMIVMPTSTPSIKYNSVAAMGAEVVLYGKDFDEAKAECARLAQLHKLTDIPPFDHPYVIAGQGTIATEILRQVHNASQIGAVFCGVGGGGLIAGIGSYLKRIAPHIKIIGVETHDAPTLHTALKQGRRTMLPAVGCFADGTSVRMMGEETFRVARDVVDEVVLVNTDELCAAIKDIFEDTRAIVEPSGALGVAGLKKYIASHQDAENSRHTYVPVLSGANMNFDRLRFVSERAVLGEGKEVFLAVTIPDVPGSFKRMNQIIHPRAVTEFSYRYNEHARRNQDGTARACIYTSFSVADPAAEVPDVLTRLRALGFDARDISANELAKSHARYLVGGAARVPNERLFAFEFPERPGALTNFLAGLDSSWNITLFHYRNHGADVGRVLVGIAVPSDEYSAFDAFLSGLGYAYQEETGNPVYREFLLC

SEQ ID NO: 43432 - protein, 223 aa, Burkholderia xenovorans LB400
MTTQILFIRHGETDWNRIKRIQGHVDIPLATTGLAQAQRLARRMAEEAKQGARLDAIYSSDLQRAQQTAQPVADALGLPLQLRENLRERSYGAFQGHDNDEIAQRFPDEYAHWQTRDPGFSPPDGESQRALYHRVLHAIEPLVAAHPGGRIACVAHGGVLDCVRRFACGLPLDAPRDYPLLNTSVNTVDFDNGKATIVTWADVSHLDAPSEDDSFKKAAEPGR

SEQ ID NO: 43433 - protein, 382 aa, Ralstonia metallidurans CH34
MLPSFPSAILALADGTVFRGYSIGASGHTIGEVVFNTAITGYQEILTDPSYSRQIVTLTYPHIGNYGVNPEDVEATKVHAAGLIIKDLPILASNFRKEHTLAHYLKQEKVVAIAGIDTRKLTRILREKGAQNGCILAGEDNVQKAIDLARSFPGLAGMDLAKVVSVKEPYEWTQTEWKLGEGYGKQDKPQFHVVAFDFGVKFNILRMLAERGCKVTVLPAQASAADALALNPDGIFLSNGPGDPEPCDYAIAATREFIARGIPTFGICLGHQIMALAVGAKTLKMSTGHHGANHPVKDHDDGRVVITSQNHGFAVDASTLPANARVTHTSLFDGTLQGFALTDKPAFCFQGHPEASPGPHDIAYLFDRFTKLMQDARAKAAA

SEQ ID NO: 43434 - protein, 327 aa, Staphylococcus aureus subsp. aureus MW2
MIKSGKARAHTNIALIKYWGKKDEALIIPMNNSISVTLEKFYTETKVTFNDQLTQDQFWLNGEKVSGKELEKISKYMDIVRNRAGIDWYAEIESDNFVPTAAGLASSASAYAALAAACNQALDMQLSDKDLSRLARIGSGSASRSIYGGFAEWEKGYSDETSYAVPLESNHFEDDLAMIFVVINQHSKKVPSRYGMSLTRNTSRFYQYWLDHIDEDLAEAKAAIQDKDFKRLGEVIEENGLRMHATNLGSTPPFTYLVQESYDVMALVHECREAGYPCYFTMDAGPNVKILVEKKNKQQIIDKLLTQFDNNQIIDSDIIATGIEIIE

SEQ ID NO: 43435 - protein, 440 aa, Staphylococcus aureus subsp. aureus MW2
MKTYDLIVIGFGEAGKTLAKYAASTGQHVAVIEQSPKMYGGTCINIGCIASKTLVHDGLEGKSFEASYNRKNDVVNALNNKNYHLLADDNNIDVLDFKAQFKSNTEVNLLDQHDDIADSITAPHIIINTGATSVIPNIKGLDQAKHVFDSTGLLNINYQPKHLVIVGGGYIALEFASMFANLGSKVTVLERGESFMPREDQDVVAHAITDLENKGITLHTNVETTELSSDNHHTTVHTNVGNFEADAVLLAIGRKPNTDLALENTDIELGDRGEIKVNAHLQTTVPHIYAAGDVKGGLQFTYISLDDYRIIKSALYGNQSRTTDNRGSVPFTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 43436 - protein, 300 aa, Dehalococcoides sp. VS
ALMLVNALCIYIVARLLKSCHTESLDRAVLMAQGGEFAFVLFSAAVNARLIQAEIGANLTAIVVLSMVLTPVAIIALRKLSPKTALSLEGVDEPNGLSGSVLLIGFGRFGQVVSQSLLARAVEVAIIDTDVEMIESAQTFGFKVYYGDGTRLDVLRASGAATAQLIAICIDDRAAATSTAQLIRHEFPQARVLARSFDREHALELVHAGVDLQIRETFESAMRFGEAALIELGVSADDAAEVVADIRRRDAERFELELVDGVRAGVSLLYGNMQQTPLIAPKPRQAQRDDEEEHAPGISA

SEQ ID NO: 43437 - protein, 229 aa, Leavenworthia crassa
QESGMCVLLGLMIFMSILILMIYLTCLRIKTVGLDSIFLWEDSLVLKDVKKLFLLDAWVPADDVLSLCKAVLEAYRDLGTRGNRQKTRMMWLIDELGVEGFRSEVEKRMPNGKLERGSLEDLVKKQWERRDYLGVHPQKQEGLSFIGLHVPVGRLQADDMDELARLADTYGSGELRLTVEQNIIIPNVETSKTEALLQEPFLKNRFSPEPSILMKGLVACTGNQFCGQA

SEQ ID NO: 43438 - protein, 95 aa, Synechococcus elongatus PCC 7942
MAVETIQKPETTTKRKIAPRYRVLLHNDDFNPMEYVVMVLMQTVPSLTQPQAVDIMMEAHTNGTGLVITCDIEPAEFYCEQLKSHGLSSSIEPDD

SEQ ID NO: 43439 - protein, 229 aa, Leavenworthia uniflora
QESGMCVLLGLMIFMSILILMILLTCLRIKMVGLDSIFLWEDSLVLKDVKKLFLLDAWVPADDVLSLCKAVLEAYRDLGTRGNRQKTRMMWLIDELGVEGFRGEVEKRMPNGKLERGSLEDLVKKQWERRDYFGVHPQKQEGLSFIGLHVPVGRLQADDMDELARLADTYGSGELRLTVEQNIIIPNVETSKTEALLQEPFLKNQFSPEPSILMKGLVACTGNQFCGQA

SEQ ID NO: 43440 - protein, 156 aa, Photorhabdus luminescens subsp. laumondii TTO1
MLEKSLILIKPDAVHRGLVGKIITEFEEKGFKIHNIRSLVLNDEDFYFLYPKILGKPFHKQFKTVMQSAPSTLLVLSGHNALGSIFNFAGAYSNPEEDTTRSIRQKYSVWTGADVIHRAADSNEAMKQIAYFFDEVCEYRHNNEAFMAKEYWEPNV

SEQ ID NO: 43441 - protein, 188 aa, Vitis vinifera
  misc_feature (33)..(33): Xaa can be any naturally occurring amino acid
MKGQGSYVPPPYIPLGQSDSEVEIVPHDSDLPXHRHTSDSPSQWSSGICACCDDMQSCCIGFFCPCFLFAKNAEFLGSGTLAGSCMTHLIFWALVNTVCCLLSDGTLLGLPGCFVACYACGYRRALRSKYNLQEAPCGDFTTHFFCHLCAICQEYREIRERSGPETPDLRLSVVTAPPVQTMETASKE

SEQ ID NO: 43442 - protein, 333 aa, Triticum aestivum
  misc_feature (189)..(189): Xaa can be any naturally occurring amino acid
  misc_feature (241)..(241): Xaa can be any naturally occurring amino acid
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSVHVLGMRAAKSAGILCSYDPNVRLPLWPXARRRDGIMSIWTEATSSSEPQEVASLTRRTPPNEEDVPLVLVGGLQLLIATXGEKGVRTSPGFRGSGPGNRYSVTTAGPRVFAASSPYRFPEAPVSISGPPPRSSFPGAWGRWSTQGARRFRLRPTVGCSISRPTYIGVDAAVV

SEQ ID NO: 43443 - protein, 249 aa, Solibacter usitatus Ellin6076
MKRLSTLFLIAACAFAQTTPPAAAPAKKAAPAPAKKEAAPPAPERDPGLYMIINTSLGTITAQLFEKEAPGTVANFVALARGTKAYKNKAGAMVKGPYFNNLIFHRVIPGFMIQTGDIAGTGSSDCGFTIKDEIVPTLKYDKPGRLGLARLDSPNTGACQFFITDAPYPSLSGQYTIFGQVVEGQDVVSKIAAVPRDNMDKPRTPVRLISMTIKRYGPPPAGTAPVPAKKAAPAPGTTAPKKAATPAKQ

SEQ ID NO: 43444 - protein, 411 aa, Mycobacterium tuberculosis
  misc_feature (233)..(233): Xaa can be any naturally occurring amino acid
MATVSRLRPYATTVFAEMSALATRIGAVNLGQGFPDEDGPPKMLQAAQDAIAGGVNQYPPGPGSAPLRRAIAAQRRRHFGVDYDPETEVLVTVGATEAIAAAVLGLVEPGSEVLLIEPFYDSYSPVVAMAGAHRVTVPLVPDGRGFALDADALRRAVTPRTRALIINSPHNPTGAVLSATELAAIAEIAVAANLVVITDEVYEHLVFDHARHLPLAGFDGMAERTITISSAAXMFNCTGWKIGWACGPAELIAGVRAAKQYLSYVGGAPFQPAVALALDTEDAWVAALRNSLRARRDRLAAGLTEIGFAVHDSYGTYFLCADPRPLGYDDSTEFCAALPEKVGVAAIPMSAFCDPAAGQASQQADVWNHLVRFTFCKRDDTLDEAIRRLSVLAERPATGVPRGLEHHHHHH

SEQ ID NO: 43445 - protein, 546 aa, Pseudomonas aeruginosa
MSELIRVPDIGNGEGEVIELLVKPGDKVEADQSLLTLESDKASMEIPSPKAGVVKSIKAKVGDTLKEGDEILELEVEGGEQPAEAKAEAAPAQPEAPKAEAPAPAPSESKPAAPAAASVQDIKVPDIGSAGKANVIEVMVKAGDTVEADQSLITLESDKASMEIPSPASGVVESVSIKVGDEVGTGDLILKLKVEGAAPAAEEQPAAAPAQAAAPAAEQKPAAAVPAPAKADTPAPVGAPSRDGAKVHAGPAVRMLAREFGVELSEVKASGPKGRILKEDVQVFVKEQLQRAKSAVPAPRGAGIPPIPEVDFSKFGEVEEVAMTRLIEVGAANLHRSWLNVPHVTQFDQSDITDMEAFRVAQKAAAEKAGVKLTVLPILLKACAHLLKELPDFNSSLAPSGKALIRKKYVHIGFAVDTPDGLLVPVIRDVDRKSLLQLAAEAADLADKARNKKLSADAMQGACFTISSLGHIGGTGFTPIVNAPEVAILGVSKATMQPVWDGKAFQPRLMLPLSLSYDHRVINGAAAARFTKRLGELLADIRTLLL

SEQ ID NO: 43446 - protein, 161 aa, Parvularcula bermudensis HTCC2503
MGRIAMAIGLAPVLLLAPPWYGVFILLMIAATDVLDGHLARRRGEVTALGAALDPIADKLVAIAALSAYIADGRIEGIHLIPALAILFREALVAGLREAAAGKVALPVSRAAKLKTALQFVAFSILAVPQAASVGLALLWVAGGLTLITGGSYLRLFVQKL

SEQ ID NO: 43447 - protein, 447 aa, Debaryomyces hansenii CBS767
MAKSSTKSAKADKKQVKSKKQVKKQESSSESSSSSSSESESSSSSESDSDSSDEEKEEEKKVSSDSDSSSDSESEAEVKKEKKDDSSDSDSDSSSSDSDSSDEEEAPKKEAKKDTKKVAKKEVKKEASSSSSSSSSESDSDSSSSSSSSSDSDSDSDSDSEEEEKDSKKRKVEESSEEVEESTEEPVSKKPKTNEEPATLFVGRLSWSIDDEWLRREFEPVGGVISARVIMERSTGKSRGYGYVDFDSKSAAEKALQEYQGKELDGRPINLDMSTGKPHASNPNTDRAKQFGDVPSAPSDTLFVGNLSFNAERDSLFNTFGEYGTVVSCRIPTHPDTQQPKGFGYVQFSSVDEAKAALEALNGEYLDGRACRLDFSTPRDNSNAPRGGFGGNRGGRGDFGGNRGGRGGFGGRGDFGGRGGFGGRERSAPPRSAPNSAEFKGTKKTFD

SEQ ID NO: 43448 - protein, 404 aa, Arabidopsis thaliana
MSIPCLTEETAKTVLRQVEFYFSDSNLPIDDFLKKTVTESEDGLVSLALICSFSKMRGYLKLGDSKGDDIPEDTIKAVADTLRTSSALKISDDGKKVGRSTELLKLEDLIEQLNARTVAASPFSYDVKREDVESFFSQYGKVNSVRMPRHVAESRIFSGVALVEFPTEEDAQNVMKQNLVFAGQELELKPKKEFDNEREKDEVKFANYQPQKGSANQKNGSDHKNNSAYEPDYPKGLIISFTLKRSAEEGTTEQKSSEEPTDKTMEESETKPADTPDADKENTGEVQAEGAEDEDDEKEEKGALATHKDNKDVVLREDLKAVFGKFGDVKFVDFKMGSETGYLRFDEPEASQKARAAAVLANEGGLAVKNFIAVLEPVIGEAEKEYWTLLRSKDRFDKGGRGGR

SEQ ID NO: 43449 - protein, 219 aa, Xylella fastidiosa Dixon
MPPNAQHSPQTCDPKQMSSPLEYAKYLLSAHTIHQLPSDDGSEVAFAGRSNAGKSSVLNTLTRQNALARVSKTPGRTQQLVYFTVTPQRYLVDLPGYGYAKVPKELQIHWQTFIDSYFHQRQALRGLVVVMDIRHPLKEYDLQMLAYARQRGLPAQALLTKADKLGRGQQAQTLQKVRNELTKHFADHIDIQTFSSKSRQGVEQLHTVIETWLGLARSG

SEQ ID NO: 43450 - protein, 502 aa, Oryza sativa Japonica Group
MAVAVAASLSTPAPSPAAGGRGRRRVNVAVASLRRAAAGGGSSWRSKRRLMSELERTVTPGAAERVIRSYVASKSERAALAALSRLLMDSDPFAIPVPRAACFYEVVTQARWFKWSSIHAAAVAALLESNGSAEESRSLISDSISRLHSTSSSSEEVSLFYCDLMAAFSSRGMRDRAMDFYSQLRASPPLSGKKTYTAMIKSLCLMGLAGEAEAALREMASRGHQPEAFQFGLVAKCYGKAGSMAEMERVISSMSDAGIRLGTGAANIVLSCYTSCRDHSRMLAWLRRMRKLRIAPTTKAFNFVLNSCPTVASMAQELGESLPLSTAELVKKLRSASQWPAEAELVQELLTSSSVLDKAMDWSESEVKLNLHGFSTIAAYVLILQWVDAMKARRALPLEFPVVCGIGKHSDVRGEPKVRELAQEVLSRMGSPLRLSMRNKGRLVAKRDRVKQWLATDWSSPVDEESTDQSPNGDNQQPFLLTLMRKLGQVLSPFLQFSKGKA

SEQ ID NO: 43451 - protein, 205 aa, Triticum aestivum
MAEGKKDAPKLNQRMVSSLSKRTAAAHSWHDLEIGPEAPLIFNAVVEITKGSKVKYELDKKTGMIKVDRILYSSVVYPHNYGFVPRTLCEDGDPIDVLVLMQEPVIPGCFLRAKAIGLMPMIDQGEKDDKLIAVCVDDPEYRHLNDLKELSPHRLAEIRRFFEDYKKNENKEVAVNDFLPPETAQAAIKHSMDLYAEYILQSLKN

SEQ ID NO: 43452 - protein, 411 aa, Xylella fastidiosa Dixon
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWSAAQGRLPEHRTIVTFRGSFHGRTLGAVTATAQPKYQEGYEPLPGGFRYVDFNHIEALEAAMVGGDVAAVMLEPIQGEGGVMPVVPGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLVSVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRFGG

SEQ ID NO: 43453 - protein, 586 aa, Bacteroides fragilis YCH46
MYIEKINSPKDIKELSVEQLSVLAEEVRTALIRKLSEHGGHIGPNLGMVETTIALHYVFNSPIDKIVFDVSHQSYVHKMLTGRMAAFLDPAKYDDVTGYTNPDESEHDFFTIGHTSTSVSLAMGLAKGRDLIGGKENIIAVIGDGSLSGGEALEGLNNAAMLGSNMIIIVNDNDQSIAENHGGLYKGLKELRDTNGESPDNIFKAMGLEYYYLGDGHDVSALIKLFTSVKDIDRAVVLHIHTIKGKGLKYAEENKEYWHAGGPFHIEDGSPKGPGWPVNETVRESVLDLIEKRSDVVAITAGTPSVIGFTEDYRKRAGKQFVDVGIAEEHAVAMASGIARNGGTPIFGVFSPFLQRTYDQLSSDLCLNNNPAVIMVFMASVYGMNSNTHLGIYDIPMISHIPNLVYLAPTSKEEYLAMFKYATTQKAHPIAIRIPMMMPETGIEDTTDYSLLNKYQVVRKGSGVAIIALGDFFELGVQIADKYKILTGNDVTLINPKFITGIDEELLECLKTDHELVLTLEDGIVEGGFGQTIASFYGLSDMKVKNYGIKKSFPTDFRPEELMRENGLSVEQIIEDIKSVCREHVM

SEQ ID NO: 43454 - protein, 250 aa, Vitis vinifera
MGRKFFVGGNWKCNGTVEEVKKIVTVLNEAEVPSEDIVEVVVSPPFVFLPLVKSLLRSDFQVAAQNCWIRRGGAFTGEISAEMLVNLGIPWVILGHSERRSLLAESNEFVGDKVAYALSQGLKVIACVGETLEQRESGSTMAVVAAQTKAIAGWDNIVLAYEPVWAIGTGKVATPAQAQEVHCELRKWLHDNAGDEVAASTRIIYGGSVNGANCKELTTQLDVDGFLVGGASLKPEFIDIIKSATVKKSA

SEQ ID NO: 43455 - protein, 456 aa, Ashbya gossypii ATCC 10895
MGQILSNPVIDKEQGRSGDALTAYGMCAMQGWRMSMEDSHIVDLDISPEGSDDHIAYYCVFDGHGGASVAQFCGEQFSRILQQQKDFGGDAPNFARALVAAFIAADEELLKDPVLANDHSGCTATTLLVSHKQQLLVCANSGDSRTVLSTDKNAKALSFDHKPTLRSEQSRIMAADGFVEMDRVNGNLALSRAIGDFEFKSNPNLAPHEQIVTCVPDVLEHKLDYEKDEFVILACDGIWDCLSSQECVDLIHYGIQQGMGLQDIASRVIDVCCSPTTEGTGIGCDNMSFIVVALLRENETEDQWFERMRAKKYQGLLSFEAQRRKVFSYHYDFINEDDDNLFDISTKRPEERNRGSGSLPPMHATTREDPDEEDGANPADGRQHLYSLEELINAGGIQITQGGNNTSYIHGSALSEVLASLVGATGGIVARPAQRADAEDNVSEEQDGKKLEEIQE

SEQ ID NO: 43456 - protein, 180 aa, Zea mays
MLRAGGRRLLAPGLRRLGLGTGASGEAGPAAAAAGVRAYHERVVDHYNNPRNVGSFDKDDPNVGTGLVGAPACGDVMKLQIRVDENSGKIVDACFKTFGCGSAIASSSVATEWVKGKPMDEVLTIKNTEIAKHLSLPPVKLHCSMLAEDAIKAAVKDYEAKKSKMGQKGEDSPSEKAAEA

SEQ ID NO: 43457 - protein, 446 aa, Shewanella sp. ANA-3
MSEAKLLLVEDDASLREALLDTLMLAQYDCIDVASGEEAIIVLKQHQFDLVISDVQMQGIGGLGLLNYLQQHHPKLPVLLMTAYATIGSAVSAIKLGAVDYLAKPFAPEVLLNQVSRYLPLKQNSDQPVVADEKSLALLSLAQRVAASDASVMILGPSGSGKEVLARYIHQHSSRADEAFVAINCAAIPENMLEATLFGYEKGAFTGAYQACPGKFEQAQGGTLLLDEISEMDLGLQAKLLRVLQEREVERLGGRKTIKLDVRVLATSNRDLKAVVAAGQFREDLYYRINVFPLTWPALNQRPADILPLARHLLTKHAKALSIIDVPEFDEAACRRLLGHRWPGNVRELDNVVQRALILRSGTVITANDIIIDAQDVPLSSDDAEYCSEPEGLGEELKAQEHVIILETLAQCQGSRKLVAEKLGISARTLRYKMARMRDMGIQLPN

SEQ ID NO: 43458 - protein, 191 aa, Brassica napus
MKRGSLSLNPISLPPPEQSISKFLTQSGTFKDGDLQVNKDGIQTVSHSEPGAPPPIDPLDNQLSLADLEVIKVIGKGSSGSVQLVKHKLTQQFFATKVIQLNTEESTCRAISQELRINLASQCPYLVSCYQSFYHNGLVSIVMEFMDGGSLLDLLKKVQRVPENMLAAISKRVLRGLCYIHDERRIIHRDL

SEQ ID NO: 43459 - protein, 525 aa, Xanthomonas oryzae pv. oryzae KACC10331
MIGCSLTPFRSGSLHIGNTGQATTAHPHPALRATFSRWRRERQRTLEMAENYDVVVIGAGPAGYHAAIRAAQLGMKVACIDAALGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIALKGTNVILAAGSESIELPFAKFDGDTIVDNVGGLDFTAVPKRLAVIGAGVIGLELGSVWKRLGAEVTILEALPDFLALTDAEVAKTALKEFKKQGLDIKLGAKVGKTEITGSGDAKQVLLSYTDAAGEQTLTVDKLLVAVGRKAATKNLLAEGTGVKVTDRGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFNGSADDLARICHAHPTLSEAIHDAAMAVSKRAIHKAN

SEQ ID NO: 43460 - protein, 353 aa, Coccidioides immitis RS
MVQPGAQGGSRKISFNVSDQYDIQDVIGEGAYGVVCSALHKPSGQKVAIKKITPFDHSMFCLRTLREMKLLRYFNHENIISILDIQKPRNYESFTEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPLKALFPKTSDLALDLLEKLLAFNPVKRITVEEALRHPYLEPYHDPDDEPTAEPIPEEFFDFDKNKDSLSKEQLKVLIYEEIMR

SEQ ID NO: 43461 - protein, 947 aa, Saccharum officinarum
MAASVSGATICLQKPGSKGRRARDATSFARRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQNQDAGSILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGTGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 43462 - protein, 254 aa, Pyrococcus furiosus DSM 3638
MKLKFWREVAIDIISDFETTIMPFFGNPDGGKLVKISPSGDETKLVDKLAEDLILSRITELGVNVVSEEVGVIDNESEYTVIVDPLDGSYNFIAGIPFFALSLAVFKKDKPIYAIIYEPMTERFFEGIPGEGAFLNGKRIKVRKTPDEKPSISFYSRGKGHEIVKHVKRTRTLGAIALELAYLAMGALDGVVDVRKYVRPTDIAAGTIIAKEAGALIKDSAGKDIDISFNATDRLDVIAVNSEELLKTILSLLE

SEQ ID NO: 43463 - protein, 303 aa, Triticum aestivum
  misc_feature (94)..(94): Xaa can be any naturally occurring amino acid
  misc_feature (196)..(196): Xaa can be any naturally occurring amino acid
  misc_feature (214)..(214): Xaa can be any naturally occurring amino acid
  misc_feature (220)..(220): Xaa can be any naturally occurring amino acid
MDRYQRVEKPRNETPMRENEIRITALGRMRNYIGYGMSLLEENGPDEITIKAMGRAINKTAMVAELIKRRVAGLHQNTSIESVGITDTWEPLEXGLVPLETTRHVSMITLTWSKEPLDTSSPGYQPPIPAEEVKAGGDYEHEGSLPSARGRGRVAPAGRRRGRGRSISDGPPPYDCGEEWEAAGDYYYNGRGRGAXRLQPRGRGRGSYGGGRRXGYGYDXGYGGRGRLPMKKPVELFEGRSQNNITPLPRGGGWGAKKELAQQRKSKKGPNLIDIFPALKTHVHCAGGRRVPPAKEIFPRDLI

SEQ ID NO: 43464 - protein, 501 aa, Glycine max
MATRVVAEQKPKTKIVCTLGPASRSVPMIEKLLRAGMNVARFNFSHGSHEYHQETLDNLRAAMENTGILCAVMLDTKGPEIRTGFLKDSKPIQLKQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVRTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASVIKILTVK

SEQ ID NO: 43465 - protein, 119 aa, Triticum aestivum
  misc_feature (53)..(53): Xaa can be any naturally occurring amino acid
ARVRLSPLLAFSALRSIRFDLFRVRVQAAAVGVTIQSVKARQIFDSRGNPTVXVDVCCSDGTFARAAVSSGASTGVYEALELRDGGSGYLGKGVSKAGDNENWSMAPALIGEDPTGNTG

SEQ ID NO: 43466 - protein, 775 aa, Yersinia pestis KIM
MMSKENIVTRENTAVSENAVSEPTVNNDVGASATNSVTHPAFTLNVRPDNIGIITIDVVGDKVNTLKAEFADQIATILQQAHALPKLQGLVIVSGKPDSFIAGADITMIAACRTAHDARVLAQKGQSILAQIAAFPVPVVAAIHGACLGGGLELALACHSRICSLDDKTVLGLPEVQLGLLPGSGGTQRLPRLVGVSKALDMILTGKQIRPRQALKMGLVDDVVPRDILLDVAIQRAKAGWLNRRALPWQERLLSGPLGKALLFRIVRKKTLAKTRGHYPAAERIIDVVRKGLDQGGPSGYEAEARAFGELAMSPQSAALRSLFFATTSLKKETGSAATARAIHRVGVLGGGLMGGGIANVTATRAGLPVRIKDINPQGINQALKYTWDALGKRVRSKRMRPTEQQRQMMLISGSTDYRGFERVDIVVEAVFEDLSLKQQMVADIERFGAAHTIFASNTSSLPISQIAALAQRPEQVIGLHYFSPVDKMPLVEVIPHEKTSEETIATTVALARKQGKTAIVVADRAGFYVNRILAPYINEAARCLLDGEPIESVDNALVDFGFPVGPMMLLDEVGIDVATKIMPILVEQLGPRFAAPPSFDVILKDGRKGRKNGRGFYLYSNPTKNSSPTKNGNSPAKRNSFKWRKNKVKPVDASIYTLLGVTPKAHLGAGVITQRCTMLMLNEAVRCLDESIIRNPRDGDIGAVFGIGFPPFLGGPFRYLDSLGADKVVQALRLLVQQYGERFEPCQRLVTMAEQQQQFYPVDANIDEVTDVAS

SEQ ID NO: 43467 - protein, 454 aa, Glycine max
MEPRVGNKFRLGRKIGSGSFGEIYLGTNIQTNEEVAIKLENVKTKHPQLLYESKLYRILQGGTGIPNVRWFGVEGDYNVLVMDLLGPSLEDLFNFCSRKLSLKTVLMLADQMINRVEFIHSKSFLHRDIKPDNFLMGLGRRANQVYAIDFGLAKKYRDSSTHQHIPYRENKNLTGTARYASMNTHLGIEQSRRDDLESLGYVLMYFLRGSLPWQGLKAGTKKQKYEKISEKKVSTSIEALCRGYPTEFASYFHYCRSLRFDDKPDYAYLKRIFRDLFIREGFQFDYVFDWTILKYQQSQLATPPTRAIGPSAGTSSGMPPAVTNADRHTGGEEGRPPALVSVDSSRRRMSGPILNTLSSANALGQSSGSSRRVAVSSSRDAFVGAESDIRTRTAEASPGAAHRALSGQRSSPIGSSDPKRVVSSGRNASHVKNYDTALRGMEGLQLENDERTHY

SEQ ID NO: 43468 - protein, 282 aa, Pseudomonas putida
MTDTARLLRSRSFVELGARQRARAVLDPGSFRELLGPFDRLMSPWLPLQGIVPQADDGVVIAKGTLNGRSAVVAAIEGGFQGGSMGEVGGAKIAGALELAIEDNRNGIPTCAVLLLETGGVRLQEANLGLAAIAEIQAAIVELRAWQPVIGVIAGSVGCFGGMSIAAGLCSHLLVTREARLGLNGPQVIEQEAGIAEYDAKDRPFIWSLSGGEQRHASGLVDGYVADDIQALRDCLLQLLDSPGADRARQHAWFLERLARLGADCPQLDAAAVRALYQGEAQ

SEQ ID NO: 43469 - protein, 445 aa, Shewanella sp. ANA-3
MQNRRHQLLNKLNHCIDKVPPFRAVASGQLVRVVGLTLEASGCRAPVGSLCSIETMAGELIAEVVGFDDELLYLMPIEELRGVLPGARVVPLGEQAGLSVGLSLLGRVLDGNGVPLDGLGALSTEQQAPRHSNAINPLSRRAITEPLDVGVRAINAMLTVGKGQRMGLFAGSGVGKSVLLGMMTRGTTADIIVVGLVGERGREVKEFIEEILGEKGRARSVVVAAPADTSPLMRLRACETSTRIAEYFRDLGYNVLLLMDSLTRYAQAQREIALAVGEPPATKGYPPSVFAKLPRLVERAGNGGPGQGSITAFYTVLTEGDDQQDPIADASRAILDGHIVLSRSLADSGHYPAIDIEASISRVAPMVISNEHLEAMRRVKQTYSLYQQNKDLISIGAYAQGSDPRIDNAIRLQPAMNAFLRQTMRDAFSFADSQVMLGQLAAQCK

SEQ ID NO: 43470 - protein, 440 aa, Burkholderia xenovorans LB400
MSSQQQAAQLAQSAATLHSVPSYLNKDDLGPWGNYLRQVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRTLSRGELERVTRRYTSEIGIIIGPNTDIPAPDVNTNEQIMAWMMDTYSMNQGQTATGVVTGKPITLGGSLGRREATGRGVFVVASEAARRIGVDIEGARIAVQGFGNVGGIAARLFQEAGSKLVAVQDHTGSLYKSTGIDAVALLEHVAKHGGVGGFPEADAVSNEEFWTVESDILIPAALENQITEKNAAKIRTKIVVEGANGPTTTAADDILHDRGILVIPDVVANAGGVTVSYFEWVQDFSSFFWTEDEINQRLERVMREAFAAVWQVSSEQKVSVRTAAFIVACKRILEARELRGLYP

SEQ ID NO: 43471 - protein, 442 aa, Sinorhizobium meliloti 1021
MSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGMNHVLYTNSGSESVDTALKVALAYHRAKGNGSRFRLIGRERGYHGVNFGGISVGGIVANRKMFGTLLTGVDHLPHTHLPAKNAFSRGEPEHGADLAAELERIVTLHDASTVAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYREEGLLTRAAELAPYWEEALHSLKDCPHVIDIRNIGLIGAVELEPIAGEPTKRAFSAFLKAYEKGLLIRTTGDIIALSPPLIIEKRQIDELFDKLRDVLKNNI

SEQ ID NO: 43472 - protein, 236 aa, Saccharomyces cerevisiae
MRLNISYPVNGSQKTFEIDDEHRIRVFFDKRIGQEVDGEAVGDEFKGYVFKISGGNDKQGFPMKQGVLLPTRIKLLLTKNVSCYRPRRDGERKRKSVRGAIVGPDLAVLALVIVKKGEQELEGLTDTTVPKRLGPKRANNIRKFFGLSKEDDVRDFVIRREVTKGEKTYTKAPKIQRLVTPQRLQRKRHQRALKVRNAQAQREAAAEYAQLLAKRLSERKAEKAEIRKRRASSLKA

SEQ ID NO: 43473 - protein, 421 aa, Bacillus clausii KSM-K16
MEKMDENQEDKLDVLAATQSIIHKALKKLGYPDEMYELLKEPVRMLTVRIPVRMDDGSTKIFTGYRAQHNDAVGPTKGGVRFHPDVSEKEVKALSIWMSLKAGIVNLPYGGGKGGIVCDPRQMSFREVERLSRGYVRAISQIVGPTKDIPAPDVFTNSQIMAWMLDEYSRIREFDSPNFITGKPLVLGGSHGREAATAKGVTICIMEAAKKKGIDLEGARVIIQGFGNAGSFLAKFMADAGALVVGIADAYGALYAEEGLDIDYLLDRRDSFGTVTNLFKDTITNEELLEKDCDILVPAAIENQITSHNAGKLKAAIVVEAANGPTTLEATQILAERGILLVPDVLASAGGVTVSYFEWVQNNQGYYWTDEEVEGRLRTVLTEAFNNIYNLALRRKVDMRLAAYMVGVRRMAEASRFRGWV

SEQ ID NO: 43474 - protein, 321 aa, Bacillus clausii KSM-K16
MNMRHVMLLTTGGTIASTTSESGKLVAGELSGEELAKLCGLPEDIHVSVRSVLQKPSVHMTLADWLLLKHEVERAFADETINGIVVTHGTDTLEETAYFLDLTNKDERPIIVTGSQRGPEQTGSDAFMNLRHAIYAACEPDLKHTGCVVVFNERIFAARYVKKEHASNLQGFNAFGFGYLGIIDNDVIFTYQKPVRREFYEIGNTPLKQIGIAKVYLGMSADMLEGMIAVCDGMVVEGVGRGQVPPNLVATLERAVANKKPIIVTTASEEGKVYPTYDYKGSAHQLEQMGVILGSDYDSKKARIKAMVMLAANKELAAGFT

SEQ ID NO: 43475 - protein, 336 aa, Staphylococcus aureus subsp. aureus MW2
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMENGTITGRMVIKF

SEQ ID NO: 43476 - protein, 525 aa, Oryza sativa Indica Group
MPRWLSSSSPAVAASTSTPTTTRKMLEFIIKTHQDVYVCSSASFIICSDYEIKFVKATIDRYKKAHACGSTSGAPLIEVNAQQYYQQESAKLRHQIQMLQNTNKHLVGDNVSNLSLKELKQLESRLEKGIAKIRARKNELLASEINYMAKREIELQNDNMDLRTKIAEEEQQLQQVTVARSAAMELQAAAAAQQQQQNPFAVAAAQLDMKCFFPLNLFEAAAQVKYEGTKMTEAAEWNDENTKIICELYAEQVRAGNRPSTHLNSIGYSQVASKFQQRTHLLYTKRQFKNKWDKLRNEYTIWKKLLIRGSGLGWDSTKGTIAADENWWNKTNTELPGAKKFRKAGMKNLDHLRVMFDDIASNGVDHTPVPATSSPSTPESPVNVANLDGLDNGMEDNDDTQLEEESPSNRNKKRPRHANNANKNKSSRTEIALLMQAQLKGMADLAEKAQATFENFTSLVGSLGSSIQYVMTLVQECGARSGSDEHFIATELFVSREQREMFLTLSTAEERLEWLRRKYKAKYGA

SEQ ID NO: 43477 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGIAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 43478 - protein, 131 aa, Glycine max
SCQTDRGCIVIDGYGKTNVPGIYAIGDVAGPPMLAHKAEHEGVICVEAIKGLHPHPMDKNLIPGCTYCQPQVASVGLTEAKAKENGREIRVGRFPFVGNGKAIALGEDQGLVKVIFDKKTGQLLGAHMVGA

SEQ ID NO: 43479 - protein, 209 aa, Neisseria meningitidis serogroup B
MNLFQNAKFFTTINHLKDLPDTPLEIAFVGRSNAGKSSAINTLTNHVRLAYVSKTPGRTQHINFFELQNGNFMVDLPGYGYAQVPEAVRAHWVNLLGDYLQQRKQLIGLVLIMDARHPLKELDIRMLDFFHTTGRPVHILLSKADKLSKNEQIKTLSQVKKLLKPYSDRQNISVQLFSSLKKQGIDEANRTVGSWLDAADAAASSPEEN

SEQ ID NO: 43480 - protein, 202 aa, Photorhabdus luminescens subsp. laumondii TTO1
MNNKMQLKRVAEAKLPTPWGDFLMVGFEEIATGQDHVALVYGTISGNEPVLSRIHSECLTGDALFSLRCDCGFQLEAALAQIAKEGRGVLLYHRQEGRNIGLINKIRAYALQDNGIDTVEANHQLGFAADERDFTLCADMYKLLGIQAIRLLTNNPKKVEIMTEAGINIVERVPLITGRNPKNAYYLDTKARKMGHLLSEQN

SEQ ID NO: 43481 - protein, 672 aa, Zea mays
  misc_feature (277)..(277): Xaa can be any naturally occurring amino acid
MSSFFAVAVALVLSSLIHGTTMATASSEESFFQKCPASSCSEGGPEIRFPFRLATSPLSCGAPGMELVCSKADTVLVHPNLGLCKVTAIWYGGSTITIVPLAAEPEPKCPFQKIISTNLSTDVYRPYGDRATLVSCSAEFIVPSHPASLAGPISCLTNASRRFAYLVPSFRPMDFLPLDCTVLSNSISVPYPASVNAGFNGTARGAIAFGETMLEWRVPNITDVCRDCEAEGRLCGFSSESRQAFCKSKNHSSRLKVIAGTWFQCTFDLLSVISISXQQNRSTLSYIVVSSTKDLNNRLQSNNRLIFSNPVCSVTTPVAAVLVLSAMAGAALLHLALKSKYDDEIHRKVEMFLETYRTLKPRRYTFSEVRKMTRRFSSRLGQGGFGSVYKGELPNGGVPVPVAVKMLEDSTGEEEFISEVATIGTIHHANVVRLLGFCSERSRRALVYEFMPNASLEKYIRCSSQEQSLIPTASKMLEIATGIARGIEYLHQGCDQRILHFDIKPSNILLDYNLNPKISDFGLAKLCARDQSVVALTAARGTMGYIAPELYSRNFGTVSCKSDVYSFGMVVLEMVVVSAKRRKYSPAETEDQNDDVCVPEWIYEEIVTGQEPREMARGERDMVRKLAIVALWCIQWNPPNRPSMTTVVNMLTDSLQSLKIPPKPFVSSFVGQ

SEQ ID NO: 43482 - protein, 528 aa, Thinopyrum ponticum
MALEAAYHYLQRAVGHGTSTEALLLTVLLLLIIRVAWVRAFTTTTASTKCKQQLPPTPPGKLPIIGHLHLIGSHPHVSFRDLAAKHGRDGLMLVHVGAVPTVVVSTPQAAEAVLRTHDHVFASRPRNPVADIIRYNSTDIAFAPYGDYWRRARKVVNTHPLSVKMVYSKRHDREEEVRLVVAKICELAMAAPGKALDMTELLGGYASDFVCRAVLGESHRKHGRNELFRELTEISASLLGGFNLEDYFPRLANLDVFLRVVCSKAMGVSKRWDNLFNELIAEYEHGKEDNAEDFVHLLLSLKKEYGLSTDNVKAILVNMLEAAIETSFLVLEYSMAELINNRHVMAKVRKEVRESTPKGEKLDLIMEEDLSRMPYLKATIKEAMRIHPPAPFLLPHFSTNDCEVNGYTIPAGTRVIVNAWALARDPSHWERVEEFYPERFLQEGRDAEVDMYGKDIRFVPFGAGRRICAGATFAIATVEVMLANLIYHIDWELPSEMEAIGAKVNMTDQFGMTLRRTERLHLVPKIYK

SEQ ID NO: 43483 - protein, 466 aa, Salinibacter ruber DSM 13855
MKTASSDTLSKKDLHHTPFILFATTTAGGGSLVGDDRPWWIPGPVEGRRGPWAAISGRGGGRWRESACGLDEREATARPHQNLGDSFPRAYSPPPGSPPASVPRPGECLPKSARGPNMKEADRSNSQHFVVFLFTSFSSMPTDATLRSAQPDTLPSSPFPTDDPILGQIGGTPMLPYPGAEDGRLLCKMESANPTRSMKDRIAMGILTEALQNGEYDRVVEASSGNTAGAVALVANRLGVPCTLTCPEGTSPHKIGYMKAFGAEVRTCPDVDSDHPDHYRAVAQRIAEDTGAFLVDQYHNQSNPGVHYQWTGPEIWAQAGADMTHLVSAMGTGGLVSGTARHVKEQAADAGRDVTVVGVDAEHSNISTSFYGADAVPYDTCVEGLGKGGELPTMWFDHVDEMRDVADEEAFRQAREAAQTHGMPVGPSAGAALSVARDIHAEQPDATVVMIVCDGGEQYFDTLFDV

SEQ ID NO: 43484 - protein, 305 aa, Sinorhizobium meliloti 1021
MTGKLLSIGECMVELMQAERDMLRKGYAGDTFNTAYYARLFLPADWTVDYFTAVGTDTVSDELLAFIESTGVGTAHIRRIEGRTPGLYMIHLKDGERSFSYWRSTSAAKLLADDPDRLRAAIEAANVVFFSGITLAILSPDAAETLLAELRRAKAGGRQVVFDPNIRPRLWDDAARMRATIEAGGRAATMVMPSFDDEATHFGDASVEATIERYRALGAENVAVKDGKNGVTLCFAGKERVHVPASQVSAVVDTTSAGDSFNGSFLARLASGDSPADAAAFAARIAAAVIGHHGALIGRDKLPRG

SEQ ID NO: 43485 - protein, 344 aa, Bordetella parapertussis
MDMGWPHKAAANTTIGRRLGAALRGPAPGCPFILLLYSVRIFVAMTDTPDPAAVLSPAVKAAVLSEALPYIRRFHGKTIVVKYGGNAMTEERLQRSFAHDVVLLKLVGLNPVVVHGGGPQIDDALRRIGKQGTFVQGIRVTDAETMEVVEWVLGGQVQQDIVMMINEVGGKAVGLTGKDGMLIQATKKLMVNKDDPSQPLDIGFVGDITRVEPAVVKALQDDQFIPVISPIGYGEDGTAYNINADVVAGKMAEVLGAEKLLMMTNTPGVLDKGGKLLRSLSAQTIDELFADGTISGGMLPKISSSLDAAKNGVNSVHIVDGRVPHCLLLEILTDQGVGTMISSH

SEQ ID NO: 43486 - protein, 178 aa, Candida albicans SC5314
MSIEEIPQGADVNVIPKNEKKARELIKKLNLKQIKGISRVTFKQRGNLIYAIDSPDVYRSAAGTYVVFGEAKVDDMNQRIAEAQAQQAQQEALQKAAADAGKTEDKSPEAITADLEKASLGDKKAEDEEEDEGEIDETGLDPKDIEIVVEQTQVSRAKAVKALRNHDGDMVNAIMDLS

SEQ ID NO: 43487 - protein, 101 aa, Zea mays
FLFNNGGSPIGGEIHGGPSNFIKNGNSPGFVGPLPNGLGKWGASKVRGGGGRPAALGPALGGKKDSLCFFGGFAPKDAPPKERLEWGFRVFAPNSRPPNPH

SEQ ID NO: 43488 - protein, 324 aa, Anabaena variabilis ATCC 29413
MDIKNGFVGTVGNTPLIRLNSFSEETGCEILAKAEFLNPGGSVKDRAALYIIEDAEKKGLLKPGGTVVEGTAGNTGIGLAHICNAKGYKCLIIIPNTQSQEKIDALTALGAEVRPVPAVPYKDPNNYVKLSGRVAAELDNAIWANQFDNLANRLAHYETTGPEIWTQTDGKVDGWVASTGTGGTFAGVAMYLKDQNPAIKCVVADPLGSGLYSYIKTGEIKIEGNSITEGIGNSRVTANMEGAPADDAIQIDDHEALRVVYQLLRKDGLFMGGSTGINVAGAVALAKQLGPGHTIVTILCDSGSRYQSRIFNRDWLASKGLTVD

SEQ ID NO: 43489 - protein, 436 aa, Saccharomyces cerevisiae [sequence omitted]

SEQ ID NO: 43490 - protein, 401 aa, Triticum aestivum
MATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 43491 - protein, 394 aa, Bacillus megaterium
MNKKTLKDIDVKGKRVFCRVDFNVPMKDGKVTDETRIRAAIPTIQYLVEQGAKVILASHLGRPKGEVVEELRLNAVAERLQALLGKDVAKADEAFGEEVKKTIDGMSEGDVLVLENVRFYPGEEKNDPELAKAFAELADVYVNDAFGAAHRAHASTEGIAQHIPAVAGFLMEKELDVLSKALSNPERPFTAIVGGAKVKDKIGVIDHLLDKVDNLIIGGGLSYTFIKALGHEVGKSLLEEDKIELAKSFMEKAKKNGVNFYMPVDVVVADDFSNDANIQVVSIEDIPSDWEGLDAGPKTREIYADVIKNSKLVIWNGPMGVFELDAFANGTKAVAEALAEATDTYSVIGGGDSAAAVEKFNLADKMSHISTGGGASLEFMEGKELPGVVALNDK

SEQ ID NO: 43492 - protein, 394 aa, Geobacillus stearothermophilus
MNKKTIRDVDVRGKRVFCRVDFNVPMEQGAITDDTRIRAALPTIRYLIEHGAKVILASHLGRPKGKVVEELRLDAVAKRLGELLERPVAKTNEAVGDEVKAAVDRLNEGDVLLLENVRFYPGEEKNDPELAKAFAELADLYVNDAFGAAHRAHASTEGIAHYLPAVAGFLMEKELEVLGKALSNPDRPFTAIIGGAKVKDKIGVIDNLLEKVDNLIIGGGLAYTFVKALGHDVGKSLLEEDKIELAKSFMEKAKEKGVRFYMPVDVVVADRFANDANTKVVPIDAIPADWSALDIGPKTRELYRDVIRESKLVVWNGPMGVFEMDAFAHGTKAIAEALAEALDTYSVIGGGDSAAAVEKFGLADKMDHISTGGGASLEFMEGKQLPGVVALEDK

SEQ ID NO: 43493 - protein, 586 aa, Mesorhizobium sp. BNC1
MGVRETLAKGAMALGLLLATPALAQQAADTLAPEIASGTEEKAPVKARRQMVVAANPLAAEAGLKILREGGSAADALVAVQTVLGLVEPQSSGVGGGAFLVWYDAENGTLTTFDGRETAPEAATAELFLDEKGEPLAFFDAVVGGRSVGTPGVVRLMEKAHERYGTLDWNILFQPAITLAENGFEVSPRLHALIAADKGKLDKEEAARAYFYDADGEPLDEGTLLKNPDYAQTLRAIGEKGADAFYTGEIAEKIVAAVQNHPTNAGLLSLEDLAAYEVRERPAVCAPYRGYELCGMGPPSSGALTIGQILGMVSHFDLGGLGSDDPESWRIIGDATRLAFADRELYMADSDFVSMPQGLLNPDYLKDRASLIRRPTALPAEEVKAGTPPWDKAELRIPGIDMEQPSTSHFVIVDEAGNIASMTTSIENGFGSRQMAAGFLLNNQLTDFSFTPEEDGKAVANRVEPGKRPRSSMSPTVVLQDGRPVFALGSPGGSNIIPYVANTLIALIDWDMDMQQAISLPHLTNRFGTYILEAGTPAEELADDLTALGFEVEAGELNSGLHGIAFTSEGLEGGADPRREGVALGD

SEQ ID NO: 43494 - protein, 157 aa, Listeria monocytogenes str. 1/2a F6854
MIRIGQGYDVHKFAYDRDLIIGGVKIPYEKGLLGHSDADVLLHAITDAIIGAIGAGDIGHFFPDTDMAFKDADSAELLAEIWQKVEADGFRLGNLDATIIAEKPKMAPYVEQMKLRIAELLHADSAQVNVKATTTEKLGFTGREEGIASLAVVLLEK

SEQ ID NO: 43495 - protein, 2240 aa, Ashbya gossypii ATCC 10895
MVCAEAAGRHEANTNSMQAKLTDLIPTAPVTPALDADHGRLMTLELKDGTALQGYSFGAPVAAAGELVFQTGMVGYPESITDPSYEGQILVITYPMVGNYGVPDRQLMDELVESLPRYFESNRIHVAGLVVAHYTEKHSHWLAQSSLGQWLREEGVPAIYGVDTRALTKHLRDSGSMLGRLAVQKADANLQEATGDQWRACFDVPEWVDPNVQNLVAKVSVNEPRLYTPRLESAVRGPDGKILRVVAVDVGMKYNQIRCFVQRGVELLVVPWDYDFQEEEYDGLFISNGPGDPSVLTELASRLSGALLEKKTPIFGICLGHQLLARASGASTLKLKFGNRGHNIPCTSTISGRCYITSQNHGFAVDVDTLADGWKPLFVNANDGSNEGIYHTELPYFSVQFHPESTPGPRDTEFLFDVFINSILEHKNSGVLKSVEFPGGRVEDHLKAHPRQEPKKVLVLGSGGLSIGQAGEFDYSGSQAIKALKEEGIYTILINPNIATIQTSKGLADKVYFLPVTAEFVRKVILHERPDAIYVTFGGQTALSVGIEMKDEFEALGVKVLGTSIDTIITTEDRELFANAMDEINEKCAKSKAASTVDEALEAVKDIGFPVIVRAAYALGGLGSGFASNEQELVDLCNVAFASSPQVLVERSMKGWKEVEYEVVRDAFDNCITVCNMENFDPLGIHTGDSIVVAPSQTLSDEDYNMLRTTAVNVIRHLGVVGECNIQYALNPFSKEYCIIEVNARLSRSSALASKATGYPLAYTAAKLGLNIPLNEVKNSVTQSTCACFEPSLDYCVVKMPRWDLKKFTRVSTLLSSSMKSVGEVMSVGRTFEEAIQKAIRSTDYSNLGFNETDMELNIDEELANPSDLRIFAIANAFAKLNYSVEKVWQLTNIDRWFLEKLHSLITFGREVEAFGTKEALPRSLMKQAKQLGFDDRQIAKFLNSNEVAIRRVRKEYGIVPFVKQIDTVAAEFPAFTNYLYLTYNASEHDLEFNDHGVMVLGSGVYRIGSSVEFDWCAVTAVRTLRQNNVKTIMVNYNPETVSTDYDEVDRLYFETINMERILDIYEVESSAGVVVSMGGQTSNNIAMSLHRENVKILGTSPEMIDSAENRYKFSRMLDQIEVDQPAWKELTSMEEAEDFANKVGYPVLVRPSYVLSGAAMNTVYSKDDLESYLNQAVEVSREYPVVITKYIENAKEIEMDAVAKDGEMIMHVVSEHVENAGVHSGDATLIVPPQDLDPETVRRIVDATAKIGRALKITGPYNIQFIAKNNEIKVIECNVRASRSFPFISKVIGVNLIEMATKAIMGIPVTPYPIEKLPDDYVAIKVPQFSFPRLAGADPVLGVEMASTGEVATFGHSKYEAYLKSLLSTGFKLPKKNILLSIGSYKEKQEMLPAVQKLYKMGYKLFATAGTADFISEHGIPVQFLEFLNEDDEKSEYSLTQHLANNKIDLYINLPSANRFRRPASYVSKGYRTRRMAVDYSVPLVTNVKCAKLLIEALARNLTLDVSERDAQTSHRTVTIPGLINISAYVPNISNVTQGPAELKEVTRLSVESGFTYSQIMPRSTVGPVITNATSLKAAQSVCENSAYTDFGFTVAATANNVEEVASLANQATALFIPYRELTNKVSLVAEHLKNWPVEKQIIAEAKTSDLASVILLASLQGRPIHITGVSHKEDLALIMTVKEKMNNVTCDVNIHSLFVSQDDYPEALFLPTKEDQDFFWRNLQEIDAFSIGSMPTLLATVTSNKVVTGLGIKEALPLLLSAVNDGRLTLEDIVERLHDNPAKIFNIPEQDAKVEIDLDFTFRHTKRWTPYTKGGLTGGVERVLLDGQTVVLSGDLVASAALGEAVVPTSNNYTSTPLLNAEPLHSFVPPSSSGKKRFSFSRERGNSFASAGDHEEAVIDQPLEQRLMSSRPPKELSPPSALRELVRAHNPFRGRNILSVNQFKRSDFHALFAVAQELRAAVEREGVLELMKGRLLTTIFYEPSTRTSSSFIAAMERLGGRTVNINTSASSVKKGETLQDTIRTLACYSDAIVLRHPDEMSAHIASKYSPVPIINGGNGSREHPTQAFLDLFTIREELGTVNGISVTFMGDLKYGRPVHSLCRLLKHYQVRINLVSPKELSLPDGLRNELIDAGLLGIESESLTPEIISRSDVLYCTRVQQERFEREEDYLRLKNTYIVDNKILAHAKQQMVVMHPLPRVSEIREEVDYDHRAAYFRQMRYGLFVRMALLAMVMGVNL

SEQ ID NO: 43496 - protein, 143 aa, Triticum aestivum
MAPAALKAQLNALLDSMFTTGIVDEAFQHLRSVEQEGFLAEVVNLFLQDADNILNEVAHLLNQPVVNFGRVGALVHQLKGCSASVGAKKVNLSCTHFRQFYEAQSKEGCLMALDLVRNEFYDVRNKLQTMIQLEQQIAAMGPQ

SEQ ID NO: 43497 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINAAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 43498 - protein, 295 aa, Medicago truncatula
MIVNHYNLRNNIKSFNLGGMGCSAGMISINLAKDILNANPDSCAVVVSTETLTHNWYKGNDRSMLLSNCIFRMGGAAVLLSNKSFDRTQSKYKLLHSVRTHSGANDKSYNCVFQKEDETGYTGVSLSKELMKVAGEALKNNITELGPLVLPFSEQLMFMISLFRKKSSNYVPNFKLAFEHFCIHAGGRSVLDAMQNNIELSEWHMEPSCSTLHRFGNTSSSSLWYELAYVEAKGRVSKGDRVWQIAFGAGFKCNSAVWRACRDIPLLHDWTGNPWDDSVNNYPIHFSNSKITPSS

SEQ ID NO: 43499 - protein, 534 aa, Medicago truncatula
MGRNSIDMDKERLTAEMDFKDSTSAVIKIRRRLPDFLQTVKLKYVKLGYGYSCNATTILIFTFVVPLLLFLTVQFQLTDLKLHRLSQLLLEHTVQLDTDTAIGSIFLLFLFGLYYAKRSPPIYLVDFACYKPENERKIAVESFVKMLEDSGEFGEETLQFQRRILSRAGLGDETSLPNGIMSSPPNLCMKEARLEAESVMFGSLDALFAKTGVNPRDIDILVVNCSLFNPTPSLSAMIVNHYKLRTNIKSYNLGGMGCSAGLISIDLAKDLLKANPNSYAVVLSTENLTLNWYFGNDRSMLLSNCIFRMGGAAILLSNKSSDRTRSKYKLVHTVRTHKGADDKNYNCVYQKEDETGKVGVSLARELMAVAGDALKTNITTLGPLVLPFSEQLMFFVSLVRRKLLKGSGVKPYIPDFKLAFEHFCIHAGGRAVLDELQKNLQLSEWHMEPSRMTLHRFGNTSSSSLWYELAYTEAKGRVAKGDRVWQIAFGSGFKCNSAVWKAVRDLPVVGDWRGNPWDDSVHKYPVSVPVSVAS

SEQ ID NO: 43500 - protein, 267 aa, Oryza sativa Japonica Group
MAPFSSSSSPSPALAPASSSSTASTPRAPRQQLPRGASSSSSSSPVYLNVYDVTPANGYARWLGLGVYHSGVQGISWGGIRLRGARRGGDGIFEVPPRRCPGYAFREAIPGGDDGADARRGARGHGGPRRGLPRRRLQPRLPQNCNHFCDAACRRLVRARIPRWVNRLAKIGVVFTCVIPGNGAAVRRKGDPPGHRQRPPAGRPASRSRSARQGADAAAPPRPKTFFRSLSVGGGGGGGGGKNVTPRPLSTSPSPTPPAPPAFTTAT

SEQ ID NO: 43501 - protein, 268 aa, Nostoc sp. PCC 7120
MIMQKLLFHDRTSFRAQALFLGKKINLQRLENYVCLATMPLMVTVGEYGCAVLLGYGAVVLFNLEPAEKVGFLTQLSSQVSDSFTEPETEEVEVHLNVAESERVKEGKIFLHEFSVERLQIVADILAKSVVLSHYETSLATVFDQIEPFAASLQSDNRSKRKSRELLRQLGTTLLVQHKIVGRVEIIDKPELLWESPQLENLYLRLEDEYEIRERHNALERKLELISQTAQTVLEFMQHSSSQRVEWYVVILIVVEILLSLYDIIFKS

SEQ ID NO: 43502 - protein, 402 aa, Vitis vinifera
MGKKRSWFSLVKGVFISEAKKKEEKKSKRWKWVFTRLKLKQCPALAAPCRTLTEARDEQKKHAMTVALATAAAAEAAVAAAHAAAEVVRLTGTPQSYHTYDKGNQNLAAIKIQTAFRGHLARKALRALKGLVRLQALIRGQILRRQVITTLKCLPSTANNQAQVNKRGVLTANESYKDSDNRKFLRPKELGGREIKLEGSSKKSWDCSMLLKEDMETIWLRKQEAVTKRERMKKYSSSHRERINAQMTEETESYKENGKWNSQFEQWMDAREYEREELENSKSTIHLNINACKQNSIEGSNLPFSHSRRSFCHRKHNSEADNRSFPSSPVFPTYMATTESAKAKARSMSMPKQRVGFLDSCFDHSSAYKNRLSFWSSFNGESISNIGKNGTPQNSVTMKSFN

SEQ ID NO: 43503 - protein, 528 aa, Thinopyrum ponticum
MALEAAYHYLQRAVGHGTSTEALLLTVLLPLIIRLAWVRAFATTTASAKCKQQLPPTPPGKLPIIGHLHLIGSHPHVSFCDLAAKHGRDGLMLVHVGAVPTVVVSTPQAAEAVLRTHDHVFAPRPRNPVADIIRYNSTDIAFAPYGDYWRRARKVVNTHLLSVKTVYSKRHDREEEVRLVVAKIRELATAAPGKALDMTELLGGYASDFVCRAVLGESHRKNGRNEPFRELTEISASLLGGFNLEDYFPRLANLDVFLRVVCSKAMGVSKRWDNLFNELIAEYEHGKEDNAEDFVHLLLSLKKEYGLSTDNVKAILVNMFEAAIETSFLVLEYSMAELINNRHVMVKVQKEVRESTPGGEKLDLIMEEDLSGMPYLKATIKEAMRIHPPAPFLLPHFSTNDCEVNGYTIPAGTRVIVNAWALARDPSHWERAEEFYPERFLQEGRDAEVNMYGKDIRFVPFGAGRRICAGATFAIAIVEVMLANLIYHFDWELPSEMEAIGAKVDMSDQFGMTLRRTERLHLVPKIYK

SEQ ID NO: 43504 - protein, 583 aa, Coprinopsis cinerea okayama7#130
MPAPRIDWTKVNQVKAPFSRFHSRRSVVYGTKGMVSSSQPLATAAGLEVLNKGGNAADAAVAVSAALTVTEPSSCGIGGHSDAFCLFYDASTKQVKALNGSGRAPKKLTIEYAKQRGHKTSIPLSDLNSVTVPGAAAAWLDTIEHFGSGKVSVGDVFGPAIRFAEEGFPVSELSSHSWKLLETLIQNASPNGNELLVDGKAPLPGQVVKLPTLAQTFRELVQHGKDGFYKGRVAQAIVELIQSKGGLMDLDDLADHTSTFVEPIKYTYAGEVTVYECPPNGQGITALLALGILENIQEQGLSRPLSEMEHNSPEYLHTVVEALRLAFADSQWYVTDPEFKKAPVEELLSKRYLSERAKLFNPDKMNSDVVHGSPVNSSDTVYFTVTDQWGNACSFIQSVYEGFGTGAIPKGCGFALQNRGSNFKLDENHPNALQGGKRPYHTIIPALATRGDELFLSYGVMGGFMQPQGHVQVLLNILRGFSVQEALDAPRFCISPGMPHAEGVQAPERAGDVNSEVYFEEGIPDSTVQALREMGHDARTTKGFKRAMMGRGQVIQKLPSSSGQLVWAAGSDPRADGHAAPQI

SEQ ID NO: 43505 - protein, 406 aa, Ralstonia metallidurans CH34
MSTTPHFPIYMDYSATTPVDPRVADKMIPYLREQFGNPASRSHAYGWDAERAVEEAREQVAALVDADPREIVWTSGATESDNLAIKGAANFYSGKGKHIITVKTEHKAVLDTTRELERQGFEVTYLDVKDDGLIDMDVFKQAIRPDTILVSVMLVNNEIGVIQDVEQIGEICREKGIIFHCDAAQATGKVTIDLSTLKCDLMSFSAHKTYGPKGIGALYVRRKPRVRIEAQMHGGGHERGMRSGTLAPHQIVGMGEAFRLAREEMATENERIRMLRDRLWNGLSSMEEVYLNGSMEHRVPHNLNVSFNFVEGESLIMAIKDVAVSSGSACTSASLEPSYVLRALGRNDELAHSSIRFTVGRFTTEAEIDYTVELLKNKIGKLRDLSPLWEMFKDGVDLNSIQWAAH

SEQ ID NO: 43506 - protein, 254 aa, Brucella melitensis 16M
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPIWAIGTGLTPTVQDVRAAHAFMREQLIERFGAKGAHLRLLYGGSVKPSNAAELLGVADVDGALVGGASLKAADFLAICETYRNL

SEQ ID NO: 43507 - protein, 133 aa, Ralstonia metallidurans CH34
MSYSNKVLDHYENPRNVGSFDKNDDAVGTGMVGAPACGDVMKLQIKVNEAGVIEDAKFKTYGCGSAIASSSLVTEWVKGKTVDQALEIKNTQIAEELALPPVKIHCSILAEDAIKAAVDDYKKKHPGAEQKAA

SEQ ID NO: 43508 - protein, 446 aa, Gossypium hirsutum
MEERHVLFGKYEMGRLLGKGTFAKVYYGKELATGESVAVKVISKDQVKKKGMMEQIKREISVMRLVRHPNIVELKEVMATKKKIFFVMEHVRGGELFAKVYKGKLKEHVARKYFQQLISAVDFCHSRGVSHRDLKPENLLLDEKEDLKISDFGLSALPEQLLNDGLLHTQCGTPAYVAPEVLRKKGYDGSRADIWSCGVVLYVLLAGFLPFQDENMMKMYRKVFKAEFEFPTWFSTESKRLISKLLVADPEKRITIPAIMRDPWFRKEFTRPLAFSIQEPIDDDESAPSKSAKLSSPKFFNAFEFISSMSSGFDLSGLFEDKRKSGTMFTSRCSASAIMSKVEAVAKGLNFRVGKAKDFKMRLQGSSEGRKGRLFVTAEVFEVAPEVAVVEFSKSAGDTLEYAKFCEEDVRPALKDIVWTWQGDSFNEAEEHEKQVQQDTAEPNTL

SEQ ID NO: 43509 - protein, 264 aa, Triticum aestivum
  misc_feature (54)..(54): Xaa can be any naturally occurring amino acid
MAVDYGSREERWSLAGTTALVTGGSKGIGHAIVEELAGFGARVHTCSRNAVELXEECRRRWGEKNLQVTVSVCDVSIRADREKLMETVRETFNSKLDILVNNAGQLLFKPTTECTVVEYSNLLTTNLESSFHLSQLAHPLLIHASIAGGGSIINMSSIGGSIGYAGSAIYATTKGAMNQLTRSLATEWASDKIRVNGIAPGFVTTDMLKDIDTEYVKEEHSKTPLGRSGKPVEIASAVSFLCMPAASFITGQIICIDGGRTISA

SEQ ID NO: 43510 - protein, 343 aa, Vitis vinifera
  misc_feature (127)..(127): Xaa can be any naturally occurring amino acid
  misc_feature (129)..(129): Xaa can be any naturally occurring amino acid
  misc_feature (134)..(135): Xaa can be any naturally occurring amino acid
  misc_feature (151)..(151): Xaa can be any naturally occurring amino acid
  misc_feature (213)..(213): Xaa can be any naturally occurring amino acid
MGADAGDRVQVDEPIAQIETDKVTIDVASLKVGVIQKFVAKEGDVVDPGTKIAVISKSGESVTHVASSKKKLDEAAPKPPPAAEIKNENKKSKPETAPVMGKPKVPMTRLRKRVAMHLKDSQNTFAXLXTFNEXXMTNLMKLRSDYKDAFXEKHGVKLRFMSGFVKAAVSGLQNQPIINAVIDGDDIIYRDYINISIAVGTPKVCQRRPVAHXTEGLVVPVICDAGRMNFAEIEKEINTLAKKANDGTISIDEMAGGSFTISNGGVYGSLLSTPIINPPQSAILGMYSIVKRPMVVGGNIIATSMMYIALTYDHWLIDGREAVLFLRHIKEVMEDPCCLLLDI

SEQ ID NO: 43511 - protein, 315 aa, Brassica napus
  misc_feature (129)..(129): Xaa can be any naturally occurring amino acid
MRIRSSFFSIFLLSSSSSSPSPSPSPSSSFFSSSRFSSLSAMSPGANGDFKSRVTVVGSGNWGSVAAKLIASNALKLPSFHDEVRMWVFEEVLPNGEKLTDVINKTNENVKYLPGIKLGRNVVADPDLXNAVKEANMLVFVTPHQFMGGICKKLKGKVTGEVEAISLVKGMEVKKEGPCMISSLISKELGINSCVLMGANIANEIAVERFSEATVGYRESREIADTWVQLFSTPYFMVTPVHDVEGVELCGTLKNVVAIAAGFADGSEMGNNTKHIVTKKEVTIYRWNPDKPNSKPLFQSFFGDVPTCGPMVIVV

SEQ ID NO: 43512 - protein, 409 aa, Methanobacterium bryantii
MSLPFYTIDDFNLEDKTVLVRVDINSPVDPSTGSILDDTKIKLHAETIDEISKKGAKTVVLAHQSRPGKKDFTTLQQHAKALSNILNRPVDYIDDIFGTAAREEIKRLKKGDILLLENVRFYPEEILKRDPHQQAETHMVRKLYPIIDIFINDAFAAAHRSQPSLVGFAVKLPSGAGRIMEKELKSLYGAVDNAEKPCVYVLGGVKVDDSIMVLENVLRNGSADYVLTTGLVANIFLWASGINLGKYNEDFIINKGYIDFVEKGKQLLEEFDGQIKMPDDVAVCVDNARVEYCTKNIPNKPIYDIGTNTITEYAKFIRDAKTIFANGPAGVFEQEGFSIGTEDILNTIASSNGYSIIGGGHLAAAANQMGLSSGITHISSGGGASINLLAGEKLPVVEILTEVKMKGRK

SEQ ID NO: 43513 - protein, 545 aa, Candida albicans SC5314
MPLHPKSRRRSSRISPLPDEDSLSFINSSVENLDQSPFESIDDLVEDVNKYDLKSPSDEQQQQQQQESQTQNLKHKPSFTSTPKASYIPPWTEPYIIGIAGNSGSGKTSISQKIIQDINQPWTVLLSFDNFYQPLTSEQSKLAFANNYDFDCPDSLDFDLLVETIGNLKKGGKTTIPVYSFTSHNRTSKTNTIYGANVIIVEGLYALHDQQLLDMMDLKIYVDTDLDICLARRLTRDILYRGRDLGGAMQQWEKFVKPNAVKFINPTVQNADLVIPRGLDNSIAINLMIKHIKNQLALKSRNHLQRLKKLGVNIKFDIDKFNIKLLQNTNQVKGINSILFDTSTSRNDFIFYFNRMCGLLIELAQEFMTNYTNVDIDTGKGIYHGKKLLQNQYNAVNIIRSGDCFMASIKKSFPVISIGKLLIQSDSTTGEPQLHFERLPHKLSDKIMLFDSQIISGAGAIMAIQVLLDHHVKEQDIILITYLSTEIGIRRIVNVFPKVKIVVGKLSSMEDSNSNNKVWYNNEGFLDSHWHFRNRFIDSLYFGTE

SEQ ID NO: 43514 - protein, 355 aa, Physcomitrella patens subsp. patens
MPIAMGPLPSTSGRDRTSEFHAIVDRLRKTQGSTLPYANEANGAVTNGHAGETARLLPPTTGSLQSEFNKRASQIGLSIHQTSQKLSKLAKLAKRTSMFDDPAVEIQELTSVVKQDITALNAAISDLQQLCDSRNDGVNQTKHSSEHSTTVVDTLKSRLMNTTKEFKDVLTLRTENLKVHDNRRQLFTATANKQVNPYARQGPLASAAQNTASSTSVSLPPWGNGAGRSNELFSSRRRHTADGPESSQSQARLQQQQLAPVQDSYMQNRAEALQNVESTIVELSTIFTQLATMVAQQGEVAIRIDENMDESLSNVEGAQNQLLKYLDSISSNRWLILKIFMVLITFLLIFVVFVA

SEQ ID NO: 43515 - protein, 410 aa, Methanothermus fervidus
MFKFYTMDDFDYSGSRVLVRVDINSPVDPHTGRILDDTRMRLHSKTLKELVDENAKVAILAHQSRPGKRDFTTMEEHSKVLSNILDMPVTYVEDIFGCAARESIRNMENGDIILLENVRFYSEEVLKRDPKVQAETHLVRKLSSVVDYYINDAFAAAHRSQPSLVGFPLKLPSAAGRLMEREVKTLYKIIKNVEKPCVYILGGVKIDDSIMIMKNILKNGSADYILTSGLVANVFLEASGIDIKEKNRKILYRKNYKKFIKMAKKLKDKYGEKILTPVDVAINKNGKRIDVPIDDIPNFPIYDIGMETIKIYAEKIREAKTIFANGPAGVFEEQQFSIGTEDLLNAIASSNAFSVIAGGHLAAAAEKMGISNKINHISSGGGACIAFLSGEELPAIKVLEEARKRSDKYI

SEQ ID NO: 43516 - protein, 283 aa, Oryza sativa Japonica Group
MGKEADVEAGGVRDYEDPPPAPLVDIDELGRWSLYRAVIAEFVATLLFLYVTVATVIGYKHQTDASASGDDAACGGVGVLGIAWAFGGMIFILVYCTAGISGGHINPAVTFGLFLARKVSLVRAILYIVAQCLGAVCGVALVKGFQSSFYDRYGGGANELAAGYSKGTGLAAEIIGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 43517 - protein, 415 aa, Penicillium chrysogenum
MSLSNKLPVTDVDLKGKRVLIRVDFNVPLDENENVTNPQRIVGALPTIKYAIDNGRKAVVLMSHLGRPDGKVNPKYSLKPVVPVLEELLGKSVTFTEDCIGPQTEETVNKASDGQVILLENLRFHAEEEGSSKDAEGKKVKADKADVDRSASLTALGDVYVNDAFGTAQRAHSSMVGVDLPQKAAGFLVKKELEYFAKALESPARPFLAILGGAKVSDKIPVIDNLLPKVNSLIIIGGMALTFKKTLENVKIGNSLFDEAGSKILGEIVEKAKKHNVEIVLPVDYVTADKFSADATVGSATTQRIPDGYMGSDVGPESVKLYQKTIAEAKTILWNGPPGVFELKPSPRPTEATLDAAVKAAESGSIVIIGGGDTATVAAKYKAEDKISHVSTGGGASLELLEGKELPGVAALSSK

SEQ ID NO: 43518 - protein, 212 aa, Anabaena variabilis ATCC 29413
MALRLGDTVPNFTQASTHGDIDFYEWAGDSWVVLFSHPADYTPVCTTELGTVAKLKPEFDKRNVKAIALSVDDVESHKGWVGDIEETQSTTLNYPILADADRKVSDLYDMIHPNANAAVTVRSVFVIDPNKKLRLSFTYPPSTGRNFDELLRVIDSLQLTDNYSVATPADWKDGDKVVIVPSLKDPEVLKEKFPKGYEVVKPYLRLTPQPNK

SEQ ID NO: 43519 - protein, 84 aa, Glycine max
IFNVLFLQIEYLPISSVEKSKQILEEFIDIWKEVVSKKSLAGQFMHTEPNYAEYGLSDNYTSQHTAVQYAAALAQLIQSAQLRN

SEQ ID NO: 43520 - protein, 394 aa, Physcomitrella patens subsp. patens
MADEPEPASHREVDNSSTQGKPITCRAAIAYEKSKPLVIENVEVAPPQAGEVRVKILYTALCHTDFYTLSGKDPEGLFPCILGHEAAGVVESVGEGVTELKPGDHVIPCYQAECRECKFCKSGKTNLCGKVRPATGKGVMLSDGQSRFKVAGKPIYHFMGTSTFSEYTVLHDVSVAKINPDAPLDKVCLLGCGIPTGLGAVFNTAKVEPGSNVAVFGLGTVGLAVCEGAKKAGAKRIIGVDTDPSKFDLAVKFGATEYVNPKDFDKPIQDVLVEMTDGGVDYSFECIGNVQVMRAALEACHKGWGTSVIVGVAAAGQEISTRPFQLVTGRVWKGTAFGGYKSRTDVPKLVDEYMKQEIKLDEYITHKFPLGKINEAFGLLEAGKCLRAVINMEQ

SEQ ID NO: 43521 - protein, 340 aa, Bacillus clausii KSM-K16
MQKIAVIGAGSWGSALAMVLADNGHDVRLVGRRQEQMDELNERHTNESYLPNIELPTTIRGYTGMEEALGGVEAIVLVVPTKAMRETVRKIVPYLQKAVPVIHASKGIEPATHKRISEMIAEEDASTNRISSITVLSGPSHAEEVALRQPTTVTVASADDEAAKYTQNLFMNQQFRVYTNPDLIGVEIGGALKNIIALACGVTNGLGYGDNTKAAIMTRGLAEISRLGTTMGAKPLTFSGLSGLGDLIVTCTSVHSRNWRAGRMIGEGLSMDEVLEKMGMVVEGIRTTQAAYELSEKLEIDMPVTKALYSVLFNGIDPYQAAEELMGRVKRHEVESLYRS

SEQ ID NO: 43522 - protein, 460 aa, Oryza sativa Japonica Group
MPSANVRGAQPSADRRLSTLVRHLLPSSARTATTTSTSSSAADADSSLQAFPTMASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIRQLMRSKALLPFFDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKTRETPGDWSHIIKQIGMFTFTGLNSDQVAFMRQEYHIYMTSDGRISMAGLSGRTIPHLADAIHAAVTKLK

SEQ ID NO: 43523 - protein, 416 aa, Hypocrea jecorina
MSLSNKLSITDVDLKGKRVLIRVDFNVPLDENKKITNNQRIVGAIPTIKHALDNGAKAVVLMSHLGRPNGAVNPKYSLKPVVPELERLLGKPVTFARDCVGPEVESIVNDADNGAVILLENLRFHIEEEGSAKDKDGNKTKADKAKVEEFRKGLTALGDIYINDAFGTAHRAHSSMVGVDLPQKAAGFLMKKELDYFAKALESPQRPFLAILGGAKVSDKIQLIDNLLDKVDTLIVCGGMAFTFKKVLNNIPIGTSLFDEAGAKTCPSCREAKAKNVKLVLPVDYITADKFDKDANTGTATDESGIPDGWMGLDCGEKSIELYKEAIADAKTILWNGPAGVFEFDKFANGTKATLDAVVEGCKNGKIVIIGGGDTATVAAKYGVEDKLSHVSTGGGASLELLEGKELPGVVALSSK

SEQ ID NO: 43524 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRITTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 43525 - protein, 110 aa, Picea sitchensis
MDSNKGQGGIQLLLAAEQEAQNIVASARAAKMARLKQAKDEAEREIASYRAQREAEFRKKVSETSGDSGSNVKRLEEETKTKIEHLQNVASEVSPEVVAMLMKYVTTVRN

SEQ ID NO: 43526 - protein, 197 aa, Yarrowia lipolytica CLIB122
MEGQAQQFRGYSRTCFNCGEFGHQVRACPRVGNPVCYNCGNDGHMSRDCTEEPKEKACFKCNQPGHILKECPQNDAIVHDGAAPVAPNGEAPIGGEFGAPRGPSGVCYKCGKPGHFARACRSVPAGGAPPKFGRTQSCYSCGGQGHLSKDCTVGQKCYNCGSMGHVSKECGEAQSRVCYNCKKPGHIAIKCDEVRAA

SEQ ID NO: 43527 - protein, 546 aa, Ralstonia metallidurans CH34
MTPHAEPRFEFPMQTSVTPIAPPSRDTLLQTLAREPRWDVIVIGGGATGLGTALDAASRGYRTLLLEAADFAKGTSSKATKLVHGGVRYLAQGNISLVREALHERGLLARNAPHVVWPLGFVVPAYQMFDQPFYGIGLKLYDMLAGGLNLSGSRWLSHHETLEAAPTLAEHVGGRPLRGGNLYFDGQFDDARLAMALMRTLFDVGGTAVNYMRVSGLSQSNGVITGVTAQDVIGGETFHLRADCVINATGVWVDAVRQMEDGQARRMVAPSQGVHLTIPRSFLPGDRAVLIPKTDDGRVLFLVPWNGHTIVGTTDTPRQDLPLEPRAASDDVDFILETAARYLARDPTRDDVTSVWAGLRPLVKATGEASTASLSREHTILVSKAGLITVTGGKWTTYRKMAEDVMETAIQRQLLRAAPCRTADLPLHGATNMPNDLPPSGTGSPDRYYGADLPLVQAMPGADNVLVPASGLTEAHVRFAARYELARRVEDVLARRNRALFLDARAALDGAPRVAAILAEELAHDSAWQARELEDFGKLARGYMLG

SEQ ID NO: 43528 - protein, 636 aa, Medicago truncatula
MGDHNNKFVPPTMLRVLLVEPDDSTRHIISALLRNCGYKVAAVRDGLKAWETLKNKSLDIDLVLTEVDLPSISGFSLLTQIMDHHNCKNIPLIMMSSQDSVSTVFKFMLNGAVDFLIKPVRRNELRNLWQHVWRRNTTITMPPQNITFPQNKLDVAAENNAASNHSSGSVASTHKNIECSEKNSEPHKLATLVQSIFTSTSPFSEADSKYMENMQDNSIKYERESAEYKDVTGEKSTTIASKAAGCDKISTGLRLGQNYDYSETENRDEVLGTELSKAHPHINTKIHQSNNELEDHSAGAIDLMATFDKYPKNNHANCSFSGGNTAKFDFDTQFELSLQRDSPGSPPKPTTEERQILNHSNASAFSWYGSSMVLQPLFPTKSSHESQKLSENINTTHHYDGKKQKQENITYLVIGQSGQVDTKCQLEFFPATGATSDNKSMEHNNVLHSMFNAQSGMHPTWTPKSVFQKESSPFPTSISSHSNPKSQNSEPHHWSDDATYTCDQSNNDFAMHESPSNGQSCTSFYHDAESHNASGVCEGLGSVSDGNAPSTIVGKNNLESSMNNDHHDGLRDTSSHRTSQREAALTKFRLKRKDRCYDKKVRYESRKRQAENRPRVKGQFVRQVQGEVPVAETRGY

SEQ ID NO: 43529 - protein, 349 aa, Hordeum vulgare subsp. vulgare
MSDNSIQRALLPDNHNADVLQRKPSEGAKRFRRSRSAPRSEADQKPEENGSPLPDKELFSVIRPSFRLAGLLLFLYLLAGVVVFYLVMDQLSGKRTNRVLDALYFCIVTMTSVGYGDLVPHSDTAKLLACVFVFTGMAFIALFVSKSADYLVEKQEVLFFKALHMNMKFSKAKMLRQIETNKTKYKFYTAALLLVTTIVVGTVFLWKVEKLSLVDSFYCVCATITALGYGDKSFSSELGRTFAVFWIITSTIILALFFMYLAEIYTQRRQKMLAKWVLTRRITNMDLEAADLDNDRKVGAAEFVVYKLKELGKISQEDISSFLEEFEKLDVDQSGTLSTYDLTQAQSGQ

SEQ ID NO: 43530 - protein, 334 aa, Escherichia coli K12
MSDLYKKHFLKLLDFTPAQFTSLLTLAAQLKADKKNGKEVQKLTGKNIALIFEKDSTRTRCSFEVAAFDQGARVTYLGPSGSQIGHKESIKDTARVLGRMYDGIQYRGHGQEVVETLAQYAGVPVWNGLTNEFHPTQLLADLMTMQEHLPGKAFNEMTLVYAGDARNNMGNSMLEAAALTGLDLRLLAPKACWPEESLVAECSALAEKHGGKITLTEDVAAGVKGADFIYTDVWVSMGEAKEKWAERIALLRGYQVNAQMMALTDNPNVKFLHCLPAFHDDQTTLGKQMAKEFDLHGGMEVTDEVFESAASIVFDQAENRMHTIKAVMMATLGE

SEQ ID NO: 43531 - protein, 277 aa, Brassica napus
  misc_feature (195)..(195): Xaa can be any naturally occurring amino acid
TGKTLAKKMCASRLASEFPKDCNFDPADTRDELHQFMGLLKAQRLSVPHWRKQRPYVVAQKVGMLVDDTTPGKCTLLLSGYLRARKLSVNQLVHVTGVGDFQLSKVEVLKDPFPLLNERRKQNSMELDDSHDEEVLRSLVPDPMKQEPLVTENTPDPLAGEQTWPTEAEMAEADINQKQGKPKKRSLPRGTSEYXDEEDSDNGDFDDDRMVLDRGEDQYSNQDQDFEDDKETLYVQDMDNETHNDSEMMDDENLTREQYEDQIKKIKEAHAEDEEFP

SEQ ID NO: 43532 - protein, 567 aa, Dehalococcoides sp. CBDB1
MEELGSSFGLDLIIVLVAAVLAGLLARRFKLPLLLGYLGAGIAIGPNGFGLVQSPGVIESMATVGVILLLFTLGLDFSLDELKRVGRVAVLGGLIQIIVTAGFGFLLGRSLGWDINASIFFGFMVSLSSTLIVLKILMDRGEMEAPHGRVMLGILLVQDICLIPLMIILPALGGDGGDIGFTMGIAFAKATAFILAMFALGFWVFPRLLGRVASHSHELFLLSVITLSLGAAMGATALGLSPAVGAFIAGLLIGQSMYAKQALADIIPLRDIFGALFFVSLGMLANLNFAVENMGLVLLVVAFLVVIKSLVAGVVPWLFGYTFQTSFTTGIGLMQIGEFSFVLAGVGLAASVITDSIYAITISAAVITMIITPFALSFSGAAYRKVSQWPLASKLVSLRTSGQTEYKDLDISNHAVICSQGGVAKTLTRVMSRRNFPFLVIDLDPQTIAELRRQKAPAIYGDAANPEILKFARLDKARLLICAMPGFADTEQVVKNARKINSRLDIVARVTSDMQAEKLKKMGVSEVVQPEFEVGLELSRHAMHRFGMTTIEIQYILNSLRNMGKPE

SEQ ID NO: 43533 - protein, 409 aa, Arabidopsis thaliana [sequence omitted]

SEQ ID NO: 43534 - protein, 375 aa, Medicago truncatula
MAPPSTESNQPLANGKEKHVVKQEEEKEDNDALEFCTQLTGSIVVPLALRSAIDLGIFDILSKAGNGAQLSADDIAVKIGTKNPEAATMLDRLLRLLASHSILNSYVPQHPQTLERFYSLSNHSKYFVTDADGVSLGPTLALLLDNVFYQSWSELKGAIMEGGIAFNRVYGMHAFEYPRVDPRFNDVFNKAMVNSTTINMKRIIDCYQGFDHITKLVDVGGGLGINLKLITSKYSHIQGINFDLPHVLQHAPVYPGVEHVGGDMFESVPAGDAIFMKWILHDWSDEHCLKLLKNCYKAIPEDGKVIVVDTILPVMPETTANAKTACMSDVLMMTQNPGGKERTEHEFKELAKGSGFSAIKPICCVSGLWVMEFFK

SEQ ID NO: 43535 - protein, 193 aa, Ochromonas danica
AGGISEMAELHKDVRTKTDALDSAGNTTAAIGKGFAIGSAALVSLALYGAFVVRIRVSSHNSDSHVEILQPMTFAFLLIGSMLPYWFSALTMKSVGDAAIEMVKEVQWQFEQNPELLNPNGTARPDYSRCVAISTKSALREMIAPGALVMLAPLVAGTFFGVHAVYGLLTGALLSGVQLAVSMSNTGGAWDNA

SEQ ID NO: 43536 - protein, 719 aa, Triticum aestivum
  misc_feature (156)..(156): Xaa can be any naturally occurring amino acid
  misc_feature (673)..(673): Xaa can be any naturally occurring amino acid
MELKLAFPQDSPPLSIISAAKIAGVPLIIDPTLASGSVPTLHFSSGDFIHGVNTILRYIARAASLSSFYGQDDIQAAHVDQWLEYAPLILSGSEFEAACLFLDGYLASRTFLVGYGLSIADIVVWSNLTGTGQRWESLRRSKKYQSLVRWFNSVAXHYADALDEVTSAYVGKRGIGKSPAPSLKEKVPGLKENTSGHEIDLPGAKVGEVCVRFAPEPSGYLHIGHAKAALLNKYFAERYKGRLIVRFDDTNPSKESNEFVENVLKDIETLGVKYDVVTYTSDHFPKLMEMAESLIKQGKAYVDDTPKEQMRSERMDGVESKRRNSTVEENLSLWKEMVNGTKRGTECCVRGKLDMQDPNKSLRDPVYYRCNPDPHHRVGSKYKVYPTYDFACPFVDALEGVTHALRSSEYHDRNAQYYRILQDMGLRRVEIYEFSRLNMVYTVLSKRKLLWFVQNNMVEDWTDARFPTVQGIVRRGLKIEALIQFILEQGASKNLNLMEWDKLWTINKKIVDPVCGRHTAVLKDKRVLLTLTNGPEEPFVRILPRHKKHEGAGKKATTFANRIWLEYADASVVSVGEEVTLMDWGNAIIREIKTDDGTVTQLVGELHLEGSVKMTKLKLTWLSDIEDLVSLSLVDFDYLINKKKLEEDEDFLDNLNPCTRREALALGDPNMRXNVKKGEVIQLERKGYYRCDVPFIRSSKPIMLFAIPDGRQKSTSIGA

SEQ ID NO: 43537 - protein, 797 aa, Desulfitobacterium hafniense Y51
MKMKDFKLINAASLEEAVSGLQQSGAVAKAGGTDLLGAMKKNILPHYPKVVVNIDSIQGLDYIKEEDGMLKIGALAKLAEVAENSVVKEKYTALAEAAKKTASPNLRNMGTIGGNICQYNRCWYLRASGNYFDCLRKGGSTCYAISGDNRFHSIFGGIRIEGGLPCADDCPSGIAIPDYLGKVKAGDMAGAAAILLESNPLPAMTGRVCPHFCEDHCNRGDLDEAVSIRDLERKVGDYILEHASELIKAPEKESGKKAAVIGAGPAGLAAAFYLRLMGHSVTIIDAKEEAGGMLTYAIPAYRLPKEIVKKQVNALKATGIEFNMGVRIGQDIQLDKLMADYDAVFVACGAWKEKPTGIKGEELLLSGLNFLNDVAGGMSKLPKPEKTIVCADRGGCSLIGGVQHVAVLGGGNTAIDVARTLQRMGAVPVIVYRRTIEEMPAIKHDIEKAIEEGIEIRFLTQPVEAAQKGAKVVLTCSKMELGEPDASGRRRPVAVLNSEFNLEFDAVITAFGEDADTSFVPSKYLDGKWLKADGAYVGDNLFSGGDYLSGPSTVTQAMASGKKAAKAINAYLGGEEQECGCTSECSGLLDLSNPCMEQACRAVAPEMAVAERIKNLTGEDVASLDDAAFGTEANRCLNCGCVAVNCSDTAPALIALDAQIITTKRTIPADKFWSSKAPGSTILENDELVTEIRIPVAVAGSKSAFLKLATRATIDFPIVNCAVVISGKDARVCLNAVHPNPYRACKAEDLIKGKVIDEALAEAAGEAAVSDAIAMPNNAYKIQMAKVIVKRTILACK

SEQ ID NO: 43538 - protein, 425 aa, Brucella melitensis 16M
MTAIIDIVGREILDSRGNPTVEVDVVLEDGSFGRAAVPSGASTGAHEAVELRDGGSRYLGKGVEKAVEVVNGKIFDAIAGMDAESQLLIDQTLIDLDGSANKGNLGANAILGVSLAVAKAAAQASGLPLYRYVGGTNAHVLPVPMMNIINGGAHADNPIDFQEFMILPVGATSIREAVRYGSEVFHTLKKRLKDAGHNTNVGDEGGFAPNLKNAQAALDFIMESIEKAGFKPGEDIALGLDCAATEFFKDGNYVYEGERKTRDPKAQAKYLAKLASDYPIVTIEDGMAEDDWEGWKYLTDLIGNKCQLVGDDLFVTNSARLRDGIRLGVANSILVKVNQIGSLSETLDAVETAHKAGYTAVMSHRSGETEDSTIADLAVATNCGQIKTGSLARSDRTAKYNQLIRIEEELDKQARYAGRSALKLL

SEQ ID NO: 43539 - protein, 742 aa, Oryza sativa Japonica Group
MMGTAHHNQTAGSALGVGVGDANDAVPGAGGGGYSDPDGGPISGVQRPPQVCWERFIQKKTIKVLLVDSDDSTRQVVSALLRHCMYEVIPAENGQQAWTYLEDMQNSIDLVLTEVVMPGVSGISLLSRIMNHNICKNIPVIMMSSNDAMGTVFKCLSKGAVDFLVKPIRKNELKNLWQHVWRRCHSSSGSGSESGIQTQKCAKSKSGDESNNNNGSNDDDDDDGVIMGLNARDGSDNGSGTQAQSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARAANAPNCSSKVPEGKDKNRDNIMPSLELSLKRSRSTGDGANAIQEEQRNVLRRSDLSAFTRYHTPVASNQGGTGFMGSCSLHDNSSEAMKTDSAYNMKSNSDAAPIKQGSNGSSNNNDMGSTTKNVVTKPSTNKERVMSPSAVKANGHTSAFHPAQHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVDAERPNMEIANGTINKSGPGGGNGSGSGSGNDMYLKRFTQREHRVAAVIKFRQKRKERNFGKKVRYQSRKRLAEQRPRVRGQFVRQAVQDQQQQGGGREAAADR

SEQ ID NO: 43540 - protein, 405 aa, Dehalococcoides sp. CBDB1
MAVVVHKYGGTSVGDAERIKHVAKRIIAARQKGNDVVAVVSAMGDTTDDLIELAHKLNDCPEPREMDVLLSTGEIVSSTLLAMALKNMGQDAISLSGQQAGIRTDSVHSKARITGIDPKRIHDELDKGRVVIVAGFQGISDCQDVTTLGRGGSDTTAVALAASLGASICERYTDVDGVYTADPRLIPDARRLSEISYEEMLELSSYGAKIMHPRAVEIGQVYNIPILVASSFNENPGTLIHGGEKMEIRNKVSGIAHDFEVAKITILGVPDKPGIAAGLFAPLAKAGVSVDTIVQNSSQDHITDLTFTVTKSDLGKALEVIGPIAKELQAREVLSDSKIGKVSIIGTGMLNAPGYAARMFKALSDAGINILLISTSEIRITCIIEEDKVKDAVRAIHKAFEMEKD

SEQ ID NO: 43541 - protein, 274 aa, Brassica napus
  misc_feature (259)..(259): Xaa can be any naturally occurring amino acid
MGSSGNVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISESFEKGTVHLIGLLSDGGVHSRLDQVQLLLKGFAERGAKRIRVHILTDGRDVLDGSSVGFVETLESELAELRSKGVDAQVASGGGRMYVTMDRYENDWTVVKRGWDAQVLGEAPHKFKNALEAVKKLRAEPKANDQYXPFVIVDDSGKAVVDR

SEQ ID NO: 43542 - protein, 366 aa, Chlamydomonas reinhardtii
MATDKPVAFRDFVTADGRFKPEAGRYHLYVCLGCPFACRCLAVLYMKGLEHVIGVSVTHPTFQRTRPDDHEDTHCGWVFAKPTDPPLTATNGKGAFPCTGCVPDTVNGVRFVRDLYEMAGAKKVTFSVPVLWDKKEKTIVNNESPEIMRMLNSAFNALAKHPEVDLYPEALQSTIDDTAAWVGPHINMAVYRCGFAPDQAAYDAGFKDLFAGLDRAESVLGGRRYLTGDTLTEVDIKLFMTLIRFDEAYFVCYKTNKKLIRDYPNLCNYVRDLYHVPGIGRTVDLYHIKAAYFTCKPDMNPNVIIPGGGDAWWAQPHDRADKFGGKREGGGLAGWLQKLPVWAPHAAASAAAALVAGAALGSSRRR

SEQ ID NO: 43543 - protein, 388 aa, Gibberella moniliformis
MFKATTSARHRPGQGNSLSTLMARYNNQGLQRYSLKDKEHKIRRRKRSWGFQHSVILKNSWALPLLLTIVLPVIYAIHPVESKFFGHFILLSYRHGSVTDGMAFPVAQYKKGLWDLAFVAFYANALFLARKFIMKRLLRPLALKNNVSTMGKQQRFMEQMYTACYFAVMGPFGLYVMKTTPGLWIFQTHGMYDSYPHRSLGPAIKFYYLLQAAYWVQQSVVLVLRLEKPRKDHMELTVHHIITITLIALSYRFHFTHIGISMYITHDISDLFLATSKSLNYLSHRLQTPAFCLCVIAWIYLRHYTNWRILYSVLTEFRTVGPFELDWEAEQYKCQLSQFITFGLLATLQTLNIIWLYCLLRNAYRLLFLRIAKDDRSDTDKSEIEHGD

SEQ ID NO: 43544 - protein, 427 aa, Gibberella moniliformis
MSIVFSVVRSRIPSHYGHYNHSHHPHFEDLVVKPLTNILPLLTGFTLLAGVILLIHISIPQAEPYTSKFLFLSHRQPSTGLYSVGDGDVCFVLFEVLTLAGLREGCMKYLLAPFARVMGVSKERKVVRFSEQGWILMYYSVFWPLGMLIWAKSPHFSDMDQLWIHWPQRDIDGLIKFYILTQLAYWIQQVISVNIEARRKDYWLNVVHHFITITLILLCYVYHHTRVGSLILVMMDAIEILFPFAKCLRYLGFTTLCDLVFFLFFVTWIVSRHVLYLMTCWSVYSDVPRIIEPSCFMGSANDLHGPLPVPDDWWHLIEPWIYPKGKVCHSDSFRVSILAYLLLLQVLMMIWFGFICKVAIGVLDGRAAEDVRSDVESDEEDSEPVANGSGWQQSQLQPGRRVGSNGAAQMVDGVKKDLRCNIHCNEE

SEQ ID NO: 43545 - protein, 488 aa, Oryza sativa Japonica Group
MAVQAGTPATPISPQVISGAFVQQYYHILHETPDQVYKFYQDASIVGRPDSNGVMKYVSTTADINKIILSMDFSNYLTEIETADAQLSHQDGVLIVVTGSLTSEGICRRFTQSFFLAPQESGGYVVLNDIFRFIVERPPVAISQVSQENENNQNTATLPETDPNPAGDGMISEPVAVENNVAEGEVTNSTVDGTSIENNATAAVEPPVQMTKEEPRKISVAAPPPPAQKDVTKKSYASIVKVMKEVSLTPVVKPKPAPKHVVKTVEASEKPSVKSSQTVEITPNDNNDAENNTSNDEQGYSVFVKSLPHNVTVQTVEEEFKKFGAIKPGGIQVRNNKIDRFCFGFIEFESQQSMQAAIEASPIHMGGKEVFVEEKRTTTRVVNGVVITRGDNGNAGGGGRYQSGRGGYRGDNFRGRGGGYANSGNYRGGDNFSRRNDLRNRNEFSGRGRGPPPGNGYQNNGFHPARPFQNGNGRFTRVNGPRQTPVAA

SEQ ID NO: 43546 - protein, 950 aa, Glycine max
MSSIVKGIFIRSTADVCKNSMVLKKQSEIVGRRSTRVQWQLHLRSKSNTWKRGSRRSYQPPIRGQAILTPATPPTTKKRVFTFGKGRSEGNKAMKSLLGGKGANLAEMATIGLSVPPGLTISTEACQEYQQNGKKLPDGLWEEVLEGLQFVENEMGAILGNPLKPLLLSVRSGAAISMPGMMDTVLNLGLNDEVVAGLAAKSGERFAYDSYRRFLDMFGDVVMDIPHSLFEEKLEKLKHTKGVKLDTDLTTYDLKDLVEQYKNVYLEARGEKFPSDPKKQLELAVKAVFNSWDSPRAIKYRSINQITGLKGTAVNIQSMVFGNMGNTSGTGVLFTRNPSTGENKLYGEFLINAQGEDVVAGIRTPEDLEVMKSCMPDAYKELEGNCEILEKHYKDMMDIEFTVQENRLWMLQCRSGKRTGKGAFKIAVDMVNEGLVDIRSAIKMVEPQHLDQLLHPQFEDPSTYKDKVIAVGLPASPGAAVGQVVFTADDAEEWHAQGKSVILVRNETSPEDVGGMHAATGILTARGGMTSHAAVVARGWGKCCVSGCSDILVNDAEKVFVVGDKVIGEGEWISLNGSTGEVILGKQPLSPPALSDDLEIFMSWADEIRHLKVMANADTPEDAVTARQNGAQGIGLCRTEHMFFASDERIKAVRMMIMAVTPEQRKAALDLLLPYQRSDFEGIFRAMDGLPVTIRLLDPPLHEFLPEGDLEHIVRELTSDTGMKEEEIFSRIEKLSEVNPMLGFRGCRLGISYPELTEMQARAIFQAAVSVSNHGITVHPEIMVPLIGTPQELRHQVNLIRNVADKVLSEMGSSLSYKVGTMIEVPRAALVADEIAKEAEFFSFGTNDLTQMTFGYSRDDVGKFLPIYLSGGILQHDPFEVLDQKGVGQLIKICTEKGRAARPNLKVGICGEHGGEPSSVAFFAEIGLDYVSCSPFRVPIARLAAAQVAV

SEQ ID NO: 43547 - protein, 408 aa, Oryza sativa
  misc_feature (236)..(236): Xaa can be any naturally occurring amino acid
  misc_feature (253)..(253): Xaa can be any naturally occurring amino acid
MIREEYARLGSVFTVPILSRKITFLIGPEVSAHFFKGNEAEMSQQEVYKFNVPTFGPGVVFDVDYSVRQEQFRFFTEALRANKLRSYVDQMVVEAEEYFSKWGESGTVDLKYELEHLIILTASRCLLGREVREKLFDDVSSLFHDLDNGMQPVSVIFPYLPIPAHRRRDRARQRLKEIFATIIKSRKASGRAEEDMLQCFIDSKYKSGRSTTEGEITGLLIAALFAGQHTSSITSXWTGAYMLRFKQYFASSXKRSRRRCIKEALRLHPPLIMLLRQSHNDFSVTTKDGKEFDIPKGHIVATSPAFANRLPHIFKNPDSYDPDRYAPGREEDKAAGAFSYISFGGGRHGCLGEPFAYLQIKAIWTHLLRNFEFELVSPFPETNWKAMVVGIKDEVMVNFKRRKLVVDN

SEQ ID NO: 43548 - protein, 278 aa, Vibrio vulnificus CMCP6
MLVDRLFTRYQRQIALTEFGESGQANLLQAHVLIIGCGGLGNAAALYLAAAGVGHLVLVDDDVVEESNLQRQIAFRQQHLASPKVDALAEQLKQLNAELRVRTISHRLDEERLNLEVMLADIVLDCTDNFPSRQLINQACLNQRTPLVSASAIGWKGQFIAFDFSSYHSIQSQQDTSSAASSVNPPCYHCLFPFAENAMQTKCSDAGVIGPVVGLMGNYQAIATIQKLATGAFQTTCHQLHLFDGLKLSWQHLAVVKDPSCRVCQIQKQESSNEHHSN

SEQ ID NO: 43549 - protein, 235 aa, Bacillus clausii KSM-K16
MAQSKEQRVHDVFQSIYKKYDVMNSVISLQQHKSWRKDTMKQMDVQAGTSALDVCCGTGDWTLALSEAVGEQGSVIGLDFSENMLAVGREKVAAAKRTNISLVHGNAMALPYDDNTFDYVTIGFGLRNVPDYMQVLQEMCRVAKPGGKIVCLETSQPTIPVFKQLYFFYFKRIMPLAGKVFAKKYEEYSWLQESTLAFPGKDKLRDMFVEAGMKDVTVKSYTGGVCAMHMGIKPI

SEQ ID NO: 43550 - protein, 422 aa, Synechococcus elongatus PCC 6301
MSPETVLAAVDAAIASPFSTDAFDACVMQTYGRFPLALERGEGCRVWDTQGRSYLDFVAGIATCTLGHAHPELVDAISDQIRKLHHVSNLYYIPEQGQLAAWLTANSCADRVFFCNSGAEANEAAIKLARKHGNTVLEAENPIILTAQASFHGRTLAAVTATGQPKYHKGFQPLVQGFRYVPYNGLAAPEATLAELDAAGETVAAILLEPLQGEGGVNPGDRAYFQAVRQLCDQRRMLLILDEVQVGMGRSGQLWGYENLGIEPDAFTVAKGLGGGVPIGALLVKASCNILQAGEHASTFGGNPLACRAGLAIAQVMERDQLLANVQARGEQLRAGLQELVDRYPNLLAGVRGWGLINGLVLRNDPNVTPIALVKAAIEQGLLLVPAGAEVVRFVPPLIVSAAEIDEALAMTERALLAIAGE

SEQ ID NO: 43551 - protein, 163 aa, Triticum aestivum
  misc_feature (26)..(26): Xaa can be any naturally occurring amino acid
SGGDAGYAAEPPEEAKVYVGNLPYDXGFGFVTMSTIEEADKAIETFNRYDISGRLLNVNRAAQRGSRVERPPRQFASSFRAYVGNLPWQAEDSRLVQLFSEHGEVVNATVVYDRETGRSRGFGFVTMASKEDLDSAISALDGQEMDGRPLRVNVAAERPQRGF

SEQ ID NO: 43552 - protein, 395 aa, Physcomitrella patens subsp. patens
VNGLIVVEQAYNNILKVQFPLKCANGTVELIEGYRAQHSHHRLPVKGGIRMAPNVDAEETMALAALMTFKCAVVDVPFGGAKGGIKIDPTKYSANEKESIIRRYTSELVRKSFIGPSIDVPAPDYGTGPQEMAWIKDTYEHLKPNDINGAACVTGKPLEEGGIDGRQEATGLGVFFCLRDFLDDEALVDKLGLTTGIKGKTFIVQGFGNVGRHTIDYIYDAGGLITAIAEVDGGLVAECENGIDIPALKAYHKKMGTITSFPGAKTVSVKFAPGILELPCDVLIPAALETQIHSGNAGNVKAKIVAEAANGPVTPLAETILEGKGVVILPDLLLNAGGVTVSYFEWLKNLNHIHFGRMSRRMEEKGQRMLINALEAELGNGHKISHEVRSQVVKG

SEQ ID NO: 43553 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLSEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 43554 - protein, 181 aa, Capsicum annuum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 43555 - protein, 307 aa, Anabaena variabilis ATCC 29413
MSLTFVPPPIQKINSEIANNAGVEIDVLRLDLMHPWVNGNKWYKLKYNLLEAKEKGYTTLLTFGGAYSNHIFATAAAGNLLGFQTIGVIRGEETLPLNPTLSFATKQGMQLVYVDRETYRQRNSATLHADLRKRFGEVFIIPEGGSNLNGVRGCLEIISAATQAFNIVCVACGTATTLAGIALALEAKQRVIGFPVLKNGGFLAEEITQFMNNYVAAGLPISSSSPAHWELVCDYHFGGYAKVKDDLIVFSQQFTQTHGVPLDYVYTAKMFYGVMDLLKQRYFTKGDRILMIHTGGLQGNIGMSERL

SEQ ID NO: 43556 - protein, 147 aa, Bacillus clausii KSM-K16
MERTYVMVKPDGVQRNLIGNIVSRFEQKGYTLAAAKLVTLSKETAETHYSEHRERPFFGELVSFITSGPVFAMVWEGEGVIKAARQLIGATNPSEAAPGTIRGDLAVNVGMNVVHGSDSPESAEREIAIFFKEEELNDYQKDSNKWV

SEQ ID NO: 43557 - protein, 534 aa, Oryza sativa
  misc_feature (462)..(462): Xaa can be any naturally occurring amino acid
  misc_feature (492)..(492): Xaa can be any naturally occurring amino acid
  misc_feature (502)..(502): Xaa can be any naturally occurring amino acid
MQQQAYRAHDELPYMGMDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGLFYMPYAMGRMEFLWGKDAEAFRPERWLDEHGVFXQESPFKFTAFQAGPRICIGKDFAYRQMKIXFAPVLIRSFXVSNFGDKKDNVSYRTAITLAIDQDLHLTATAR

SEQ ID NO: 43558 - protein, 362 aa, Medicago truncatula
MASIPSEKQELEDEESFSYAVQLSNSIVLSMALQSAIELGVFEVLQKAGRDTPLSSDEIASRLSCTNPDAPKMLDRILALLASHSVLNCSVHPDQHNLGSFHRLYAMTSVAKFFAPNSDGVSLGPLIALHQDKIYLQSWSQLKDAIREGGIPFNRVYGTNDFEYASIDSRFNQVFNTAMINHTTIVMNKVLQSYKGFEDVKRLVDVGGGLGVNINLITSKHPHIHGINFDLPHVIQHAPSYPGVEHVGGDMFETVPKADAIFMKWILHDWSDEQCLKLLKNCYDAIPDDGKVIVLEAVLSIIPENNAAWKFAAQSDVLMMTQSPGGKERTEQEFMDLANGAGFSGIRYECYVHTFWVMEFFK

SEQ ID NO: 43559 - protein, 573 aa, Prochlorococcus marinus str. MIT 9303
MALIHGFHLRNVRGDLLGGLTAAVVALPLALAFGNAALGDGGAIYGLYGAVIVGFFAALFGGTPSQVSGPTGPMSVTVAGVVAALAAVGISTALPTVDGPGELLPLVMAAVVVGGLFQILFGVLRLGRYITLVPYSVVSGFMSGIGVIILILQIGPLFGISTKGGVIACLTQLSANFQPNWGAVAVAVMTLAIVFLAPRRLTEWVPSPLLALLIVTPLSVVLFNDANLAARGIDELPRIGTIPDGGLGFSLPSWDPAFLPLIIKSGLVLAVLGAIDSLLTSLVADNITQTRHNSDRELIGQGIGNSLAGLFNGLPGAGATMRTVINVKSGGSTPLSGMVHSIVLLIVLYGAGQFAALIPTALLAGILVKVGLDIIDWGFLLRAHRLSIKTAVVMYGVLLMTVFWDLISAVLVGVFVANLLTIDSLTQAQLEGMDADNRLMDGDFDNNSTSAYANTEEPSLPPSEQALLDRCGGQVMLFRLRGPLSFGAASGITERMALVRNYKVLILDITEVPRLGITATLAIEQMVQEAKNHSRKAYVVAANERVRKRLEKFDVQGLMANRTQALEAALADL

SEQ ID NO: 43560 - protein, 219 aa, Medicago truncatula
MSEHDQEVQEVQENVQEIHRPVPRLNERILSSLSRRSVAAHPWHDLEIGPGAPHIFNCVVEITKGSKVKYELDKKTGLIKVDRILYSSVVYPHNYGFIPRTLCEDNDPIDVLVLMQEPVLPGCFLRARAIGLMPMIDQGEKDDKIIAVCADDPEYKHFTDYKELAPHRIMEIRRFFEDYKKNENKEVAVNDFLPPSTAVEAIQYSMDLYAEYILHTLRR

SEQ ID NO: 43561 - protein, 383 aa, Vibrio vulnificus YJ016
MVYPKHKTASTRSKLNKVTIMGFKCGIVGLPNVGKSTLFNALTKAGIEAANFPFCTIEPNTGVVPVPDLRLDELAKIVNPQRILPTTMEFVDIAGLVAGASRGEGLGNKFLANIRETDAIGHVVRCFENENIVHVAGKVSPIEDIEVINLELAMADLDSCERAIQRQAKKAKGGDKDAKFELTVLEKLLPVLTEGGSARTVELSKEELAAVGYLNFLTLKPTMYIANVNEDGFENNPYLDAVREFAAKENNVVVPVCAAIESEMAELEDDERAEFLADMGIEEPGLNRVIRAGYELLSLHTYFTAGVKEVRAWTIPIGATAPKAAGKIHTDFEKGFIRAEVIAYDDFIQFKGENGAKDAGKWRLEGKEYIVKDGDVVHFRFNV

SEQ ID NO: 43562 - protein, 532 aa, Brucella melitensis 16M
MRRHSSAISKTRWVCWSDGTDAALVFVAYTKNSAAFPFSGIRAKIMADIYDVIVIGSGPGGYVTAIRAAQLGLKTAIVEREHLGGICLNWGCIPTKALLRSAEILHFGEHAKDYGLKLDGTITPDVKAVVQRSRGVSARLNGGVAFLMKKNKIDVIWGEAKLVKAASGSNPAEISVGKTSKQPMQPQNPVPKGVLGEGSYKAKHIIVATGARPRALPGIEPDGKLIWTYFEAMVPQALPKSMLVMGSGAIGIEFASFYHDMGVDVTVVEVMSQIMPVEDAETSAIARKQLEKRGLKIITDAKVAKVEKGANSVTAHVETKDGKTQTLTVDRMISAVGVQGNIENLGLEALGVKTDRGCIVIDGYGKTNVAGIYAIGDVAGPPMLAHKAEHEGVICVEKIAGLPNVHPLDMGKIPGCTYCNPQVASVGLTEAKAKEQGYDIRVGRYSFSANGKAIALGEDQGLVKTIFDRKTGQLLGAHMVGAEVTELIQGFVIAMNLETTEEELMHSVFPHPTLSETMKESVLDAYGRVLNA

SEQ ID NO: 43563 - protein, 576 aa, Xanthomonas axonopodis pv. citri str. 306
MSLRLRGHGAARGNALGRARVRQSHTLEVAEQRVPANQVETQLQRLHAAIASARVEMQQLRDRLHGALAREVGEFLELHALLLDDPELLQGLDELIRTHRYSADYALRVQRDRLAAVFDGMEDAYLKSRMDDLDHVIGRIHAFLHKRAPDLKGVAGEILVCDNVAPSELAQLQAQGVVGIVTTAGSTLSHSAILARSLHLPLVVGVSDALQRIEDGDVLIVDAGSGQVIVDPKPEHLRDYRERLRALAKEQRELGRLRSKPTRTRDNVDITLLANAESLEDVANAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILQLRKQLKKLTAQLREEGHEIAEHIPLGAMIEVPAAALALDCFIDDIDFLSIGTNDLVQYLLAVDRNNEALGELYSPLHPAVLRLIAQVIATGRTYGKPVAVCGEIAGDPRFVPMLLALGLTEFSLHPATLLEVRRAVRDTHLGDLRVHGEKLLRARDRKGIEKWLTGHAQGLLR

SEQ ID NO: 43564 - protein, 704 aa, Oryza sativa Indica Group
MMGTAHHNQTAGSALGVGVGDANDAVPGAGGGGYSDPDGGPTSGVQPPPQVCWERFIQKKTIKVLLVDSDDSTRQVVSALLRHCMYEVIPAENGQQAWTYLEDMQNSIDLVLTEVVMPGVSGISLLSRIMNHNICKNIPVIMMSSNDAMGTVFKCLSKGAVDFLVKPIRKNELKNLWQHVWRRCHSSSGSGSESGIQTQKCAKSKSGDESNNNNGSNDDDDDDGVIMGLNARDGSDNGSGTQAQSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARAANAPNCSSKVPEGKDKNRDNIMPSLELSLKRSRSTGDDANAIQEEQRNVLRRSDLSAFTRYHTPVASNQGGTGFVGSCSPHDNISEAMKTDSAYNMKSNSDAAPIKQGSNGSSNNNDMGSTTKNVVTKPSTNKERVMSPSAVKANGHTSAFHPAQHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVDAERPNMEIANGTINKSGPGGGNGSGSGSGNDMYLKRFTQREHRVAAVIKFRQKRKERNFGKKVRY

SEQ ID NO: 43565 - protein, 346 aa, Solibacter usitatus Ellin6076
MSRFLAMFLVVTCLAATTRDLVIFDTDSGLFGDDGAALVMLLRGSSQEVLQGITIVPGNVWAAQGAEYMFHILDLLKKPQMQVAVGAEAPLIHTAAMSKEFDRRWGGLGYTGAFAQDPTAVVPAPGSKISTRKLRRDAINFLISEIERHPGEITILALGPMTNIALALRLKPDIETKIKRIVFMGGNIRVAGNATPAAEFNFWFDPEAARIVLRSRIPKKMMFGLDICNLAKIRKAEFDQIASARNPIAELFREDLGNRYPGFLKKPDAIGFMWDSLAAAYLLDPDFVTKTESRYLDVQTTWGQFYGSTTPLDRRATPTATPVTVMLDLDFKRVFALYKDRLVRSE

SEQ ID NO: 43566 - protein, 201 aa, Zea mays
  misc_feature (114)..(114): Xaa can be any naturally occurring amino acid
MQIKIGMDVAASEFLTKDGNYDLNFKNQPNDGAHILSAQHLGDLYRDFVKDFPIVSIEDPFDQDDWSSWASLQSSVDIQIVGDDLLVTNPKRIADAIDKKACNALLLKLVYLFXVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 43567 - protein, 293 aa, Brassica napus
  misc_feature (207)..(207): Xaa can be any naturally occurring amino acid
  misc_feature (210)..(210): Xaa can be any naturally occurring amino acid
  misc_feature (252)..(252): Xaa can be any naturally occurring amino acid
  misc_feature (258)..(258): Xaa can be any naturally occurring amino acid
  misc_feature (285)..(285): Xaa can be any naturally occurring amino acid
MSLVVVSGYNTGRLLRLPTLSIFPKFSPLSALMNSSNLSSSSKPAFSSFSQSSRSGGRGRGNERDNDRRRPQGRGGGGGGRGGGGGDRIDALGRLLTRILRHMASELRLNMRGDGFVKAGDLLSLNLKTSANVQLKSHTIDEIREAVRRDNKQRFSLVEENGELLIRANQGHSITTVESEKLLKPILSPEEAPVCVHGTYRKNLESXLAXGLKRMNRLHVHFSCGLPTDGEVISGMRRDVNLLIFLDIKKAXEDGIAXYISDNKVILTEGVDGVVPVDYFQKIEXWPSRQPIP

SEQ ID NO: 43568 - protein, 725 aa, Glycine max
  misc_feature (234)..(234): Xaa can be any naturally occurring amino acid
MAPNPRVVAAFTAMANLGIHESKVKPVLKKLLKLYDKNWALIEEESYRALADAIFEEEENKVNEPDQNNKNKNGVVDDEEAHTHGEPVRPLKRLRLRGQEGQSLRPLTSSGPSSAAFPLKAPKLEDGAVPESSSRRQPQSMAALSDGNARIGARHVPPQDAVVDKGKKPISPQLTPRARRSLAEPTVEAGAALLANNKMPHPFILIKPKDEPVDGIPDYEIPLAVIPPEPSSEXDSLMGAAGKKDCHDTVVSQCRDENVEHEYVFPSSNEEATSNVDVALSSMGEEQSVKITQTDDVSKESETNDSPIVRGNKDSVIANGSISVESSAMAELQVPSSIPCSSDLDNAVPAPKKVGMNGFLQSDSGKELEHPIIPNSRTLVVVPKHQLTNDDVRAVHDVNDLTKGEERVKISWVNNTTNDFPPPCHYIPRNLVFREAYVNISLSRIGNEDCCSTCMGNCVLSSKSCSCTNKTGGEFAYTAKGLLKEEFLDECIALNRDPQNYFYCKACPLERSKNDDCLEPCKGHLKRKFIKECWSKCGCGKHCGNRVVQRGITCKLQVFLTSDRKGWGLRTLEDLQKGAFVCEFVGEILTIKELHERRLKYPKNGKYTYPILLDADWGSGIVKDREALCLYAASYGNAARFINHRCLDANLIEIPVEVEGPTHHYYHFAFFTSRKIAAQEELTWDYGINFDDHDDHPVELFQCRCGSKFCRNIKRSNRSMRSSSS

SEQ ID NO: 43569 - protein, 569 aa, Synechococcus elongatus PCC 6301
MLRLDRISKIYPTGEVLRDVSWEVKPGDRIGLVGVNGAGKSTQMRIIAGLEEATSGEIIRPSSLKIAYLQQEFDIDPERTVREELWQAFGEATTVFNQLSEVEHQMQTAEPEQLDDLIHQLDRLQRRFEALDGYAIDARIAKLLPDLGFGLEDGDRSVAAFSGGWQMRMGLGKILLQEPDLLLLDEPTNHLDLETIEWLETYLKGLSQPMVIISHDREFLDRLCTQIVETERGVARTYLGNYSDYLTQKELEKTAQFAAFERQQKELAEQQAFIDRFRASATRSTQAKSREKQLEKVERIEAPEDNLRGIQFRFPPAPRSGREVVMIEDLTHAYNDKILFLGAELLIERGDRIAFLGPNGAGKSTLLRLILGREPLLEGKVELGAHQVIPSYFEQNQAEALDLEKTVLDTIHDEVPSWKDSEVRTLLGSFCFRSDTVFKKVGALSGGEKARLALAKMLLQPANLLILDEPTNHLDIPAKEMLEEALREYEGTALIVSHDRYFVSRVANKIVEIRDGEFRVYAGDYHYYLEQIQLKKERERLAAIEAEKASKAAAKRAKQKAKQQERRQS

SEQ ID NO: 43570 - protein, 519 aa, Coprinopsis cinerea okayama7#130
MPGPRFALLRSIGSRGISTTARLQALSAAARPKAEQISAEWKGTSATGANTKNFIGGQFVESKSTEWIEVQDPSTQTVLTRVPQTTETEFEQAVDAASQAFKTWSRTSLLTRQKFVLELQHLLRKNADAIAANAHGDLLRGLQVVETAAGITSNLLGDKLEVTKDMDTYVRRVPLGVCASVAPFNFPAMIPLWTIPLAAVTGNTLVLKPSERDPGAAMMIAELCQQAGLPDGVLNVVHGGVPTVNAICDHPAIKAISFVGGDKAGKHIYDRGTQNGKRVQANLGAKNHAILMPDANKNLALNSIVGAAFGAAGQRCMAVSVAILVGDSQAWLPELVERAKKLKVSGGFEPGADLGPVISPAAKERILGLISSAEADGGEILLDGRNISVPDYPDGNFVGPTIIKGGVGMKCYDQEIFGPVLIVLQAETLDDALDIINNNRYGNGAAIFTQSGATARKFETEVNVGQLGVNVPIPVPLPMFSWSGNKASVLGDIGFYGKSLWKAEDALGNRASVNMPTHH

SEQ ID NO: 43571 - protein, 388 aa, Oryza sativa Japonica Group
AFKEIKVPPPLSPPSSPPMSSGPPQRSKRWLYAIVISSIALLFIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 43572 - protein, 882 aa, Rickettsia conorii str. Malish 7
MIYDMKKLIYYFGSNGSDGNASMKNILGNKGAGLAEMSNLKLPIPDGFTITTELCNYFYTHNNNFPKNFQSDLKKAITELEIITGKIFGSTSNPLLLSVRSGSKVSMPGMMDTILNLGMNNEVCNALADSCGDKRFALDSYKRFLEMYGSTVLSIPSDLFEQICEKHKMQADIHKDSDITVELLEKIIDDFKRLHIKYTKQLINDPYEQLESAIKAVLHSWMSNRAVIYRKINNISEDCGTAINIQAMVFGNLGKTSATGVAFTRSPSTGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGIVTIRGGMTSHAAVVARGMGKPCVCGTSNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEKLEQRYRYKFSFTLGTMIELPRAALGSKKIAKEVDYFSFGTNDLTQTTYGISRDDIASFLPYYLEEKIFESDPFTTLDEEGVGELIDIAIKRGKSSNANLKLGACGEHAGNPASIEFFHRMNLNYVSCSPYRIPIARIAAAQAKIKHG

SEQ ID NO: 43573 - protein, 335 aa, Vitis vinifera
METQIHHLEQEAYSSVLRAFKAQSDAITWDKEGLITELRKELRVSDDEHRELLARVNADNIIQRIREWRQAGGHQTAMLSMSQHAHDQIPSPTVSASRKKQKLSQSGQPFPGLSSVKSMQYHSSITAGRGQFRTSSGTLTTNEPAEPGTYDPLIGRKVMTLWPEDNNFYEAVITDYNPLEGLHALVYDINTTNETWEWRQISPEDIQWEGEDPGISRQGGRGGQGRGVKRSTSRGVALPSAGRGRGSTKVQSNREFPPSQNGIGKKVSDSDDIEIFHTDTLIKEVERVFGASHPDPVELEKAKKMLKEHEQALVDAISRLGDASDGESGNKYLCI

SEQ ID NO: 43574 - protein, 423 aa, Arabidopsis thaliana
MENKSHSNHHRYHHLSSRSHEQNQRGLISINAIIIIGISIISIFIILAILLIIILLHRLKSARVKAQELSCKESFNNMNNGGASTNYSYTSSPAEGVEVYTYKELEIATNNFSEEKKIGNGDVYKGVLSDGTVAAIKKLHMFNDNASNQKHEERSFRLEVDLLSRLQCPYLVELLGYCADQNHRILIYEFMPNGTVEHHLHDHNFKNLKDRPQPLDWGARLRIALDCARALEFLHENTISTVIHRNFKCTNILLDQNNRAKVSDFGLAKTGSDKLNGEISTRVIGTTGYLAPEYASTGKLTTKSDVYSYGIVLLQLLTGRTPIDSRRPRGQDVLVSWALPRLTNREKISEMVDPTMKGQYSQKDLIQVAAIAAVCVQPEASYRPLMTDVVHSLIPLVKAFNKSTDSSRFPSRRESLSFDDIMP

SEQ ID NO: 43575 - protein, 245 aa, Aspergillus oryzae
MNVIEWAFGKRMTPAERLRKHQRALDRTQRELDRERTKLENQEKKLVQDIKKSAKNGQIGACKIQAKDLVRTRRYTCHATSLYMSGYELMDIAGSRYIQKFYQMRTQLQAISLRIQTVRSNEQMMQSMKGATMLLGSMNRQMNLPALQRIAMEFERENDIMDQRQEMMDDAIDEATGMEGEDEDSEDIVKEVLDEIGVDLSQALGETPTDIQKTAVGETRVAQPVGAGGSSADDDLQARLDSLRR

SEQ ID NO: 43576 - protein, 246 aa, Zea mays
MVSRKAFQVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYILDVVDLVLIMSVNPGFGGQSFIESQVRKIAELRRLCAEKGVNPWIEVDGGVGPKNAYKVIEAGANAIVAGSAVFGAPDYAEAIKGIKTSQRPAAVHA

SEQ ID NO: 43577 - protein, 193 aa, Listeria monocytogenes str. 1/2a F6854
MSIITEVYAREVLDSRGNPTVEVEVYTEAGAFGRALVPSGASTGEYEAVELRDGDKARYLGKGVLKAVENVNDIIADKIIGFDVTDQIGIDKAMIELDGTPNKGKLGANAILGVSLAAARAAADELGVHLYEYLGGVNGKVLPVPMMNILNGGEHADNNVDVQEFMVMPVGAPNFKEALRMGAEILHALKAVL

SEQ ID NO: 43578 - protein, 510 aa, Listeria monocytogenes str. 1/2a F6854
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSVDAEVAFKPIEMKNVIGEVLSNEGLAQLRIAETEKYPHVTFFMNGGRNEEFPGESRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 43579 - protein, 360 aa, Triticum aestivum
MALEARLRLPLAGPTPATAFLSGSNPKPSHISFSLKPTSTSLSAANAPPIVVVGSANADIYVEVDRLPLVGETVAASAGHSLAGGKGANQAACGGRLALGPTYLVARVGDDANGRLLEGALADAGGVRLDRVARAPGAPSGHAVVMLMPDGQNSIIIVGGANMESWAPEVDPEDLDLIRQAGVLLLQREIPDWVNIQVAQAAKGAGVPVILDAGGMDAPVPRELLELVDIFSPNETELARLTGMPTETFEQISQAAGACHKMGVKEVLVKLGSQGSALFVEGEEPIRQAIIPATQVVDTTGAGDTFTSAFAVALVEGKPKKECMRFAAAAASLCVRVKGAIPSMPDRETVMSLLESVQAE

SEQ ID NO: 43580 - protein, 251 aa, Listeria monocytogenes str. 1/2a F6854
MRKPIIAGNWKMNKTAAKAGQFAEDVKNNVPSSDAVESVVAAPALFLQELVRLTEGTNLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 43581 - protein, 723 aa, Vibrio vulnificus CMCP6
MIYQAETLQVKEVQDGVAEILFCAPNSVNKLDLATLASLDKALDALTAHSGLKGVMLTSDKEAFIVGADITEFLGLFAKPEEELDQWLQFANSIFNKLEDLPVPTVAVVKGHTLGGGCECVLATDLRIGDKTTSIGLPETKLGIMPGFGGCVRLPRVIGADSAMEIITQGKACRAEEALKIGLLDAVVDSDRLYASALQTLTDAINEKIDWKARRQQKTSALTLSKLEAMMSFTMAKGLVAQVAGPHYPAPMTAVVTIEEGARFARNQALDIERKHFVKLAKSEEAKALVGLFLNDQYIKGIAKKAAKSANKETQRAAVLGAGIMGGGIAYQSALKGVPVIMKDIAQASLDLGMTEASKLLNKQLERGKIDGFKMAGILASITPSLHYAGIDNADIIVEAVVENPKVKAAVLSEVEEQVSEETVLTSNTSTIPINLLAKSLKRPENFCGMHFFNPVHRMPLVEIIRGEHTSDETINRVVAYAAKMGKSPIVVNDCPGFFVNRVLFPYFGGFSMLLRDGADFTQIDKVMERKFGWPMGPAYLLDVVGIDTAHHAQAVMAQGFPERMGKQGRDAIDALFEANKYGQKNGSGFYTYTMDKKGKPKKAFSDEIVPILAPVCAAQQAFDDQTIIQRMMIPMINEVVLCLQEGIIASAQEADMALVYGLGFPPFRGGVFRYLDSVGIANFVAMAQQHVELGAMYQVPQMLIDMAEKGQTFYGAQQQGSI

SEQ ID NO: 43582 - protein, 396 aa, Listeria monocytogenes str. 1/2a F6854
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEAAIAELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGDKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 43583 - protein, 379 aa, Oryza australiensis
MATAGKVIKCKAAVAWEAGKPLVIEEVEVAPPQAMEVRVKILFTSLCHTDVYFWEAKGQTPMFPRIFGHEAGGIVESVGEGVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 43584 - protein, 336 aa, Listeria monocytogenes str. 1/2a F6854
MTVKVGINGFGRIGRLAFRRIQNVEGIEVVAINDLTDAKMLAHLLKYDTTQGRFDGEVEVHDGFFKVNGKEVKVLANRNPEELPWGDLGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPTLKGKLDGAAQRVPVPTGSLTELVTVLDKKVTVDEVNAAMETASDSETFGYTSDQVVSSDIKGMTFGSLFDETQTKVLTVGDQQLVKTVAWYDNEMSYTAQLVRTLEYFAKIAK

SEQ ID NO: 43585 - protein, 503 aa, Zea mays
MDATPPSSRDLSPQPRRPASSAGPAKRVGLLLGRYELGRLLGHGTFAKVYHARQADTGETVAIKVLDKEKALRNGLVPHIKREIAILRRVRHPNIVRLFEVMATKSKIYFVMEFVRGGELFARVAKGRLKEDTARRYFQQLISAVGFCHARGVFHRDLKPENLLVDERGDLKVSDFGLSAVADQFHPDGLLHTFCGTPSYVAPEVLARRGYDGAKADIWSCGVILFVLMAGYLPFHDQNLMAMYRKIYRGEFRCPRWFSKDLSSLLIRLLDTNPETRITVAQIMESRWFKKGFRPVRFYVEDDQVHSLADGEDEVPELGPSEPPTPPPPPPPQKEDDGDDSGWESDSSVASCPATLSSEERRRPAGSLPRPVSLNAFDIISFSRGFNLSGLFEERGNEVRFVSAHPMQTIITKLEEIAKVKSFAVRRKDWRVSLEGTRESEKGPLTIGAEVFELTPSLVVVEVRMKAGDRQEYEDFCERELKPGMQHLVHHTASVPDIPSDTD

SEQ ID NO: 43586 - protein, 419 aa, Arabidopsis thaliana
MDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADAQHITVLRVVIREDFSRTLAERLVADISKVLHELDTLPSKISKKMGIEGIAKNVKEKKMEKEILMEVIVGWRKFVKERKKMNGVC

SEQ ID NO: 43587 - protein, 581 aa, Ustilago maydis 521
MLAKHTFRQIASSALGRAGRNGVATARSYRAASHSFFQEQQSVLPNNLDPSSDEFLANKAYMDGLVETLDAAHARLALGGSEKARARHVARGKMLPRERVAALLDHGSPFVELSRMAAYEMYGDDEIPGAGVISGIGRVSGTECMIVANDPTVKGGSYYPISVKKHLRAQTIARENRLPCVYLNESGGAALPHQADVFPDENHFGRIFYNMAQMSALGIPQISVVHGISVAGGAYVPAMADETIIVRNQGTIFLAGPPLVKAALGEVVDDETLGGGEMHCSESGVTDHLAVNDAHAITLAREAVAHLGLCGRSNDALGDASFDQPLYNASELHGIIPENARKPFDIRDIISRLVDGSRFHEFKKLYGNTIVTGFAKIAGQDVGIIGNNGVLFGESAKKATSFIHLCNQRQTPLVFLVNVTGYMVGTKAERSGIAKDGAKMVRAVACANVPKFTVIVGGSFGAGNYGMCGRAYSPRFLWMWPNARVGVMGGEQLSQVMGTVSSDKSKQQGLRDRIEKQTLPEYASARLWDDGIIRPQDTRSVLALGLSVANTGRWRSAQRGDAGGSRHPAWDGNNYGDGVYR

SEQ ID NO: 43588 - protein, 462 aa, Xanthomonas axonopodis pv. citri str. 306
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQIVVVIAAEAVGAAGLLATVWPALPVPLLSLLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLEVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILAVIFVLLASSADTRAQFLSMVALTAVIAAVSEIARRVRARM

SEQ ID NO: 43589 - protein, 71 aa, Oryza sativa
QDCWTAGKGCTATLGNFAKATYAAMAQTYSYLTPDLWKETVFTKTPYQEYSAHLANASKKYTVGLGDKNYQ

SEQ ID NO: 43590 - protein, 460 aa, Xanthomonas axonopodis pv. citri str. 306
MIDTPRRDDAATLERFGYAQELKRQLTLKDLLIYGLVCMVPTAPFSIFGGVFDISAGMVPLTYLVGFVAMLFTALSYQQMSQAFPVAGSVYAYVGRGLSSGMGFLAGWAILLDYLLVPTLLYVVGANAMHTVLPAVPQPAWIAFFVVLNTVVNLRGIETTARANRFFLLAQLLVLAVFVVLATLAIQRGVNGAHWSWRPLYNPQAFSPQLIFSALSVAVVSFLGFDAISTMSEEARGGNRVVGRATLLALLIVAGLFVLQTWLAALLQPTLQRYPSAQASNDAFFEIGRLIAGPWLQIVIALTVAISAAIANSLVAQAATSRLLFAMARDRQLPGFLRYIHPRTGVPQRAILLVAGLSLVLGEVFVGQIALLSSLCNVGALTAFVLLHIAVLWHFRTQGRHVLHGAVPLIGIVILAYVLLNADLHAQLGGAAWMAVGLAVLAFLKLSGRSTEFRASDALE

SEQ ID NO: 43591 - protein, 186 aa, Brassica rapa subsp. pekinensis
YIGLKQRRATGQEYAEFLHEFMCAVKQNYGEKVLVQFEDFANHNAFDLLSRYMDSHLVFNDDIQGTASVVLAGLIAAQKVLGKSLADHTFLFLGAGEAGTGIAELIALKISKETGAPIEETRKKIWLVDSKGLIVSSRKESLQHFKQPWAHEYEPVKDLIGAVNAIKPTVLIGTSGVGQTFTKEVV

SEQ ID NO: 43592 - protein, 158 aa, Oryza sativa Japonica Group
MVVGLINANPVVYEKKERRSRQAPETTDENAAEAIDQLEIFDHIRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 43593 - protein, 68 aa, Oryza sativa Japonica Group
MTTSRRLADRKSAKFQKNITKRGSVPETTVKKGNDYPVGPMVLGFFIFVVIGSSLFQIIRTATSGGMA

SEQ ID NO: 43594 - protein, 198 aa, Photorhabdus luminescens subsp. laumondii TTO1
MNNISIRNSTFIPLKSINNESEFISFNGFTQDKEHLAIRIGKWSEKHIPLVRIHSECVTGEIFHSLLCDCGEQLNESLKEIDIHGGVLIYLRQEGRGIGLYNKIDAYKLQRNGLDTYQANQALGFLDDYRDFSLAAKMLLAMNISKIRLITNNPDKIHQITQNGIEIYEVINTKTFLNEKNKNYLTAKKIKTFHALEL

SEQ ID NO: 43595 - protein, 472 aa, Vitis vinifera
MGKIPPSFRTSTVPVTTLLKNPPAVLPKQSTVLETPQKPHHFPKKRPQPSGKTKKTRTPIEDPKSPVIFNSPNLLDAKKLFASITTTSTTPLDLRFHNALLQSYSSISTVNDSISFLRHMIKSQPSFSPERSTYHILLSQSCKSPNSDLSAVHQTLNLMVTHGFPPDRVTTDIAVRSLCSAGREEHAIELVKELSLKHSPPDSFTYNFIIRHLCKTRALSTVYNFIDELQNSFQLKPDLVTYTILIDNVCNGKNLREATRLLEVLGEAGFKPDCYVYNTIMKGYCILDKGSEAIGVYKKMKEEGVEPDLVTYNTLIFGLSKSGRVKEARKFLDIMAEMGHFPDAVTYTSLMNGLCREGNALGALALLEEMEAKGCSPNSCTYNTLLHGLCKLRMLERGIELYGVMKSGGMKLEKASYATFVRALCKEGRVAEAYEAFDYVVESKSFDDVTAYSTLENSLKWLRKAREQGLAS

SEQ ID NO: 43596 - protein, 162 aa, Oryza sativa Japonica Group
MAPVAVGDTLPDGQLGWFDGEDKLQQVSVHGLAAGKKVVLFGVPGAFTPTCSNQHVPGFINQAEQLKAKGVDDILLVSVNDPFVMKAWAKSYPENKHVKFLADGLGTYTKALGLELDLSEKGLGIRSRRFALLADNLKVTVANIEEGGQFTISGAEEILKAL

SEQ ID NO: 43597 - protein, 343 aa, Vibrio angustum S14
MKIKALSKLKPEEGIWMTEVDKPEVGHNDLLIRIKKTAICGTDVHIYNWDEWSQKTIPVPMVVGHEYVGEVVGMGQEVRGFAIGDRVSGEGHITCGHCRNCRGGRTHLCRNTIGVGVNREGAFAEYLVIPAFNAFKIPDDISDDVASIFDPFGNAVHTALSFDLVGEDVLITGAGPIGIMAAAVAKHVGARHVVITDVNEYRLDLAREMGVTRAVNVAKESLTDVMAELGMKEGFDVGMEMSGNPAAFNSMLSSMNHGGKIALLGIPPSDMAIDWNQVIFKGLIIKGIYGREMFETWYKMATLIQSGLDLSPIITHHYKIDDFQQGFDVMRSGQSGKVILDWE

SEQ ID NO: 43598 - protein, 448 aa, Zea mays
  misc_feature (35)..(35): Xaa can be any naturally occurring amino acid
  misc_feature (59)..(59): Xaa can be any naturally occurring amino acid
MAAPPATAPAASRCLSGAKSCWAAERSSQLVWPSXAPSTDLRQSRSRILSVRAKVATGXVQRASTVDDGAKRPWKLSDARLVLEDGSVWRAKSFGASGTQVGEVVFNTSLTGYQEILTDPSYAGQFVLMTNPHIGNTGVNPDDEESNQCFLGGLIIRNLSICTSNWRCKETLEEYLTKRNIMGIYDVDTRAITRRLREDGSLIGVLSTDQSQTDNELLEMAKKWKIVGVDLISGVTCDAPYEWLDKTDSEWEFKRDQSSETFHVVAYDFGIKHNILRRLASYGCKITVVPANWPASEVLNLKPNGVLFSNGPGDPAAVPYAVKTVQEIIGKVPVFGICMGHQLIGQALGGKTFKMKFGHHGGNHPVCDLRSGRVDISAQNHNYAVDPESLPEGAEVTHVNLNDNSCAGLQYAKMKLVSLQYHPESSPGPHDSDTAFGEFIELMKSNRL

SEQ ID NO: 43599 - protein, 403 aa, Oryza sativa
MVKVTCQANDQALVGFGYTQDNGKYSVSITGLPLSSTYGADSCKVELHSAPGGSDCNVPIELNLSGLSVYSKSNEEVVLQANQPSATTAACWHIIDNTICELLSIPATSKSAVISISDEAPEVIQCSADTPARSSAGITFFRRRISSTDLAVSKQHDPPTNEKENLYIADSYDFFPNAAAELVTSSNGLQGHTGEDEDDNEEATGGHGRGVLPEVAVEASPEAAATAAGPAVAPPQKIRIVFGPRSAASPILLDSRPWGGFTDYSDSVPDSKYTRDRGYHPLEEVKERPKKKDLSLTDVETARTVVEANSKGLLVFPARVHNEPHGHVAWSDFQYIVDDYGDIFFQVPDSENILEDDAANNPVTVLIGMDGPIIGETSVVTSDFSDYMDVENFIDMPDENDSK

SEQ ID NO: 43600 - protein, 459 aa, Solibacter usitatus Ellin6076
MQAPKSSLMATTVPSLDRLYSDHVNPQWVRLLDLLQMNVQYERCSGSELFTTEGRRILDFLSGYCVHNAGHNHPAIVAALKDELDRSGPAMLQSHVPQLAAELAQRLLQRAGGNLQRVYFTNSGSEGVETAIKFARAHTGRTGLLYAAGGFHGLTCGALSLMSDPFWSDGFGPMLPGTQSVHFGDIAALESHLATRKFAAYILEPVQSEGGIQVPDASYLHAAQELCRRYGTLLVLDEVQTGMYRTGSFLAAHRFQVEPDMVILAKALSGGLIPVGAVLMTEAVSNSVFSSLKRAFVHASTFGENALAMRAGLATLDVLEHDDLGERSAATGARLRLHLAEALAPYEMVGAIRGLGMLNGIQFTAPRQLRLRVAFEGFQRIHPAMFGQVVVMRLFRDKGILTQICGNNFMVLKVAPPLVATDVQLEEFVDCVRDVVHLIHNSGAFWTDALGLARRAVGI

SEQ ID NO: 43601 - protein, 186 aa, Zea mays
RDGGRCSIEGYAAGSCIPSPQKNVERDFLKKYWSRWKADHVGRCRAMPHIKTFTRYSGQNIAWFLLTSANLSKAAWGALQKNNTQLMIRSYELGVLFLPQTLQSVPQFSCTEKSRSIRDGVALGKTIKTKLVTLCWKGDEEDPSIVRLPVPYQLPPQPYGTQDVPWSWDRRYTKKDVYGSVWPRYG

SEQ ID NO: 43602 - protein, 149 aa, Volvox carteri f. nagariensis
KNPVEGFSAGLVDDSNVFEWQVTIIGPPDTLYEGGFFNAKLSFPKDYPNSPPTCRFTSEMWHPNVYDDGKVCISILHNPGDDPHGYESAAERWSPVHTVETIMISIISMLSSPNDESPANVDAAKMWRENREEFKKRVARIVRKSQEML

SEQ ID NO: 43603 - protein, 142 aa, Triticum aestivum
  misc_feature (83)..(83): Xaa can be any naturally occurring amino acid
  misc_feature (113)..(113): Xaa can be any naturally occurring amino acid
MACPIKHPTLLIPGPIEYDEAVLQSMSHYSESHISSSFIETFSETLSMLRKLFQTEDPSSQPFVISGSGTLGWDLVAANLTKXGDDVLVLHSGYFADSFANWFWRYMGFRATXLKGPIGSMSWIKKSEERPKEEKDQNGWTG

SEQ ID NO: 43604 - protein, 338 aa, Nostoc punctiforme PCC 73102
MNSNRGSAVLSSATFKVQASSTGMTDNHRLRLFSGSANLQLSQEVARYVGMDLGPMIRKRFADGELYVQIQESIRGCDVYLIQPCCQPVNDHLMELLIMVDACRRASARQVTAVIPYYGYARADRKTAGRESITAKLVANLITEAGANRVLAMDLHSAQIQGYFDIPFDHVYGSPVLLDYLASKELPDLVVVSPDVGGVARARAFAKKLNDAPLAIIDKRRQAHNVAEVLNIIGDVKGKTAVLVDDMIDTGGTIAEGARLLREEGARQVYACATHAVFSPPAMERLSSGLFEEVIVTNTIPIPENNRFPQLVVLSVANLLGETIWRIHEDTSVSSMFR

SEQ ID NO: 43605 - protein, 362 aa, Saccharum hybrid cultivar
MGSTAEDVAAVADEEACMYAMQLASASILPMTLKNALELGLLEVLQAEAPAGKALAPEEVVARLPVAPTNPDAADMVDRMLRLLASYDVVKCQMEDKDGKYERRYSAAPVGKWLTPNEDGVSMAALTLMNQDKVLMESWYYLKDAVLDGGIPFNKAYGMTAFEYHGTDPRFNRVFNEGMKNHSVIITKKLLEFYTGFEGVSTLVDVGGGIGATLHAITSHHPQIKGINFDLPHVISEAPPFPGVQHVGGDMFKSVPAGDAILMKWILHDWSDAHCATLLKNCYDALPENGKVIVVECVLPVNTEAVPKAQGVFHVDMIMLAHNPGGRERYEREFHDLAKGAGFSGFKATYIYANAWAIEFIK

SEQ ID NO: 43606 - protein, 199 aa, Magnaporthe grisea 70-15
MDFGGAQSGGAGGRTCYTCGQPNHQARDCPNRGAAKCYNCGGEGHISRACPEEPKDQKICYRCSQPGHISRDCPSGGAGGGGGGGGGQSSGAECYKCGEVGHIARNCSKGGYGGGGGGGYSGGGGGYGGGYGGGAGGKTCYSCGGVGHMSRDCVNGSKCYNCGETGHFSRDCSKRSTTGEKMCYKCQQPGHVQAECPNN

SEQ ID NO: 43607 - protein, 277 aa, Trichodesmium erythraeum IMS101
MDKNDIIRLLIGKFSILRLILSILIIYILIGLWAFFFSDRLIFLPRPSSYQKNQDFVKLQSRDRTQITGIYLPLPKAEYTILYSHGNAEDLGEILPRLRDLRDIGFSIFSYDYQGYGTSQGKPSVDGAYQDINAAYEYLTKKLGIPANKIIVYGRSVGGGPSIDLASRQPVAGLVIESSFTTAFRVVTRIPIYPFDRFPNIDKIKSINCPVLVMHGNADQVIPFSHGQQLFAIANQPKLSLWVDGAGHLNLLEIAGQKYVKVMGEFIRLVQNNNQNY

SEQ ID NO: 43608 - protein, 201 aa, Listeria monocytogenes str. 1/2a F6854
MILLIDNYDSFTFNLEQYLAEFSEVVVKRNDAADLIKIAALADGIVLSPGPGKPSDAGLLEEVVAKFAKEKPLLGICLGHQAIGEVFGGEVKRAAKIRHGKVSTMRQTAGAIFANLPEEMPVMRYHSLIVDKNTLPDVLEVLAIATDDSEVMAMKVKDYPVYGLQFHPESIGTNDGKQMMENFIQIVEGARENGNLTTKSI

SEQ ID NO: 43609 - protein, 389 aa, Gluconobacter oxydans 621H
MSNPCPPGANAALVLADGTVLWGRGFGAHTEGAVGELCFSTGMTGYQETLTDPSFAGQIVTFTFPHIGNVGTNADDNEAPKMAALGAVVKEDITAPASWRSHEPFAAWLRDHGRAGISGIDTRAITRTLRDNGPQTAILAFPENGRIDTDSLLNRARQWPGLEGMDLAKEVTRPKRVWTEGVWHSTKPVRENRRRVVAMDYGAKDNILRCLVTAGCDVTVLPATATAEEILELRPEGVFLSNGPGDPAATGTYAVPAIRKVLDANVPVFGICLGHQLLAQALGGKTYKLERGHRGANQPVKDVETGRVEITSQNHGFAVDEKSLPADVKVTHVSLFDGSNEGIASTTKDAFSVQYHPEASPGPSDSFYLFERFVAVMDRRAANSTNAGA

SEQ ID NO: 43610 - protein, 275 aa, Salmonella typhi
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVPPVINQIELHPLMQQRQLHAWNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQSGG

SEQ ID NO: 43611 - protein, 426 aa, Yarrowia lipolytica CLIB122
MSTFHTHLKMSLTNKLSIKDLDLKNKRVFIRVDFNVPLDGTTITNNQRIVAALPSIKYAIDQGAKAVILASHLGRPNGQRVEKYSLKPVQAELSKLLGKPVTFLDDCVGPKVEEEVSKAKDGEVILLENLRFHPEEEGSHKDADGKKIKADPAKVEEFRKSLTSLADVYVNDAFGTAHRAHSSMVGIELPQRAAGFLVAKELEFFAKALEHPERPFLAILGGAKVSDKIQLIDNLLDKVNALIIGGGMAFTFKKTLENVKIGNSLFDEDGSKIVAGLVEKAKKNNVKLVFPVDYVTADKFSKDAKVGHATDAEGIPDGWQGLDCGPKSIEEFQKVIGESKTILWNGPPGVFEFDNFAKGTKAVLDACVKAVDNGATVIIGGGDTATVAKKYGAEDKLSHVSTGGGASLELLEGKTLPGVAALSEKK

SEQ ID NO: 43612 - protein, 586 aa, Chlamydomonas reinhardtii
MAELEKTFALIKPDAVRAGKAQEIMQLIELNGFTIIAKQKLQLTRARAEEFYGEHKGKEFFPKLVNFMTSGPIWALVLAKPGAILAWRALMGPTNVFKARAEQPKCLRALYGTDGTQNATHGSDSPISAAREIKFFFPTLSGDPTIYAEPTAAAEYITKRIQPALAKALAALAREKPSADKFEAITFVAGYLLQNNPNKPKVLMPDEWDPALMGDDEDDEADFINARLAAPTGNDGATKAEFDAMVEAAKADTGGAAPAQEFVYPDSKPTTPVVPAPPAPGSKPPSASGARPQSARPTSARPPSASAAPPAPLAPVPPPASSSRPASGSGRPPSATARPPSATPPPPPPAVELEEADDPAQLDEAATKVQAAFRGYQARKEVAVMRSEAQPGEAAAEPEQEAELQPEAEPEPQPEGEQEPQPQASASSSFLPDGVTEEMAAEAATRVQAHMRGHLARKQVAAIKAQQAAPAVAESSEALAEPEPQPEAEAEPQPQASVSSSFLPDGVTEEMAAEAATLVQAHMRGHLARKQVAAIKAQQAAPAVAESSEAQAEAEQTEAEAEPQPDAEAEAGAAEGEAEPEPEAAE

SEQ ID NO: 43613 - protein, 941 aa, Alnus glutinosa
MMEGSDYFILRLLEWFILCFFILVRSTCGQEGFVSLRCCSDSNFTDQITSINWTPDDSWFPNKTGCRDEPNIEAWKKHKDYGKARIFNIDSGKRCYRLTSIKEQDYLVRGTFLFGDLLRTTLDTSFDVLVGVTGISRVNSSEDSEVEGIFRATKDHIDFCLEKVQGDPYISKLELRPLKDLNYLQNFSSTTVLKSVHRIDVGNTGVDIRYPSDKSDRIWKPDTNSTARGSRLSVNVSNYSANNATPPLEVLQTALYHSERLEFQESLDKRDYEYRVFLYFFELNKTSKHGDRVFDIYINNEKVKENFEILANGYNYKEVVWDVRANGSLNLTLIKASGSLFGPICNAYEILQVREINQSYGEFDLQVQQTDEKDVEVAWRVRNELLVSNQANAVLESWSGDPCLPKPWQGLACALHNGSAIITSLNLSSMNLQGSIPHSITELANIETLNMSYNQFNGSIPEFPDSSMLKSVDISHNYLAGSLPESLISLPHLQSLYFGCNPYLDKEPQSSFNSTIHTDNGRCDSNESPRVRVSVIATVACGSFLFTVTVGVIFVCIYRKKSMPRGRFDGKGHQLTENVLIYLPSKDDISIKSITIERFTLEDIDTATENYKTLIGEGGFGSVYRGTLSDGQEVAVKVRSATSTQGTREFENELNLLSEIRHENLVPLLGHCSENDQQILVYPFMSNGSLQDRLYGEPAKRKTLDWPTRLSIALGAARGLTYLHTNAKRCIIHRDVKSSNILLDHSMCAKVADFGFSKYAPQEGDCVSLEVRGTAGYLDPEYYSTQQLSDKSDVYSFGVVLLEIVTGREPLNIHRPRNEWSLVEWAKAYIRDSQIDEMVDPSIRGGYHAEAMWRVVEVASTCIESDAASRPLMIDILRELDEALIIETNASEYMRSIDSLGTSSNRFSIVMEKRIVLPPISSSPSEPSPILPQGPSPPQPR

SEQ ID NO: 43614 - protein, 941 aa, Alnus glutinosa
MMEGSDYFILRLLEWFILCFFILVRSTCGQEGFVSLRCCSDSNFTDQITSINWTPDDSWFPNKTGCRDEPNIEAWKKHKDYGKARIFNIDSGKRCYRLTTIKEQDYLVRGTFLFGDLLRTTLDTSFDVLVGVTGISRVNSSEDSEVEGIFRATKDHIDFCLEKVQGDPYISKLELRPLKDLNYLQNFSSTTVLKSVRRIDVGNTGVDIRYPSDKSDRIWKPDTNSTARGSRLSVNVSNYSANNATPPLEVLQTALYHSERLEFQESLDKRDYEYRVFLYFFELNKTSKHGDRVFDIYINNEKVKENFEILANGYNYREVVWDVRANGSLNLTLIKASGSLFGPICNAYEILQVREINQSYGEFDLQVQQTDEKDVEVAWRVRNELLVSNQANAVLESWSGDPCLPKPWQGLACAPHNGSAIITSLNLSSTNLQGSIPHSITELANIETLNMSYNQFNGSIPEFPDSSMLKSVDISHNYLAGSLPESLISLPHLQSLYFGCNPYLDKEPQSSFNSTIHTDNGRCDSNESPRVRVSVIATVACGSFLFTVTVGVIFVCIYRKKSMPRGRFDGKGHQLTENVLIYLPSKDDISIKSITIERFTLEDIDTATENYKTLIGEGGFGSVYRGTLSDGQEVAVKVRSATSTQGTREFENELNLLSEIRHENLVPLLGHCSENDQQILVYPFMSNGSLQDRLYGEPAKRKTLDWPTRLSIALGAARGLTYLHTNANRCIIHRDVKSSNILLDHSMCAKVADFGFSKYAPQEGDCVSLEVRGTAGYLDPEYYSTQQLSDKSDVYSFGVVLLEIVTGREPLNIHRPRNEWSLVEWAKAYIRDSQIDEMVDPSIRGGYHAEAMWRVVEVASTCIESDAASRPFMIDILRELDEALIIETNASEYMRSIDSLGTSSNRFSIVMEKRIVLPPISSSPSEPSPILPQGPSPPQPR

SEQ ID NO: 43615 - protein, 585 aa, Photorhabdus luminescens subsp. laumondii TTO1
MQWKKLQRWMPGLGNFSHYRKEWFSHDLRAGLSVAAVALPVAIAYAELMGISAIIGLYACILPMFAYALFGTSRQLIVGPDAATCAVIAAAVAPLVFGNEDVRWQLTIVMTLMTGIWCVLASHFRLGAFADFLSKPILKGLMNGVALTIIVDQLAKVFGFAGVPMGLIERVIALPAKLMSTHLPTLAMSVAMVLILLTVRFLRPTWPGPLLAMVLATYISWQFDLEKYGVQIVGSVSGGGLPVVPMPDFQPGIMRELVIPSLNLAVISFVSFMMTARSFASKNGYQIDADCELRALGIANIASALSQGFAVSAASSRTAVNDTIGGKTQLVSVIAATIILLVLLFMTRFLAYIPLSSLGVVLIYSASSLLGLRQIWSLRKRNHQAFTLSLFTFIAVLVVGLINGVGFAVLLGLLQFLRIIFRPTDQLLGVNDQGMIHSINHGNDIKPIDGVMMYRFNSPLTYFNVSYFKKRVLQHVDRIQKINKTQKRPGWLVVDAAVSFTHDDVSVFAAIDELISELKVRDITLVLAGRRTELTRWIKQNKLRSSDDDLIVVPDLYFAVRMIQSKPEWYSNYAKRYNSVIEINQ

SEQ ID NO: 43616 - protein, 945 aa, Tropaeolum majus
MMMERLDNRSSRRVECFIFCLLILPIIFHSVSAQPGFVSVACCADSGFTDNTLINWITDESWFPDKQGCRNFAPPVANYTGYKKARIFAIDSGKRCYNLPTIKDQDYLIRGSFLFGDSLSSPFGTSFNVLVGVTPIARVSTSDKLEVEGIFRANRDYIDFCLAYEKGEPYISNLELRALENSNFLKLESPVVLKLVDRVDLGGSTGEGIRFKDDKYDRIWKPDSYLNRTIITNANVSINNLNVTVPIKALQSAVTNENRLEFLKNDLDIGDYKYSVTLYFLELVENVQPGQRLFDIYINNALKWENFDISANGSDYKEVSFYATANGFLNVSLVKVPNGLGFGPICNAYEILQVRQWIQQSNLNDVNVIVNVKEELLKHNKRNVLWESWSGDPCLPYPWDGLVCYSVNGSSVITELNLSSRKLQGPIPSSIIQLTYLKDLNLSYNGFTGTIPSFTASSMLTSVDLRNNDLKGSLHESIGALQHLKTLDFGCNPQLDKELPSNFKKLGLTTDKGECGSQGPKHSTRAIIISIVTCGSVLFIGAVGIVIVFFYRRRSAQGKFKGSRHQISNNVIFSIPSTDEPFLKSISIEEFSLEYITTVTQKYKVLIGEGGFGSVYRGTLPDGQEVGVKVRSSTSTQGTREFDNELTLLSTIRHENLVPLLGYCCENGQQILVYPFMSNGSLQDRLYGEAAKRKVLDWPTRLSIALGAARGLTYLHSLAGRSLIHRDVKSSNILLDQSMTAKVADFGFSKYAPQEGDSCASLEVRGTAGYLDPEYYSTQQLSAKSDVFSFGVVLLEIISGREPLNIHRPRNEWSLVEWAKPYIRESRIDEIVDPTIKGGYHAEAMWRVVEVALACIEPFSAHRPCMADIVRELEDGLIIENNASEYMKSIDSIGGYSFGGGSNRFSIIVTDKEKKTIPPPPSPPTPNPSEPSPVNTQALTPPEPR

SEQ ID NO: 43617 - protein, 526 aa, Silicibacter sp. TM1040
MTDSSQSTEITDLFIIGGGINGCGIARDAAGRGLSVTLAEKNDLASATSSASTKLFHGGLRYLEYFEFRLVQEALIEREVLLRAMPHISWPMRFVLPFHKDMRFDNTTPTSKLLTTFMPWMKGRRPAWLIRLGLFMYDTLGKRGILPGTTTVDLTRDEAGKPLQSKFKKAFEYSDCWVEDARLVVLNARDAESRGTEILTRTEVINATRHADHWEIRLRDLATGEEETRRAKMLVNAGGPWVADVLRQKLGQNSRENVRLVRGSHIVVPKLYDHGRCYFFQGQDGRIIFAIPYEEDFTLIGTTDADHPDPETKPVCTEEEQDYLVRFASNYFERPVTREQIVWTYSGVRPLYDDGASSASAATREYVLTLDTAQAPLLNVFGGKITTYRKLAEAALEKINEVFPELPEKWTAGVALPGGDFPVEGVTELGAKLAQDYPFLTPYAVRRLIRAYGTEAWDVLGDATTPSDLGEDFGATITARELDWTIQNEWVRSGEDYLWRRTKLGLRLDADARGAVNRYIEARITG

SEQ ID NO: 43618 - protein, 117 aa, Eucalyptus grandis
MAEEGQVISCHSAESWSEQIAKSNESDKLVVVDFTASWCGPCRFIAPFLAELAKRFPNVLFLKVDVDELKTVAQEWAVEAMPTFMFVKGGKIVDRVVGAQKDQLQMTLAKHMATASA

SEQ ID NO: 43619 - protein, 289 aa, Zea mays
SPVADAHFGLAQIIPAHKKKNARISRFLFLLAQSRSPLHRASRKKARPLRHLAHQAPATSSGAMATAPYASSLFLASSPISTAPRASAGSFPPSAQPFSMRLRPRPSPAVAAAVQAEHQPAVAATPKPPALPFRVGHGFDLHRLEPNLPLIIGGIDIPHDRGCEAHSDGDVLLHCVVDAILGALGLPDIGQIFPDSDPRWKGADSSVFMREAVKLMHEAGYELGNLDATLILQKPKISPFKETIRLNLCNLLGADPSVVNLKAKTHEKVDSLGENRSIAAHTVVLLMRK

SEQ ID NO: 43620 - protein, 587 aa, Bacillus subtilis
MKRTWNVCLTALLSVLLVAGSVPFHAEAKKPPKSYDEYKQVDVGKDGMVATAHALASEIGADVLKKGGNAIDAAVAIQFALNVTEPMMSGIGGGGFMMVYDGKTKDTTIIDSRERAPAGATPDMFLDENGKAIPFSERVTKGTAVGVPGTLKGLEEALDKWGTRSMKLLITPSIKLAEKGFPIDSVLADAISDYQEKLSRTAAKDVFLPNGEPLKEGDTLIQKDLAKTFKLIRSKGTDAFYKGKFAKTLSDTVQDFGGSMTEKDLENYDITIDEPIWGDYQGYQIATTPPPSSGGIFLLQMLKILDDFNLSQYDVRSWEKYQLLAETMHLSYADRASYAGDPEFVNVPLKGLLHPDYIKERQQLINLDQVNKKPKAGDPWKYQEGSANYKQVEQPKDKVEGQTTHFTVADRWGNVVSYTTTIEQLFGTGIMVPDYGVILNNELTDFDAIPGGANEVQPNKRPLSSMTPTILFKDDKPVLTVGSPGGATIISSVLQTILYHIEYGMELKAAVEEPRIYTNSMSSYRYEDGVPKDVLSKLNGMGHKFGTSPVDIGNVQSISIDHENGTFKGVADSSRNGAAIGINLKRK

SEQ ID NO: 43621 - protein, 260 aa, Ralstonia eutropha JMP134
MTGLQNAGRLVPDLSGRQALVTGGSSGIGEAIATAMGQAGARVILAARRQSQLDAAASRLDAMGIAVDTHVFDVSDLDAIPAAADALQQQHGTIDILVNAAGMNLRETYASVTPSSWRLQLDTHLGAPFFLTQALAPAMQTQGWGRILNIASLQSYRAFANSAPYGAAKGGIVQLTRAIAEEWSRHGITCNAIGPGFFPTALTGPVFADAGLTEYHASRTCIGRNGELADLHGLVAFLASDMAAYITGQTFMVDGGYTAR

SEQ ID NO: 43622 - protein, 403 aa, Pseudomonas syringae pv. tomato str. DC3000
MDTSFWKAGHRPTLFAAFLYFDLSFMVWYLLGPMAVQIATDLHLTTQQRGLMVATPILAGAVLRLFMGLLADQLSPKTAGIIGQVIVIGALFTAWQLGIHSYEQVLLLGLFLGMAGASFAVALPLASQWYPPQHQGKAMGIAGAGNSGTVLAALIAPVLAASFGWGNVFGLALIPLVLTLIAFTLMARNAPERSKPKSMADYLKALGDRDSWWFMFFYSVTFGGFIGLASALPGYFNDQYGLSPITAGYYTAACVFGGSLMRPLGGALADRFGGIRTLTVMYTVAAVGIAAVGFNLPSSWAALALFVAAMLGLGAGNGAVFQLVPQRFRKEIGVMTGLIGMAGGIGGFLLAAGLGAIKQNTGDYQLGLWLFAGLAVLAWFGLLNVKRRWRTTWGSAAVTAARV

SEQ ID NO: 43623 - protein, 482 aa, Cryptococcus neoformans var. neoformans JEC21
MSPSPTENAPTNLEELEELLKNDNKVKVAGVDVEGVLRGKIMSKAKLLSSVKSEGFNFCSVIFGWDIHDQAYNKELLVANWDNGYRDLFAVIDLSTFRRLKWEKDIPFFLCRFVIPETGEVLPVDPRSLIAKVTDKGEAMGYKCMSGAEFEYFQFAETTKSLADKNFRNLNPLTPGMHGYSILRPTLNMDYFHDLYDMAVNFGIEVEGHHTETGPGVFETALGYTDASRMADNACLFKLVAKSIGMKYGISPTFMAKPWGDLPGCSGHIHVSLQDKNGKNIFAVSDEEAANGGRKDAAFEDLKYLSQEGEWFLAGLLEGMPDVVPMFCPTINSYKRLQGGQAMWAPDTATYGYDSRAASVRLLTAPGVPGYATRFEVRVPGADMNPYFAMSAIFALGLRGIEQKRVLPYGPIGSSGVSRDTVKHLPTSLDSATEAFMKKDSLAREVFGNFFVDHYGGTREHEVELHRKAVTDWEVARYFELV

SEQ ID NO: 43624 - protein, 112 aa, Oryza sativa
MADAAPADRRGPRGGAGGEGGAGGRDGFKSGFGGERGGRGGRGGRGDRGGRGGRGGRGGRGGAPGGGRKDEGKGGWNPVTKLGRLVKEGKITSLEEIYLFSLPIKEAEIVDR

SEQ ID NO: 43625 - protein, 312 aa, Physcomitrella patens subsp. patens
MPKLKLNTGTCISAVGLGTWQADPGLVKQAVKEAVKVGYRHIDCAKAYKNEDEVGEALQELFKEGVVKREDLWITSKLWCTDHNPADVEPALDGSIERLQCGYLDLYLMHWPVALKKDAQGTGPDDFAPLNVAATWAAMEKCYEKGKAKAIGISNFSVEKTKDLLSKCKVRPAVNQVECHPLWQQKKLWPYLKSEGIHLTAYSPIGSSNSPFATINVLELPTVTKLAEKYKRSPSQIVLRWNIQQGHSVLPKSTHADRLASNIEIFDFELNEEDLKEFDKIEQHRLLLGDDMWINDKTSPYKTVEELWDGDI

SEQ ID NO: 43626 - protein, 510 aa, Physcomitrella patens subsp. patens
MVSLYLQKPPGVEVSNDEDAKRRREWLESIGAVLQRVVGVEARMWLITTLSLLEVPSHVQVECFFDLLQNSMRDSVKRREENAEGPLELQFTRMLCENRPRIAAKLIADDSSIFKRLFSDNPKNILLWFGKFAGAGQTEHQQGARALANYAFRNRDLCWHLLEWEGKHAQAPSTVAAKPHYFLELDVVNTVQNFLEDEPEFWRSDEFRDSLKDGEFLSIDIMFFAKVMVKKLASDIDSALDTWKVLKNYIRDESFSILCQQLLHVASDDKLLMFVNHLGSDLPRGYKKDGKNGNTNLDRAVRSWMEVLSFAGMQWKSLVEPMFCNACINHGRNLLRALHQEEHEEDANFLKQLINNRTNDEEKEHWALKVKISRMDKASVCRYIALEAWVLFYQLSSSAGTNFEAVLNESGIQFRHHSPAKDVRNRKRNRKSSKRPRKRKQKRRRSIDADDSDDESSDDIELSNPEIFSKDEQDWRVSIDNYSLTWTRADLAEYLTGFAVQGWLDWLSKS

SEQ ID NO: 43627 - protein, 126 aa, Candida albicans SC5314
MSAPNPKAFPLADSALTQQILDVVQQSQNLRQLKKGANEATKTLNRGISEFIIMAADTEPIEILLHLPLLCEDKNVPYVFVPSKAALGRACGVSRPVIAASVTSNDASSIKNQIYGIKDKIETLLI

SEQ ID NO: 43628 - protein, 328 aa, Trichodesmium erythraeum IMS101
MANYAPAIETMTANYLEKWVEMGTLTWYPEIRNYTFDIASLLFMGSDESSQTKLVSLFEEWVKGLFSIPLSLPWTRFGKSLRCRQKLLQHIEEIILQRQQQQNLGEDALGILLQAQDKEVNGLSLDELKDQILLLLFAGHETLTSAIASFCLLTSQHLDVLTRLRQEQKQFSAIEPLTLENLKRMTYLDMVLKEVLRLIPPVGGGFRQVTQDCEFCGYSIPKGWLVQYQIAKTHQDETLYPDDKNFDPERFAPENAVDKQKVFGYVPFGGGMRECLGKEFARLEMKIFAVMLLRGYEWELLPEQDLSVVAAPTPYPRDGLKVKFRKVE

SEQ ID NO: 43629 - protein, 652 aa, Synechococcus elongatus PCC 6301
MAYEPLHHKYRPQCFADLVGQEAIARTLSQALAQQRIAPAYLFTGPRGTGKTSSARILAKSLNCQQSTVPTASPCGECEACRAIARGNALDVIEIDAASNTGVDNIRELIERAQFAPVQCRFKVYVIDECHMLSTAAFNALLKTLEEPPDRVVFVLATTDPQRVLPTIISRCQRFDFRRIPLQAMTDHLQVIAQKESIEIEPTAIALVAQLAQGGLRDAESLLDQLGLLPPPVTPEAVWDLLGAVPERQLLQLLEAIAANDPEALLTLIRQLLDRGREPLTVLQNLTAFSRDLLIARTAPQRRDLTTVTEATWQELCTFAEDWTPEQILQLQQHLRQSELQIKNTTQPRLWLEVALLGLLPSAQAPVTTAPPAIAAPVTRPVSIPAAVVPAETPSSPAAVAPVAIPVAPAVTTTPPEVPAIAAAAPEPLNLEELWQRVLINIASRGTQMLLQQQGRLLRCQAGQAVVSVPPNWLSIVQGKRNLLAEAFQTVLGQAIAVELESSSGTDPNPVSLPPPPVVIEMPRSPASPAVTPRSAPPSEPIAAAPRQPAIATIAPPPVAVAPPVPPPAPSPPIPQSKPVAIATSPSKSPEVVPAPQLETPPAALRPLADWELDPGLKAARSLAQFFNGEVVSDRESESDTSEAVVEPDVDF

SEQ ID NO: 43630 - protein, 577 aa, Bacillus cereus G9241
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLDNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKCFWCIDRNGLVTDNMEDLLDFQMPYARKEAEVSEWKQNGVIGLAEVVKHVKPTILIGTSTVAGAFKEEIIKDMASHVERPIILPMSNPTPLAEAKPADLIEWTEGKALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENLSDNDIKIAVKEAIWEPEYRQIKAVEKVRI

SEQ ID NO: 43631 - protein, 335 aa, Oryza sativa Indica Group
MLLHHRLLPRLLLSPSTPVTTTLLVHRTSLFPTRRILSPCCSALSQVAAAPETVDHSDGDEPQGDVQVQLPLDRLFVPPGASVSAGDAEAVTARVLKGSNIVLGPYARGDANVIAADFVKSSVRPDDCPRDGLPEFALVGRSNVGKSSLLNSLVRRKRLALTSKKPGKTQCINHFKSLFNRYAAAPQEARTNWDEFTRNYFLGRENLVSVFLLVDASIPAKKIDLDYASWLGQNKCKIQKSSQTSNYVGINLVPETPLKTSSNVPMTLVFTKCDKRKKKKNGGKRPEENVENFQSLIREYFEAAPPWIMTSSVTNQGRDEILLHMSQLRNYWLKH

SEQ ID NO: 43632 - protein, 598 aa, Physcomitrella patens subsp. patens
IALFEGPNSIGRDDLVSANKQVSRKHVVLKTSSDCTFELSVIGQNPVVIKSGSGKRKLLPNARALISAGDIIEFLPGKMPYKLTLEPTEDELSPRAANKLDEAFGVDYEAGCRSSSTFRLMQVKGLPQWANKGCVNIRGVIQGDVQVALLSNYMVDIDWLLEACPRLKTVPSVVIFHGESGGSLELLQARKPNSWLLHKPPLRLSYGTHHTKAMFLLYPTGIRIVVHTANLIYIDWNNKSQGLWTQDFPYKNVAAGESKPSPFENDLVEYLQALEWTGCIAIISGIGEVHVDAAFFRKFDYSSAMVRLVASVPGYHLGRNLTKWGHLKLRTILQEQHFEEHFKGSPCVYQFSSLGSLDEKWMGEFGSSIQAGSTFGNEQLGPGPVQIVWPTVEDIRNSLEGYAAGGAVPSPLKNVERAFLSKYWYRWQADHTGRSRAIPHIKTFLRYNDQRLAWFLLTSSNLSKAAWGVLQKNGSQLMIRSYELGVLFLPSLVGNNSNVTPFSCTYSSSILPRELQNREDDGGKRQLRHTKLVTLSWKSSNHEKSDMDIFVRLPIPYALPPVKYDPKDIPWSWDRQYREPDMFGEVWPRQVRRYTMQS

SEQ ID NO: 43633 - protein, 104 aa, Brassica napus
  misc_feature (13)..(13): Xaa can be any naturally occurring amino acid
MYSSLETTALATXSPRVLGRESSEKDMSMSGGDKLILKGLKFYGYHGAIPEEKTLGQMFLVDIDAWVSLKKAGESDNLDDTISYVDIFSIAKEIVEGPSRNLLE

SEQ ID NO: 43634 - protein, 508 aa, Spinacia oleracea
MVTRVNDEFETKKFGDLPVDTENKAMIFPLFSVAKPHMRAFHLSWFTYFTCFISTFAAPPLLPIIRDNLNLTANDIGNAGVGSVAGAIFARLALGAACDMVGPRLAAATICFITVPAVFLSSMASSPTAFFIMRFFTGFSLATFVSTQYWMSCMFSPKVVGLANGQSGGWGNLGGGVANLVMPFLYSFILNKTPADTPFTAWRVAFFIPAGLQMFSAYAVMLFGQDLPDGNFLQMQKSGAMHKDKASKIVYHAVTNYRSWITAIGYGFCFGVELAVTNVVVYYFYDRFNLNLNLAGIVGALFGMVNIFSRSSGGWFSDFMAKKFGMRGRLWGWWTVQTLSGVMCIVMGRMNTLSSTTAVMMIFSFLVQAAEGLTFGVVPFVSRRSLGVVSGLSGAGGNAGAVICQVIFFRGSQFKIEHGLTYMGIVIIACTLSLGTINFPQWGGMFCGPKPNVTEEDYYMREWDAEEQEQGLHRVSMKFAEGSRNERSSKVISVTEEEDSTPTPVNNV

SEQ ID NO: 43635 - protein, 164 aa, Glycine max
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEAAMENPKGPSRCSTCRKRVGLTGFNCRCGNLYCATHRSRDSPKCSLTTAPGPGRLPKANPVVRGKT

SEQ ID NO: 43636 - protein, 352 aa, Nicotiana tabacum
DQPEPVAENGYNEQLEKYAAVVSPPRLCQLGLTYLGKYEMPILFPIASRLTKLDLLYALLDTAAHCFLLQRCPNLEILETRNVVGDRGLEVLGQYCKRLKRLRIERGADDQEMEDEQGAVTHRGLTDLAKGCLELEYMAVYVSDITNEAFENIGTYLKNLCDFRLVLLDREERITDLPLDNGVRALLRGCYKLRRFALYVRPGGLTDVGLSYVGRYSQNVRWMLLGYVGESDEGLLEFSKGCPSLQKLEVRGCCFSERALALAAMQLKSLRYLWVQGYRASSTGRDLLAMARPFWNIELIPARRVVASEGNNGEIIVAEHPAHILAYYSLAGQRTDFPDTVRPLDPTYLLAE

SEQ ID NO: 43637 - protein, 310 aa, Yarrowia lipolytica CLIB122
MKLVFTPLTARRAMVYCVQTSVTPPASQTPRLDDKLVKKFGTVWKQFESSETGWKKQIVFWTNKMLEQIPYEEWGLKSIPRQSAVLRRLKQIEAKDEKELFEKNEKLPVAEQLPVVQLEDIAKKHHEELLKVPLVFPNHLSTPDQAKAQLLKLAIDGAKHHRKYMIWCAIGAPLTLPVALLPVLPNLPGFYLVFRCWSHWKALEGANHLKHLIEDNHLEFVSSEQVFDAYNKAEDTHVLKNVAKLAEEDGVAPATPTSNETVENSLLVDNTSIDHIVETVQLPDLAAELKRARRQVVYNIDKEIKKREQK

SEQ ID NO: 43638 - protein, 488 aa, Gluconobacter oxydans
MEHFQQVEPFDYVIFGATGDLTMRKLLPALYNRLRMGQIPDDACIIGAARTELDREAYVARARDALERFLPSDILGPGLVERFLARLDYVTLDSSREGPQWDALKSLLAKAQPDRVRVYISQPHRSLRQHLRDLNRYELITPTSRVVLEKPIGTNMATATAINDGVGQYFPEKQIYRIDHYLGKETVQNVLALRFANPLMNAAWSGEHIESVQITAVETVGVEGRAAYYDTSGALRDMIQNHLLQVLCLVAMEAPDSLEADAVRNAKLAVLNALRPITDATAATETVRAQYTAGVVDGENVPGYLEELGKPSATETYAAIRAWVDTPRWKNVPFYIRTAKRSGKKVSEIVVTFRPAATTMFGATPASNRLVLRIQPNEGVDLRLNVKNPALDVFNLRTADLDTSIRMEGGLPFPDSYERLLLDAVRGDPVLFIRRDEVEAAWRWVEPILEAWKHDKAPMQTYSAGSYGPEQATQLLASHGDTWHEASE

SEQ ID NO: 43639 - protein, 495 aa, Bacillus clausii KSM-K16
MNQIEQAEAVFVIFGSTGDLAKRKLFPSIYNLYRKGNLNEHFAVVGLGRREWDDEKLRTVVMESIQEELGEQRPEVTESFLKHFSYLSFDVTNKDSYSELNDKLHILDETFQIPGNRIFYMAMAPEFFGQIAQSIHNEGLKDTQGWTRLVIEKPFGTDLQSAIRLNDEIRQAFSEDEIYRIDHYLGKEMVQNIQVIRFANAIFGSLWNNRHIANIQVTSSEQLGVEGRGGYYEKSGALRDMVQNHMLQMVSLLAMDVPLRLSTDDIRSEKIKVLRALRPIVGESIKENVVRGQYGRGEINGQEVIGYLEEENVSDSSKTETYVAAKLMIDNHVWAGVPFYIRTGKRMAVKSTKIVVEFKELPLNLYSKENKQTGPNLLIIHIQPDEGMTIVLNGKKIGSADTTPVHLQYRHDSEDRFNTPEAYERLLFDCMMGDATNFAHWDEVSLSWSLVDAISKAWSESGEKLPTYRAGSMGPKEADELLEADGFSWWPVEEM

SEQ ID NO: 43640 - protein, 416 aa, Solanum tuberosum
MGICLSNEIKAETTIFTGTGVGSRNVSGNGTETSNSNSKVSSGSVPPTPRSEGEILQSSNLRSFTFNELRASTRNFRPDSVLGGGGFGSVFKGWIDEQTLLASKPGAGIVIAVKKLNQEGLQGHREWLAEINYLGQLRHPNLVRLVGYCLEDDHRLLVYEFMPKGSMENHLFRKGSYFEALSWSLRMKVALGAARGLAFLHNAEASVIYRDFKTANILLDSNFNAKLSDFGLARDGPTGDKSHVSTRVMGTYGYAAPEYLSTGHLTAKSDVYSFGVVLLEILSGKKAIDKNRPTGEHNLVECSRPYLTSKRRVFRVLDSRLEGQYSLTRALKVANVALQCLAMDPKSRPTMDEVVTALEQLQESKDRVKNDKNKDQQLNRLSSQSSGELNKSFRSNSEETPRVANYPRPSASLRSI

SEQ ID NO: 43641 - protein, 320 aa, Solanum chacoense
MEKNQEAEVMWKRGRTLGQGGFGFVSLACTTHSDDSPLIPSLIAVKSCMLSHSESLEDEIEFLRMCQDCPHVIRSFGVKVTQEDDILLYNLLLEYASAGSLADRLLNNDQLGLPEFQVQNHTKSVLLGLRFIHRKGIIHCDIKPHNILLTSTDDDDAEEVAKIADFGLSLTLEQSWTQTQGMRGTKRYMAPESLLKQEYGPEADIWALGCTVYELITGTPLWESSNSDPEFDDVLHRIMYEEPNLENDKLSTEAKDFMSYCLIKNPKSRWSAGLLLNHSFLKSADSVLPPKKRKRQQVTCPGYRGERKHSGHSHTFVIWL

SEQ ID NO: 43642 - protein, 923 aa, Lupinus albus
MEHQHSWILRLVSYIICLYIFIRSASATEGFESIACCADSNYADPLTTLNYTIDHSWFSDKGSCSQISKNVTNYGSNENVRLFDIDEGKRCYNLPTTKNGVYLIRGIFPFGELSNSSFYVTIGVTQLGSVISSRLQDLGIEGVFRATKNYIDFCLVKEKVNPYISQLELRPLPEEYIHGLPTSVLKLISRNNLKGEGDDIRYPVDKSDRIWKGTSNPSYALLLSSNATNFDPKTNMTPPLQVLQTALTHPEKLEFIHNDLENEGYEYRVFLYFLELNSSLKAGQRVFDIHVNSEAKVERFDILAEGSNYRYTVLNFSATGLLNLTLVKASGSENGPLMNAYEILQVRPWIEETNQTEVEVIQKLRKELLLQNQDNKVIESWSGDPCIIFPWQGIACDNSSVITELDLSSSNLKGTIPSSVTEMINLKILNLSHSSFNGYIPSFSMSSLLISIDLSYNDLMGSLPESIPSLPHLKSLYYGCNQHMSEKVPANLNSSLIKTDCGKCQADNPKFGQIIVIDAVTCGSILITLAVGLILVCCYRLKLTPSEGFGEKNYPMATNIIFSFPASKDDFFIKPLVVTIQIFTLEYIEVVTERYKTLIGEGGFGSVYRGTLEDGQEVAVKVRSATSTQGTKGFDNELNLLSAIQHENLVPLLGYCNEKDQQILVYPFMSNGSLQDRLYGEPAKRKILDWPTRLSVSLGAARGLAYLHTFPGRSVIHRDVKSSNILLDHSMCAKVADFGFSKYAPQEGDSYVSLEVRGTAGYLDPEYYSTQQLSEKSDVYSFGVALLEIVRGREPLNIKRPRNEWSLVEWAKPYIRASKIDEIVDPGIKGGYHAEAMWRVVEVALQCIEPMSAYRPCMVDIVRELEDALIIENNASEYMKSIDSLGGSNHYSIVMEKRVLPSTSSSTAESTITTQTLSQPQPR

SEQ ID NO: 43643 - protein, 490 aa, Escherichia coli K12
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 43644 - protein, 304 aa, Solanum chacoense
MASIRWSRGRTIGKGAEGTVTLATTHNNFSIAVKSSLFSCSKSLQKEREFLNEFQDCSQIIRCFGADVTEEDNNILYNILLEYAIGGSLAHRIGKKSGLPDFEVKKYSKPILLGLRVVHGKGFVHGDIKPHNILLVGTEKRAKIADFGFASKVGIGSKKRKLRGTPMYMAPESVLDDEYGTPADIWAFGCTVFEMITGKKVWDCTGINDPLHLLCKIGMQSPDLHDDKMSKQAEDFLNKCVDRDPHSRWTADLLLNHPFLSSDNNDVHQRKRKELNLVDLCNSTELKPMKLLTNKRRRKLVERC

SEQ ID NO: 43645 - protein, 484 aa, Agrobacterium tumefaciens str. C58
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 43646 - protein, 218 aa, Triticum aestivum
  misc_feature (154)..(154): Xaa can be any naturally occurring amino acid
  misc_feature (170)..(170): Xaa can be any naturally occurring amino acid
  misc_feature (184)..(184): Xaa can be any naturally occurring amino acid
VLSLLQSSRHARHFSTQLLEGVPTLPKPTCERYFLRNASPYQIWSTSFASYNGDLVEAVVPFMGESVTDGTLANFLKKPGDRVEADQAIAQIETDKVTIDVSSPEAGVIEKFIASEGDTVTPGTKVAVISKSAARREVHVAPSEETSQKETPPXTPPVKPKVVGKSPSVXICHTQASKLASPSXPQLPPKERERTVSMPRLTKRIANRLRDSQTLWPY

SEQ ID NO: 43647 - protein, 610 aa, Aspergillus nidulans FGSC A4
MVSASKAARLAKRGDAKAKKASKSKDDTPVESGAEDQPATTDAKMKEVEKLTAQMDKHGLSDRVTTGVLSSMPSSRDAKITSASLVFHGKVLITDSTLELNFGRRYGLLGENGCGKSTLLKAIDAREFPIPEHIDIYLLNEGAPPSDLGALEWVVTEAQNQLDRMEKQAEEILEKEGPDSPILEDLYDRMDKMDPSTFHTRASLILTGLGFNKTTIHKKTKDMSGGWRMRVALAKALFVKPSLLLLDDPTAHLDLEACVWLEEYLKKWERTLVLVSHSMDFLNGVCTNMIDMRMKQLLYYGGNYDSYHKTRAEQETNQMKAYHKQQEEIAHIKKFIASAGTYANLVRQAKSRQKILDKMEADGFIQPVIPDRVFSFRFADVEKLPPPVLSFDDVSFSYSGNWDDTLYEHLDFGVDMDSRTALVGPNGVGKSTLLRLMTGKLSPIGGRVSRHTHLKLGMYSQHSAEQLDLTKSALEFVRDKFPEKSQDFQYWRQQLGRYGLSGEAQTALMGTLSEGQKSRIVFALLAIESPNMLLLDEPTNGLDIPTIDSLADAINAFSGGVVVVSHDFRLLDKIAKDIMVCEHKTVRRWDGTIGEYKNHLRKKMISEGTV

SEQ ID NO: 43648 - protein, 142 aa, Methylobacillus flagellatus KT
MKTVRQVLETKGSTVYSVAPESLVYDALLLMAEHHIGALVVMQRDKMVGIFSERDYAREVVIKGKTSKTTTVGDIMSVQLITVSPDDTVEHCMNLMSGKRIRHLPVLEGEKLVGLLSIGDLVKETIAYQEFLIKQLESYIQS

SEQ ID NO: 43649 - protein, 618 aa, Methylobacillus flagellatus KT
MAEPQISSLLLQSAIYLGAAVIAVPVFRRIGLGSVLGYLFAGVVIGPWGLGLVADAEAVMHFSEFGVVMMLFLIGLEIEPDKLMALRLPIFGMGGLQVVLTAALVYGAGIAIGLDWRLSLVAGMGVAMSSTAIAMQILTEQGALNRPSGRSAFSVLLFQDLAVIPIMILLLVIAPGAHTAHGVHMDWFAILKAVSLVVLLVLGGRYLLRPVLRYTANTKLREIFIAFALFLIIGVSILMTLVGLSMALGAFIAGVLLADSEYRQELELDIEPFKGLLLGLFFISVGMSINIDLILQQPELVLGLALVLVLFKLVLLFCLAKVFRLDNAGGLMFAVTLSQVGEFAFVIFSAALDAKVISGEHGALLNSVVALSMVTTPLLLLGFRGVYRRRLQQRRSSRGHDEFEEARPVIVAGFGRVGQIITRLLTSVGVEPTVIEHDPNQIELMRSFGYHAYYGDITRPDVLRAAGIANARLLILAIDDADAALETARYVREHYPQVKILARARNRTYVFDYMDMEIDCVRETFLSAVHLGEKALREMGYSPFHAYRTAWKFRQDDEKLMHNLHPIHTDMQKVVSYSVRTRQDLQRTLSREMEDAIAGQGRNAWEGRPPSDTPEEKG

SEQ ID NO: 43650 - protein, 230 aa, Vibrio angustum S14
MKNTRIVLLRHGQSVWNKENRFTGWANVSLSELGENEARNAGIKLKENGFNFNFCYTSMLDRAIKTSNLALEQLDSLWIPVEHDWQLNERHYGDLQGLNKAETAEEFGDEQVHIWRRSYDIEPPQVSEDSFFYPGNDRRYQELQHSQLPHGESLKDTYDRVIPFWNESIVPNVKQGSDILIAAHGNSLRALIKYLDNIPDDKITKLEIPTGAPLVYEFNEQMKPVKSYYL

SEQ ID NO: 43651 - protein, 487 aa, Vibrio angustum S14
MKSLQQLVFNNTYSQLPSLFGTFVTPQPLSNPYLISVNQHIAKLLELDINAIQSDDFINIFSGNDTLSGFDPIAMKYTGHQFGQYNPDLGDGRGLLLGEVQTSNGKKWDIHLKGSGLTPYSRMGDGRAVIRSSIREYLASAAMAGLGIPTSHALAVIGSDTHVYREKQEFGATLIRVSESHIRFGHFEYLFYTQQHDQLRLLADYVIQHHFPECQQVEKPYAALFEQVCENTAKMIAHWQAVGFAHGVMNTDNMSILGLTFDYGPYGFLDDYNPGYICNHSDYSGRYAFNQQPSIGLWNLSALGYALAPIIDKSDIEHALEIYQHQLQMHYSKLMRQKLGLFDSQEQDNELFQQLFNLLKQQSIDYTQFFRTLSTLSQDELHNTSSHFSSLTANTTPIDEWLVDYKKRISNTNDQQRLALMLKSNPKYILRNYLAQLAIDGAEQGNFTFVENLLTVLHDPFDEHPNFEDLADLPPKWGKELEISCSS

SEQ ID NO: 43652 - protein, 369 aa, Leptospira interrogans
MSERSYYDILGVSKSANDEEIKSAYRKLAIKYHPDKNKGNKESEEKFKEATEAYEILRDPKKRQAYDQFGKAGVSGGAGGFGQGAYTDFSDIFGDIFGDFFGGGRSSGFGGGRRSGPQRGSDLRYNLEVSLEDAALGREYKIEIPRLESCVDCNGSGASKGSSPATCPDCGGSGQIRRTQGFFSVATTCPTCRGKGTIISNPCRSCGGQGLQEKRRTINIKIPPGVETGSRLKVSGEGEAGPNGGPHGDLYVVTHIKKHELFERQGNDLILVRKISLAQAILGAEIEVPTIDGKKAKMKIPEGTESGQVFRLKGHGMPYLGAYGKGDQHVIVKIEIPKKITRRQRELIEEFARESGENIPGSKGKIFTK

SEQ ID NO: 43653 - protein, 501 aa, Iris x hollandica
MVGILVYVALFILSLLLFLTAAAKLHNSKSKINQAPSPPSLPVVGHLHLLKKPLHRSISLLSSRHGPILLLRFGSRPALAVSSLPLAEECLSGKNDLAFANRAHFPSTKQLLYNYSTLDSANYGPYWRMLRRISAVELLSSHRINSFSQLRSEEVHSMISTLFLESDKELNRVELKSKLFELAMNNMMRMIFGKDLASSEGAGRFREMVKESHSLLGASTRVGDFFPFLGWTDWRARRMVLRLVRRRDEFLQSLIDAHARKMEEVEEKTMIRVLVELQKSNRESNNDEEFMIKPLIISLLQAGTDTSSDTIEWAMSLLLNNRDKLKKARDEIDARVGKERLLRESDLPNLPYLQCVITETLRLYPAAPLLVPHESAEECTVGGYAVPQGTMLLVNAYAIHRDPSTWVEPEKFEPERFEDREGEGNKTLAFGMGRRRCPGEGLGIRVVSIVLGTLIQCFEWERVGEEEVDMTEGSGLTLPRANPLEAICRPRQSMISVLAGL

SEQ ID NO: 43654 - protein, 571 aa, Aspergillus oryzae
MKALECQGFDIVWSRSVERMSRKGECTLVAAEWKEWVRSEYQRAETQVKTFLLEWAQKAYDLNRPDDPNVRRVAVIGAGISGVVSTAHLVAAGFEVTVFERNQQTGGIWLYDEQTPLECSFPSPGPSLADKVEKNARFDREKLRLQHAPPGPCYKNLTTNVSTPLMRIKLRAWPENTPDFVHHSVVNEYIRDIALSTGVDERTIYGARVEHVYKNGGKWHVNWSVLDDNGSIDGLEERRLISTFDAVVVASGHYHSPHIPDIPGLSEVKKRWPSRVIHSKRYRTPEVYRDEIIQNVLMIGGGVSSMDISRDLGPFAKMIFQSTRNGDADPPALMLPDNAVRIGEIDHLELLSGTGDTLPEGDPLPLILCLKSSQRLCKIHKIIVCTGYQIVFPFLPDYHDDSMPLQDADDTILVTNGTQVHNIHRDIFYIPDPTLAFVGIPYFNTTFTLFEFQAIAVTAVWSQTACLPSTTEMRREYLVKQKQTGGGRKFHSLKDKEKEYVRDLMAWINDGRNAHGLVPIEGHTAAWFEAMDKLWDEARAAMKGRKEQQEKIIKRIPFSADCTSVELPHLN

SEQ ID NO: 43655 - protein, 469 aa, Bacillus clausii KSM-K16
MAKQNIGVVGVGVMGRSLALNLESKGFSVSLYDVSEERINEILDHNKGKRLVGTFSLEEFVHSLEKPRKIMLMVQAGQVTDQVIDSVIPLLDKKDILIDGGNTYYTDTIRRSQTAAEHGIHFIGTGVSGGEEGALKGPSIMPGGQKEAYELVKPMFEKIAAQVNGEPCTTYIGPDGAGHYVKMVHNGIEYGDMQLICEAYSLLVNVLGLNAEDLHSVFKEWNEGELDSYLIEITADIFTKVDEETGKPMVDVILDTAGQKGTGKWTSKSSLDLGVPLPVITESVFARFLSAMKEERVKASQILSGPEKKQFTGDKQELIERIRQALYFSKVLSYAQGFSQLKSMSLEMNWNLQYGEIAKIFRGGCIIRAAFLQNITDAFERDANLDNLLLDPYFENISRKYQQALREVVALAVEYGIPVPGFSSAISYYDSYRSERLPANLLQAQRDYFGAHTYQRIDKEGVFHTNWLD

SEQ ID NO: 43656 - protein, 549 aa, Solanum lycopersicum
MANRNVPIPRRQLYIGGEWREPVKKNRIPIINPATEEIIGDIPAATAEDVDIAVEAARKAIARDDWGSTTGAQRAKYLRAIAAKDLALYSLSYIEMAVPSVFEGLNSDTLLSIGVKQITNWSEMNVDDSVLEKKSVLATLESLDSGKTLYESAADMDDVAGCFEYYAGLAEALDSRRMTPVNLNSDSYKSYVLREPLGVVGLITPWNYPLLMAIWKVAPALAAGCAAILKPSELASITCLELGEICREIGLPSGALNILTGLGPEAGGPLASHPHVDKISFTGSGPTGSKIMTAAAQLVKPVSLELGGKSPIVVFDDIDNLDIAAEWTLFGIFANTGQVCSATSRLIVQENIASAFMDRLLKWTKNIKISDPLEEDCKLGPVVSAGQYEKVLKFISNAKSEGATILCGGERPQHLKKGYYVQPTIITDVNTSMEIWKEEVFGPVLCVKTFKTEEQAIELANDTKYGLGAAVMSKDVKRCERFTKAFQTGIIWINCSQPTFNELPWGGKKRSGFGRDLGKWGLENFLNIKQVTEYTSAEPLAFYKSPSKN

SEQ ID NO: 43657 - protein, 409 aa, Bacillus cereus G9241
METIVQKFGGTSVGSVERIQHVANLIIEEYERGHSIVTVVSAMGKSTDELVALANAITENPSKREMDMLLSTGEQVTISLLTMALQAKGYNAISLTGWQAGITTESVHNSARITDIHTDRIQSYLAEGTIVIVAGFQGVSENHEITTLGRGGSDTTAVALAAALNATKCDIYTDVTGVYTTDPRVVKDAYKLDEISYDEMLELANLGAGVLHPRAVEFAKNHNVILEVRSSMEQENGTIVKGECNMEQQSIVKGIAFEDNITRITLKGLEQGSLSTVFSTLAAAHINVDIIIQSITNEGTVHLSFSIHSNDLRETLEVLEQNQEALHYESVEYENHLAKVSIVGSGMVSNPGVAANMFTTLKEEDIHIKMVSTSEIKVSVVIDRLHLVTGVEALHQSFMAKIEPLVQMI

SEQ ID NO: 43658 - protein, 788 aa, Yarrowia lipolytica CLIB122
MVNTPPLPRADDIDATWKYIEDGVGQVLRDDLAHGAGLSSQMYMNLYSAIHNYCVSRDSNRSVSLASRGGVGSSTRGAQLIGADLYYKLKGFLESHLSSLEAEAQPMSGGNLLLYYIKCWDKYTVGAQYINHIFNYLNRHWVKRERDDGRKNVVDVNTMCLCAWKECFFDPLEKKVIDALLEQFTRLRNGESTGTIDIRKVVYSLVSLGLDQLDIKRVNLQVYEQAFLHPFIQHTKDYYTKESALFLQENTVVDYNRKAEQRLAEEKGRVDVYLHPSSEQRVIETCHECLIADHAEVIRSEFGSLLQGYREDDIRRVHVLLSKVDGALDPILPVFESYVKQEGENAVKQLAKDLTGTVDASTYVDTLIGVYERYVHLVEVAFSNHTSLHKVLDAACLAFINKNAIATPDSPSNKSRDSKTPELLASYCNTLLKKTTKTTEDFDLEAKLENAIVIFRFLEEKDAFQKHYTRNLARRLVYNSSASDDAERSMVNKLKNECGMEYTGKLNKMFQDISVSGELQEEFKERVQQKRQDAAASGGEANLVDFSPTIIAEGCWPLPSVKDGFRLPNDLTKTYEAFTQYYQAKHQGRKLKWLWNFTKGDVKIHTKGSKIGYSVTASIYQIAILLAYNDADVLSVADLQEITGLSNTYLHGSLHLILKSKFLLVEGVSGDPKDVELTPETRIVFNQDFKSKKIRININGVIKTEAKAEAEETKKAIEEDRKWFLQATIVRVMKARKTLKHTALVQETIVQSKKRFHPKIGEIKKVIDDLIEREYLTRIEQDKYEYAA

SEQ ID NO: 43659 - protein, 190 aa, Prochlorococcus marinus str. MIT 9303
MPSLQSVPDVTFKTRVRDESVPGPNPFRWQDLTSAEIFKGRKVVVLALPGAFTPTCSSNHLPRYEELHTELVAQGVDQIICLSVNDAFVMFQWRKHLGTKNIFMLPDGNGEFTRKMGMLVEKSNLGFGLRSWRYSMLVNDCNIEKMFVEPGFSDNADVDPFEVSDADTMLAYMKGVQPAGVSSPRRKFEG

SEQ ID NO: 43660 - protein, 168 aa, Triticum aestivum
  misc_feature (7)..(7): Xaa can be any naturally occurring amino acid
KGASQIXAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVRELDAHAVHAIKLSNAAAAEGASQSTVDAVTEAFKGLAGNKKAGVC

SEQ ID NO: 43661 - protein, 510 aa, Vibrio parahaemolyticus RIMD 2210633
MSAKKPLALVILDGYGYREDTASNAIANAKTPVMDALIANNPHTLISASGMDVGLPDGQMGNSEVGHTNIGAGRVVYQDLTRITKSIADGEFEQTPALVEAIDAAVKAEKAVHIMGLMSPGGVHSHEDHIYAAVEMAAARGAEKIYLHCFLDGRDTPPRSAENSLQRFQDLFAKLGKGRVASLVGRYYAMDRDNNWERVQVAYDLLTQAKAEFTAETAVAGLEAAYARDENDEFVKATAIKAEGQEDAIMQDGDAVIFMNYRADRARQITRAFVPGFDGFERAVFPAINFVMLTQYAADIPLATAFPPASLENTYGEWLSKQGQTQLRISETEKYAHVTFFFNGGVENEFEGEERQLVASPKVATYDLQPEMSSPELTEKLVAAIKSGKYDTIICNYPNADMVGHTGVYEAAEKAIEALDESVGKVVEAIKEVGGQLLITADHGNAEMMIDPETGGVHTAHTNLPVPLIYVGDKAVEFKEGGKLSDLAPTMLSLAGLEIPAEMSGDVLVK

SEQ ID NO: 43662 - protein, 345 aa, Vibrio parahaemolyticus RIMD 2210633
MTQANTNNAYGKDIAMTVIGAGSYGTSLAISLARNGANVVLWGHEPEHMARLEADRANHAFLPGVDFPESLIIESDLEKAVQASRDLLVVVPSHVFGIVLNSCKPFLREDSRICWATKGLEPETGRLLKDVAYDIIGENYSLAVLSGPTFAKELAMGLPTAISVASPDAEFVADLQEKIHCSKTFRVYANNDFIGMQLGGAVKNVIAIGAGMSDGIGFGANARTALITRGLAEMSRLGAALGAKPETFMGMAGLGDLVLTCTDNQSRNRRFGLALGQGQDVDTAQEEIGQVVEGYRNTKEVWMLSQRMGVEMPIVDQIYQVLYQGKDARLAAQDLLARDKKAEGK

SEQ ID NO: 43663 - protein, 445 aa, Propionibacterium acnes KPA171202
MDRQLENAYESVLRRNPGEAEFHQAVREIFESLGPVLDTNPQYVEAAVLSRICEPERQIIFRVPWVDDEGKIRINRGFRVEYSSVLGPYKGGLRFHPSVYLGTIKFLGFEQIFKNALTGMPIGGAKGGSDFDPHDASEAEVMRFCQSFMTELYRHLGEHTDVPAGDIGVGSREIGFLFGQYKRITNRHESGVLTGKGLTWGGSLVRTEATGYGTVFFVQRMLATNGKSLDGLRVTVSGSGNVAIYAIEKAQDLGATVVACSDSSGYVVDEKGIDVALLKQIKEVERARICEYAARRDSATFHSDGSIWDVPVDVALPCATQNELNGQAAATLIRNGVVAVAEGANMPCTPEAVHSFQDAGVIFAPGKASNAGGVATSALEMQQNAARDSWDFDATEARLQQIMADIHDRCIETADEYGHPGDYVMGANIAGFTKVADAVIAMGVV

SEQ ID NO: 43664 - protein, 273 aa, Vibrio parahaemolyticus RIMD 2210633
MKHCEKQKVWNKIVSEAREMSEQEPMLASFYHATIIKHESLCAALSYILANKLNTASMPAMAVREVVEEAFAADPTITDFAACDICATVNRDPAVSMYSMPLLYLKGYHALQGYRVANWLWKQGRHALATYLQNQISVACQVDIHPAARIGSGIMLDHATGIVIGETAVIDNDVSILQDVTLGGTGKECGDRHPKIREGVMIGAGAKILGNIEVGEGAKIGSCSVVLQAVPPHTTVAGVPAKIVGRPKTDKPSLDMDQGFNGKSQSFIHGDGI

SEQ ID NO: 43665 - protein, 419 aa, Neurospora crassa
MPRDPLIGLVGKPSAGKSSTLNSLTDASSKVGNFPFTTIDPQRAIGYLQIDCACARYNVSERCKPNYGSCVNGKRSVPIELLDVAGLVPGAHEGKGLGNKFLDDLRHADALIHVVDASGTTDAEGKVTRGYDPSVDIAWLRSEIVAWIKGNLWEKWGSIKRRHIAVKATAVETLQAQFSGYGSTAAVVARTLDKLGLKEPLEEWSEETVDRVVNAFTDEKFPTVIALNKIDHPDADKNIAKIAKMQDPNSIVLCSAISEIFLRKMAKQGYIKYTEGSEFVDTREDLIADGDPDGGGLKELDEKNRNRIENLKDMVLYRFGSTGVNQVLSKAAEILGLVPVFPVRNTTTFTSGANESANKAVFRDCVLVKKNSTVADVARKIMGDAPIAYVEGAGGIRVAEDQIVTVGKNDILSFRVGRA

SEQ ID NO: 43666 - protein, 337 aa, Photorhabdus luminescens subsp. laumondii TTO1
MKFLVTGAAGFIGFHVSQRLLQMGHEVVGIDNLNDYYDVNLKQARLDLLFDRSGFKFEKLDLADRIAIPDLFSRHQFQRVIHLGAQAGVRYSLQNPMAYIDSNIIGHINILEGCRHNNVEHLLYSSSSSVYGLNRKQPFSTNDSVDHPVSLYAATKKSDELMSHSYSHLYQLPTTGLRFFTVYGPWGRPDMALFKFTKAMLSGQPIDVYNHGNMVRDFTYIDDIVESIIRLQEIIPTSNEGWMVEDGQISASSAPYCIYNIGNGQPTRLGDFIEAIEESLGIQAKKNFMPMQDGDVLSTCADSSGIVQKIGFAPNTSVKQGVKQFVEWYLSFYHQSK

SEQ ID NO: 43667 - protein, 447 aa, Photorhabdus luminescens subsp. laumondii TTO1
MKVTVFGIGYVGLVQAAVLAEVGHNVLCIDIDANKVENLKNGQIPIFEPGLAPLVKKNYEEGRLNFSTDAKAGVAHGKLQFIAVGTPPDEDGSADLKYVTAVARTIAEYMDSYKVIIDKSTVPVGTADKVNAVVNETLRQRNIDIPFDVVSNPEFLKEGAAVADCMRPERIIIGCDNERVVDLMYELYEPFNRNHDRMIVMDIRSAELTKYAANCMLATKISFMNEISNLAEMLGADIEHVRQGIGSDSRIGYHFIYPGCGYGGSCFPKDVQALIRTAEQIGYQPKILRAVEQVNELQKHKLPSFVTRHFGEDLSGKTFSVWGLSFKPNTDDMREASSRVLMEALWQAGAKIQAYDPEAMQEAQRIYGQRDDLLLMGTKEAALKGADALIICTEWQSFRAPDFDVIKESLKTPVIFDGRNLYDPERLQSRGFTYYGIGRGASINPVI

SEQ ID NO: 43668 - protein, 330 aa, Photorhabdus luminescens subsp. laumondii TTO1
MPLVNEPLVEKSLVEKVSVEKTSVEKTSVEKIVKKAVIPVAGLGTRMLPATKAIPKEMLPLVDKPLIQYVVNECIAAGINEIILVTHSSKNSIENHFDTSFELEAILEKRVKRQLLDEVQSICPSHVTIMQTRQGIAKGLGHAVLCAKPLIGDEPFAVILPDVILDEYSTDLTRYNLSEMLVRYNETGASQILVEPVPHEEVSSYGIVDCQGENLQPGDSKLIKRVVEKPKPKEAPSNLSIVGRYVLSEKIWPLLAKTAPGAGDEIQLTDAIAMLIEREPVEAYHLQGVSHDCGNKLGYMQAFVRYGMKHHALGKEFTDWLVALQDQVKE

SEQ ID NO: 43669 - protein, 838 aa, Synechococcus elongatus PCC 7942
MTLTRFQPTAGNESRDQRFVLWFEEVGIDDIPLVGGKNASLGEMIRELLSKGVNVPLGFATTAAAFRFFLAGAGLEPQLRQLFADLDVEDVVNLRERGRQARNLILNTPFPAELETAIATAYQQLCDRYEPTPAVCDRLSGLDRDRCQRQFGSVDVAVRSSATAEDLPDASFAGQQETYLNVRGVQAVIQACHRCFASLFTDRAISYRQIKGFDHFEVALSVGVQKMVRSDLAASGVMFSIDTETGFRNAALVTAAYGLGENVVQGAVNPDEFFVFKPTLQQGFRPTLDKRIGSKEIRMVYDEGGSKLTKNVSVAESDRQRFAISDDEVLQLAQWACIIEDHYSAKRGCFTPMDIEWAKDGLSGELFIVQARPETVQSQRASNLLRSYQLQGSGSVLVEGRAVGEMIGQGTARVILDVHHIADFQAGEVLVTNRTDPDWEPIMKKASAIVTNQGGRTCHAAIIAREMGIPAIVGCGTATTAIATGADVTVSCAEGDQGRVYAGLLPFEVHETVLDDLPRPRTQILMNVGNPEEAFGLAAIPCDGVGLARLEFIIANHIQAHPLALLHFDQLEDLFVQDQIAKLTANYDRKADFFVEKLAQGIGRIAAAFWPKPVIVRLSDFKSNEYANLLGGRQFEPREENPMIGWRGASRYYDPQYREAFALECQAFRQVREGMGLTNVIPMVPFCRTPEEGQRVLAEMAANGLKRGENGLQVYVMCELPSNVICADAFSEVFDGFSIGSNDLTQLTLGLDRDSALVAALFDERNPAVKRMVAQAIQTVKAAGRKIGICGQAPSDYPEFAEFLVEQGIDSISLNPDSVLKTLLAIAAVEARLETGRD

SEQ ID NO: 43670 - protein, 276 aa, Triticum aestivum
  misc_feature (153)..(153): Xaa can be any naturally occurring amino acid
PRVRPRVRRYDIVNGVVEVDGVAKEPTSENAAEGGDSDAKGVPDFWLTALKTNDVLTEEIQERDEPVLKYLKDIKWSRIDDPKGFKLEFFIDTNPFFKNSVLTKSYHMVDEDDPILEKAIGTEIEWYPGKNVTQKILKKKPKKGSKNTKPITXKTEECESFFNFFSPPQVPDDDEDIDEEAADELQGQMEHDYDIGSTIRDKIIPHAVSWFTGEAVQAEDFDDMEDGDEDDDDDDDDDEEDDEDDEDEDEDDDEDEEELSKPTKKVAGKPKVQTLH

SEQ ID NO: 43671 - protein, 596 aa, Aspergillus nidulans FGSC A4
MEGFDEETFKKFFPTSFGKQEKRPDVNAQINQTRRAVKPDTSNEKTKLSDATGDYDAKSDSEGDDIGPAGPSDKVKEDSDDSDDDSDDDDDEDEFPVSHELVMKTHERAVTTITVDLSGSRLITGSTDCTIKLHDFASMTPSTIRAFKSVDPSAKKTSAAQDAHAVHYAAFNPISPAYVLVVSATPQPRILDRDGETVTEFVKGDMYLRDMHNTKGHISEVTSGVWSPTDENLCATAGTDSTVRIWDANIGRSQKEVIVHKSRVAGSAGRSKMTALAWGSPKQGGADVLVAAALDGSLMMWSGNGPYTRPSAEIRDAHARDTWTSGIDVSADGRLVITKGGDDTIKLWDTRKFKQPITTVSHPSISSRYPTSNIVFSPTSANVVTGSETGHLHILNPATLKPELVTPVTPGSPLITVQWHEKLNQILTGSANAETHVLYNPNMSTKGAALVMSKAPKRRHIDDDPTLTMNLSQGISGDSVVVGSNGVPHYSSATWSARHPTIGLTASGRSRDPRRPHLPAQTPFAKSQPDERHIRENIPLSSMRDEDPREALLKYAEKAEKDPIFTKAWKETQPKPIYRDISDDEEPEPDRKKARR

SEQ ID NO: 43672 - protein, 487 aa, Cryptococcus neoformans var. neoformans JEC21
MNQPSTLAQAHPDHPTLAELVADRPDPATATPLGHDIASPQHTTTPTSMSDADSSPASPEAPRRPGGLSEGPNARSKSVTVASGEDTFGALNCHPGPGSAAISNSNLPADSFRVGVSEDRNRRCRRTMEDAHSFVYDFAGVKGQGYFAVFDGHAGKHAAEWCGQNFHEYLLDGLLIEPDTPVPDLMNKTFHLVDKRLSHLAHAAGTSSGCTAVTAFLRVEEMDDNDSFRKGFTNPGLQPRGLWEGKGEDELESQTSLQPSSRRSSMGGGTGGQMGGASAPGVNGRTGSLARRLSSKKIRDFVKGLTGGMEKNFDEAITEDEGVISAADGTRVEAIEPKSEKGVRRVLYTANVGDARAVLCRGGKAVRLTYDHKGSDAQEAKRITDAGGFVMNNRVNGVLAVTRSLGDASMKEFVVGAPYTTETTLDEQDEFLIVACDGLWDVCSDQEAVEIVHLVTDPQEASKRLLDHAMSNFSTDNLSVMVVRFNH

SEQ ID NO: 43673 - protein, 246 aa, Vibrio angustum S14
MFSGESASGNPCGVLELDSWLSDEELQEITCKAGLPVTSFVMKDNGKFHIRWFSMDGEINLCGHGSLGAGAAIISKYKLDSVLFSSKYGNLSIAKKSGVYTLELPSWKGETCAVPSEISDLTVDAIAAFSTRDLVLVLPSIESVRSFKPDDMRFKQLSNYHALIVTAANGENGYVLRYFAPKIGISEDLATGSAQCSLAPYWFEKLNSDSLQVHQLSSSGGYFGVRRISGDSIVLLANATLREIEI

SEQ ID NO: 43674 - protein, 309 aa, Solanum lycopersicum
MVGGKNKVSKQELNGGGGVCEQGMQVTNEKGQLMKKFAIKPRGEAEESGGYMNTYSDFDSPSNSPTSHTSSVLEGNYSGTNFTGGSGSSSSSSSGGFSSSGGCCSVSMSEEDNEGDDDCLDDWEAVADALAATDKEQEQHNSSLDSAPQVHMSFQQEVSDGKVPALDTSQQNPKGRGTIPVFPVSFQAWRPDDEFRPQSLPNLSKQYTFPMNSGRHCRGGSVWGCKSAAIPTSCPICCEDLDFTDTSFLPCPCGFRLCLFCHKKILEEDGRCPACRKQYKHDTVGGETTKDAGGLMFKVARSCSMISRS

SEQ ID NO: 43675 - protein, 591 aa, Aspergillus oryzae
MASKWIEEQPVVHRRDIRISRKSRIAAGLLVLLVLWRYGLPSSIHFGFSSEESKQLGAVASEHALCSRYGADMLERGGNAADAMVATMFCIGVVGMYHSGIGGGGFMLIKSPDGDFEFVDFRETAPAAIVALGKNISAGLRSGVPGEVRGLEYLHRKYGVLPWSVVLEPAIRTARDGFLVQEDLVNYIDMAVEETGEDFLSKNPSWAVDFSPSGSRVRLGETMTRRRLAATLEKISVDGPDAFYSGPIAEDMVASLRNVGGIMTLEDLANYTVVTRDTSHIDYRGYQITSTTAPSSGTIAMNILKVLDTYDEFFTPGTTELSTHRMIEAMKFAFGLRTRLGDPSFVHGMEEYENHILSAEMIDHIRQSISDSHTQDTSAYNPDGLEVVNSTGTAHIATVDHQGLAISATTTINRLFGNQIMCDRTGIIMNNEMDDFSVPTSSLPTFGHTPSSTNFAEPGKRPLSAISPAIILHPDGSLFLIAGSAGSNWITTTTVQNIISGIDQNLAAQEILATPRVHHQLIPNHAIFETTYDNGTVDFLSQLGHEVTWYPPAASMAHLIRVNADGGFDPAGDPRLKNSGGVVALQRRKFW

SEQ ID NO: 43676 - protein, 438 aa, Aspergillus oryzae
MKSVATSSLDVDKDSVPLGSSINGTAQAETPLENVIDVESVRSHFPVLGGETAAFNNASGTVVLKEAIESTSNFMYSFPFPPGVDAKSMEAITAYTGNKGKVAAFINALPDEITFGQSTTCLFRLLGLSLKPMLNNDCEIVCSTLCHEAAASAWIHLSRELGITIKWWSPTTTPNSPDDPVLTTDSLKPLLSPKTRLVTCNHVSNVVGTIHPIREIADVVHTIPGCTLIVDGVACVPHRPVDVKELDVDFYCFSWYKLFGPHMGTLYASRKAQDRYMTSINHYFVSSSSLDGKLALGMPSFELQLMCSPIVSYLQDTVGWDRIVRQETVLVTILLEYLLSKPSVYRVFGRRNSDPSQRVAIVTFEVVGRSSGDVAMRVNTRNRFRITSGICLAPRPTWDVLKPKSSDGLVRVSFVHYNTVEEVRAFCSELDEIVTRDT

SEQ ID NO: 43677 - protein, 494 aa, Aspergillus oryzae
MANPQTTRVAVVGAGISGVLAAGHLLATGLEVTVFERNAAPGGVWYAIPFSGLLATREADAWARLYDERTPIEPSYPAMKPSKADPPATNEQETSRFMLQHAPPGPCYYNLQNNVPTPLLEVSLKPWPDGTPDTVRHDVIQRFIQDMSIEAKVHDVTRYGARVKKVVKNGAEWKITWSTPQVGLQSETSEFEQVSPFDVVIVASGHYHAPRVPDIPGLSDTKRKYGSRILHSKEYRRPENFRNKNILMIGGGVSSIDIANDISPFANTIYQSTRNSKFDLVESMLPENGVRVHEISHFEIQSHSDEPLSDDEPLPLTIHFESGQNLHGIHMIMLCTGYHITFPYLEEYHSDETTLQDADENILITDGTQVHNLYQDIFYIPDPTLVFVGLPYYTFTFSIFDFQAIVVAQVLSGTVQLPTETEMRSEYNAKVERVGLGKVFHSILGTEENYVHDLLTWVNTSRAAQELVAIKGFSPRWYEAKEALRQKYRAQVNK

SEQ ID NO: 43678 - protein, 291 aa, Nostoc punctiforme PCC 73102
MTLSIAHLGPPGTYAEQAAVLYVNWLTKSTGDEATLSPYPTISQSLHAVADGQAHLAVVPVENSIEGSVTTTLDALWQLDSLRIQLALVLPIVHTLISCASGLDKIETVYSHPQALAQCQGWLERFLPTVQIVPSNSTTEALQRLEQETTTAAIASSRAAQLYNLPILATGINDYPENCTRFWVVSQGEADAGYQTSKVPTSHTSLAFSMPANTPGALVKPLQIFAQLGINLSRIESRPTKRSLGEYLFFMDLEADVKESQMQSALAELTIHTEILKILGAYNVLPIGAFT

SEQ ID NO: 43679 - protein, 467 aa, Vibrio vulnificus CMCP6
MATGKIVQIIGAVVDVEFPQSDVPSVYDALNVKDSKERLVLEVQQQLGGGVVRCIVMGSSDGLRRGVEVVNTGAPISVPVGTKTLGRIMNVLGDAIDERGEIGAEELYSIHRPAPSYEEQSNATELLETGVKVIDLICPFAKGGKIGLFGGAGVGKTVNMMELINNIALQHSGLSVFAGVGERTREGNDFYHEMQEAGVVNIEKPEESKVAMVYGQMNEPPGNRLRVALTGLTMAERFRDEGRDVLLFVDNIYRYTLAGTEVSALLGRMPSAVGYQPTLAEEMGVLQERITSTKQGSITSVQAVYVPADDLTDPSPATTFAHLDATVVLNRNIAAMGLYPAIDPLDSTSRQLDPLVVGQEHYDTARGVQQTLQRYKELKDIIAILGMDELSESDKQVVARARKIERFLTQPYHVAEVFTGDPGVYVPLKETLRGFKGLLAGEYDDIPEQAFMYCGTIDEAIENAKKL

SEQ ID NO: 43680 - protein, 212 aa, Rhodopseudomonas palustris CGA009
MRDPVETYMNLVPMVVEQTNRGERAYDIFSRLLKERIIFVTGPVEDGMSTLIVAQLLFLEAENPKKEISMYINSPGGVVTSGLAIYDTMQFIRPPVSTLCTGQAASMGSLLLAAGHKDMRFSLPNARIMVHQPSGGFQGQATDIMLHAQEILNLKKRLNEIYVHHTGQTYKAIEDALERDKFLTAEMAREFGIVDKVIEKRPEDPAPAPKAA

SEQ ID NO: 43681 - protein, 319 aa, Staphylococcus aureus subsp. aureus N315
MRRLFSIGEALIDFIPNVTNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 43682 - protein, 176 aa, Prochlorococcus marinus str. MIT 9303
MKHTLSVLVEDESGALSRIAGLFARRGFNIDSLAVGPAETPGQSRLTMVVEGDDHALQQMSKQLDKLVNVLQVLDLTRQPAVERELMLLKVSAPAHQRSSIFDLVQVFRAKVVDVADGALTLEVVGDPGKLVALESLLTPYGIIEIARTGKVALERASGVNTELLKVSPSGSRIPA

SEQ ID NO: 43683 - protein, 305 aa, Bacillus cereus G9241
MKLCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYVAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 43684 - protein, 454 aa, Escherichia coli O157:H7 EDL933
MTMSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWMFVVALVAFMTAFNLRSLKSVANFNTVIVVLQVVLIAVILGMVVYGVFEGEGAGTLASTRPFWSGDAHVIPMITGATILCFSFTGFDGISNLSEETKDAERVIPRAIFLTALIGGMIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAAIGLIYLACVTKSFRNPVPQYEDVA

SEQ ID NO: 43685 - protein, 492 aa, Zea mays
YILIPEAKAKPCFAVGHVTFGSLEPLVRYACDPAVPYGAKPNDLYRKACGQEPLASACLAATTTTTLSGNLLVTSEAMAPMAYIAACAAALSAFVALLHWAYRWSHPRSRGRLPPGSMGIPLLGETMQFFAPNPTCDVSPFVKERVRRYGSIFKTSIVGRQVVVSADPDMNYFVFQQEGKLFESWYPDTFTEIFGRDNVGSLHGFMYKYLKTLVLRLYGQENLKAVLLAETDAACRGSLASWAAQPSVELKEGLSTMIFDLTAKKLIGYEPSKSSESLRKNFVAFIRGLISFPVNIPGTAYHECMEGRKNAMKVLKGMMKERMADPERRCEDFFDHVIQELRREKPLLTETIALDLMFVLLFASFETTALALTLGVKLLTDSPKVVDALREEHDAIAKNRNDPDAPVTWAEYRSMTFTNQVIMEMVRLANIVPGIFRKALQDVEIKVCGAGTGYTIPAGWGVMVCPPAVHLNPDIYEDPLAFNPWRWQSEVL

SEQ ID NO: 43686 - protein, 271 aa, Oryza sativa Indica Group
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKCRACFILEFTIGNHSPICLLVAVTMEGLQAEILIFNGKLHGYAFAESSEAHTKNLLFISKAMFVPMVAAEGGHRFVKRSACQKEAKDVTLW

SEQ ID NO: 43687 - protein, 311 aa, Agrobacterium tumefaciens str. C58
MQSAGGPSVLQVIKQDLHAPRAGEVRLIQDAIGLNFVDTMIRKGQYPMALPAVPGFEAAGTITEVGSGVEGLSVGDRVAYFFSEGAYATERVIPTAPLIRLPADISNETAATFLAKGATAWMGIRGLHDLKSADTVMVLGASGSVGAILSRWARSLGATVIGVAGSPGKFDKVAAGSTHAFHAGEPDIAAKIRAIAPDGVDVVYDLVGRATFALAASSVRDGGVIAAIGAATGQPAPAPDLVRRGVDVRSGGTPQYVRGPAVENATSQLWDALRSGVFDDLETTRYPFDEIARAHDDVDNRRLSGLPVLIA

SEQ ID NO: 43688 - protein, 176 aa, Methylobacillus flagellatus KT
MNIKSLIRTIPDYPKPGIQFRDITTLLKDASGLRQVVDALVERYAGAKVDKVVGIESRGFIVGAAVAYELGVGFVPVRKKGKLPGDVLGHDYALEYGTDRVEIHSDAISPDEHVLLLDDLIATGGTAEAAAILIEKLGGHVLECAFIIGLPDLGGERKLRVLGYKTFSLCQFEDSE

SEQ ID NO: 43689 - protein, 70 aa, Oryza sativa
YWARWKADHVGRCRAMPHIKTFTRYNGQDIAWFLLTSANLSKAAWGALQKNNTQLMIRSYEVDDFVPLLN

SEQ ID NO: 43690 - protein, 119 aa, Synechococcus elongatus PCC 6301
MKVGDRDQRPWGQFEILAQGSGYQVKRLEVLPGQQLSLQRHQQRQEHWLVVQGLARVQLGDRQFSLRVGQSLDIAIGEWHRLQNPGDELLALIEVQMGAYLGEDDIERRADDYGRCPTS

SEQ ID NO: 43691 - protein, 119 aa, Brassica napus
  misc_feature (46)..(46): Xaa can be any naturally occurring amino acid
GRAPRPSPSSLIILVNAGAPVDQSIADFSEYMVPGDCIIDRGNEWXQSTQRRISEADQEGLLYLGIGVSGGEERARNCPSLMPSWSSHAYDNIKHLLGKVSAQVDDWPCVTYIREGRSG

SEQ ID NO: 43692 - protein, 532 aa, Solanum demissum
MTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRLSDSAPLLDSPQNTGFDLSQSKRELQSVNSVANNESEMGRVADNSPKNEEQRPDKDQGNSFADSPGAVLVNLLTSLRHLPPAMHSVLIVMALTWVSCSLSTAANYLSFCSFNQLSWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATRSTQIAALVVFSLLGIPLAVTYSVPFSITAELTADAGGGQGLAIGVLNLAIVVPQMVVSLGAGPWDALFGGGNIPAFVLASLAALAAGIFAMLRLPNLSSNFKSTGFHFG

SEQ ID NO: 43693 - protein, 208 aa, Oryza sativa Indica Group
MATSIVDDFGDGTYTVAFDEDYIHTTVTYSGDDVDDWLDEILRIHRRRLNYLVVGLDVEWRPATYYHGPGPVAVLQICVGRRCLIFQILHADYVPDSLFDFLADGRFTFVGVGIHDDVAKLRSHHELEVENAVDLRYLAAQTIGKPALRSAGLQGLVREVMGVWAPKPYHVRVSAWDSWNLTPEQVMYACADAFASFEVGRSLYYDYD

SEQ ID NO: 43694 - protein, 208 aa, Oryza sativa Indica Group
MATSIVNDFGDGTYTVAFDEDKIYTTVTDSGEEVEDWLDEIVRIHHRRLDHLIVGLDVEWNPASGFCAPGPVAVLQICVGRRCLVFQIIHADYVPDQLGDFLGDGRFTFVGVGIHDDVDKLREHYDLEVENAVDLRYLAAQTIGKPALRSTGLQGLVWEVMDVWMEKPHHVRVSAWDSRQLTLDQVMYACADAFASFEVGRSLYDDYE

SEQ ID NO: 43695 - protein, 430 aa, Bacillus pumilus SAFR-032
MPYIVDVYAREVLDSRGNPTVEVEVYTESGGFGRALVPSGASTGEYEAVELRDGDKDRYLGKGVLTAVNNVNEIIAPELLGFDVTEQVAIDKMLIELDGTENKGKLGANAILGVSIAVARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEDMVSKYPIISIEDGLDENDWEGHKLLTERLGSKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGIETFYNLNK

SEQ ID NO: 43696 - protein, 509 aa, Vibrio vulnificus CMCP6
MSLTQQTGADYLRQILRAPVYEVATVTPLQEMPRLSARIGNNVQIKREDRQPVHSFKLRGAYNMVANLSQAQKDAGVITASAGNHAQGMALSGTRLGIETTIVMPRTTPDIKVDAVRGFGGKVVLHGSNFDEAKAEAERLSQEKGYTFVPPFDHPLVIAGQGTIGMEMLQQNGHLDHIFVPVGGGGLAAGVAVLVKQLMPEIKVIAVEPEDSACLKAALDAGEPVVLDQVSMFADGVAVKRIGDETFRLCQHYIDDHVTVSSDEICAAVKDIFEDTRAIAEPSGALALAGLKKYAEKHKLKGHNLGTVLSGANTNFHGLRYVSERCELGEKREGLLAVTIPERKGAFFEFCHLIGGRAVTEFNYRYNDDSLANIFVGVRLQNGQEELDGIIRDLREGGYPVVDLSEDEMAKLHVRYMIGGKPSKPLKERLYSFEFPEYPGALLKFLSTLGTHWNISLFNYRNHGADYGRVLCGFELDESDLSRFSAHLRELGYQCKDVTDNPSYRFFLS

SEQ ID NO: 43697 - protein, 511 aa, Bacillus pumilus SAFR-032
MSKKPAALIILDGFGLRGETVGNAVAQAKKPNFDRYWNEFPHQTLTASGEAVGLPQGQMGNSEVGHLNIGAGRIVYQSLTRVNVAIRDGEFEKNETFLEAMTYAKENDKALHLFGLLSDGGVHSHIQHLFALLKLAKKEGLTKVYIHGFLDGRDVGQKTAKVYLKQLEEQIKEIGVGEVATLSGRYYSMDRDKRWDRVEKAYRAMAYGEGPSYQNIYDVVDDSYENGIYDEFVIPSVITRENGEPVAKVNDGDSVIFYNFRPDRAIQISNTFTNEDFRSFDRGEAHPKNLHFVCFTHFSETVDGYVAFKPVNLDNTVGEVLAQNGLKQLRIAETEKYPHVTFFMSGGREEEFPGEDRILINSPDVATYDLKPEMSAYEVKDALVADINADKHDAIILNFANPDMVGHSGMLEPTIKAIEAVDECLGAVVDAILAKGGHAIITADHGNADVLITEEGKPHTAHTTNPVPVIVTKKGATLREGGILADLSPTLLDLLGVEKPKEMTGTSLIQK

SEQ ID NO: 43698 - protein, 298 aa, Synechococcus elongatus PCC 6301
MDRQGKAMSERAIAHLGPVGTYAEMAALRFQAWLTQQDQQPSRLLACRSIPATLQTLADGAVDYAVVPVENSVEGSVAATLDSLWQLPQLSIQRALILPIAHALISFESDRTAIRQVLSHPQALAQCQQWLQRHLPQAELIPANSTTEALQDLERHPQRAVIASTRAAELYQMPIQSFPINDSPDNRTRFWVISRSPTPGGACTSLNFSLDANVPGALVKPLQTLADRRINLSRIESRPTKRSLGEYLFFLDLKADLRDPAIAAAVQAVADCTEQLRVLGSYDSLDFTQSVLVPAQAR

SEQ ID NO: 43699 - protein, 253 aa, Bacillus pumilus SAFR-032
MRKPIIAGNWKMNKTLGEAVSFVEEVKSSIPYPDKVEAIVCAPALFLEKLNSLSNGTDLKIGAQNMHFEENGAFTGEISPAALKDLGIGYSVIGHSERREFFAETDETVNKKAHAAFKHGIVPIICVGETLEEREAGKTNELVADQVKKALAGFTTQQVAESVIAYEPIWAIGTGKSSTAKDANDVCAHIRQTVASEYGQEAADSLRIQYGGSVKPANIKEYMAESDIDGALVGGASLEPQSFVQLLEEGQYE

SEQ ID NO: 43700 - protein, 408 aa, Aspergillus oryzae
MPSKRKCLGVDCHNEAEALQCPTCLKLGMKDSYFCSQDCFKKNWAEHKTVHKTAQGKTQNGDLRLMIHSKIVTEPDPATGLYNPFPTYSFTGSVRPVYPLSPMRTLPTSIKRPDWSETGIPKGERRLHRSKIDILDAKGQEAMRKVCRLAREVLDITAAEVRPGITTDYLDEVCHKACIERNVGATCTLAYPSPLNYNHFPKSLCTSPNEVVCHGIPDQRILLDGDILNLDISIYHGGYHADVNETYYVGDRAKADPDSVRVVETTRECLDMAIELVKPGTLLRDFGKVIEKHAKSRNCSVHTTWGGHGINTEFHPPPWIPHYANSKVPGVCKPGMTFTIEPILTLGKPREIYWPDDWTNVTVDGKRTAQFEHTLLVTETGVEVLTARLEDSPGGPIPIPTTDNGNSA

SEQ ID NO: 43701 - protein, 394 aa, Bacillus pumilus SAFR-032
MNKKSVKDIDVKGKVVFCRVDFNVPMKDGKVTDDTRIRAALPTIEYLTGQGAKVLLASHLGRPKGQVTEELRLTPVAKRLQELLGQEVKKADEAYGDNVKKQISDLKDGDVLVLENVRFYPGEEKNDPELSKAFADLADVYVNDAFGAAHRAHASTAGIAAYLPAVSGFLMQKELEVLGKAISNPDRPFTAIIGGAKVKDKIGVIESLLDKVDNLIIGGGLAYTFVKALGHEVGKSLLEEDKVDLAKSFMDRAKEKGVNFLIPTDVLVADDFSNDANTSIVPISEIPSDLEALDIGTETREKYADVIKNSKLVVWNGPMGVFEIDAFAKGTKAIAEALAEAKDTYSVIGGGDSAAAVEKFGLADQMSHISTGGGASLEFMEGKELPGVTALNDK

SEQ ID NO: 43702 - protein, 478 aa, Bacillus licheniformis ATCC 14580
MAKEKDAEQKSALNIIPLAVTILVGAVIWFIPSPAGLDPKAWHLFAIFVATIIGFISKPLPMGAIAVFALAITALTGTLSIEETLSGFGNKTIWLIVIAFFISRGFIKTGLGARIAYLFVRMFGKKTLGLSYSLLVSDLILSPAIPSNTARAGGIIFPIIRSLSETFQSTPKDGTERRIGAFLLKVGFQGNLITSAMFLTAMAANPLIAKLAHDVAGVNLTWTSWAVAAIVPGLVSLIITPLVIYKLYPPEVKKTPDAAKIATEKLKEMGPFKKSELSMVAVFLLVLFLWIFGGNLNIDATTTALIGLAVLLLTQVLTWDDIKKEQGAWDTLTWFAALVMLASFLNELGMVGWFSDAMKSYVSGFSWISAFLILIAVYYYSHYFFASATAHISAMYSAFLAVIIAAGAPPLLAALSLAFFSNLFASTTHYGAGAAPVFFGAGYIPQSKWWSIGFILSIVHIVTWLVVGGLWWKLLGIW

SEQ ID NO: 43703 - protein, 335 aa, Bacillus pumilus SAFR-032
MAVKVGINGFGRIGRNVFRAALNNPEVEVVAVNDLTDANMLAHLLQYDSVHGKLDAEVSVDGTNLVVNGKTIEVSAERDPAKLSWGKQGVEIVVESTGFFTKRADAAKHLEAGAKKVIISAPANEEDITIVMGVNEDKYDAASHDVISNASCTTNCLAPFAKVLNDKFGIKRGMMTTVHSYTNDQQILDLPHKDYRRARAAAENIIPTSTGAAKAVSLVLPELKGKLNGGAMRVPTPNVSLVDLVAELNQDVTAEDVNAALKEAAEGELNGILGYSEEPLVSGDYNGNANSSTIDALSTMVMEGSMVKVISWYDNESGYSHRVVDLAAYIAKQGL

SEQ ID NO: 43704 - protein, 217 aa, Moritella sp. PE36
MNQSLLSPFGDAITRVETALTALRLGKGVLVVDDEDRENEGDMVYAAESLTNEQMALLIREGSGIVCVCLPDERVKQLELAPMVENNSSQYGTAFTVSIEAAVGVTTGVSAADRVTTIKAAIADGAVPNDLARPGHVYPLRAQPGGVLTRRGHTEGTIDLMKLAGLKPAGVLCEVTNPDGTMARLPEIITFGEKHDLPVLTIEDIVTYRNALLEQVS

SEQ ID NO: 43705 - protein, 501 aa, Glycine max
MARKMLIDGEAELAQGGGEEVSNFDFDLFIIGAGSGGVRAARFSSNFGAKVGICELPFHPISSETIGGVGGTCVIRGCVPKKILVYGASFGGDLEDARNYGWELSEKVDFNWKKLLQKKTDEINRLNGLYKRMLSNWGVKLFEGEGKIVGPNEVEVTQLDGTKLSYTAKHILIATGSRAQRPNIPGQELGITSDEALSLEDLPKHAVVLGGGYIAVEFASIWRGMGSTVDLVFRKELPLRGFDDEMRAAVARNLEGRGINLHPRTNLTQLIKTEDGIKVITDHGEELIADAVLFATGRAPNSKRLNLETVGVELDNTGAIKVDEYSRTSIPSIWAVGDVTNRMNLTPVALMEASYFAKTVFGGQTIKPDYSNIPYAVFSIPPLSVVGLSEEQAIEQTNGDLLVFTSTFNPMKNTISGRQEKTVMKLVVDAETDKVLGASMCGPDAPEIMQGIAVALKCGATKAQFDSTVGIHPSAAEEFVTMRSVTRRVAGTGSVKPKTNL

SEQ ID NO: 43706 - protein, 425 aa, Rhodopseudomonas palustris CGA009
MSHASPVWHPFTQHAVQGDTPTIVHSEGAWLQADDGRRIFDAISSWWVVTHGHRHPTIISAIKQQSDQLDQIIFAGFTHPPAEQLAQRLVEITPPELTHVFFSDSGSTSVEVGLKMALGYWLHSGESRRRILALEGAYHGDTIGGMSVGERGVFNAPYDPLLFDVSRLPFPRAGAEQATLDALEQACRNEAVAALIVEPLVLGAGGMLIYPPWVLAEMARICKAHGLLLIADEVMTGWGRTGTLFACEQANVVPDIACYSKGLTGGSVPLAVTMCRREIFDAHFSTDRRKTFFHSSSYTANPIACAAALANLQVWASEPVRQRIDDLAAVHARALNRFRDDARFSNVRQIGTIAAVDLQVGDSGYLADVGPRLYAYFINRGLLVRPLGNTIYLMPPYCSTAVEIEAVYEAIAAVPEVLARGSDAG

SEQ ID NO: 43707 - protein, 294 aa, Bacillus cereus G9241
MNYEEILKVKRWPKDTIAAGRGHTVALKSDGTVVAVGRNKEGECNVSSWCDIEAVAAGNVHMATNTGNAHTMALKSNNTVEAVGWNKHGQCDVNDWHNIVAVAAGWRRTIGLKLDGTVMAVGRNKEGECNVSSWRNIVATAAGDWHTVGLKVGGTVMGVGNNRYGQCDVSSWRDIVAVAAGYLHTVGLKVDGTVIAVGNDKHNQCDVSGWRGIVAIAAGTNHTIGLKSDGTVVAVGWNEYGQCNISDWRDIVAIAAGCAHTVGLKLDGTVVAVGDNTYGQCDIGSWRNIRLPVK

SEQ ID NO: 43708 - protein, 632 aa, Klebsiella pneumoniae subsp. pneumoniae MGH 78578
MAIEIKVPDIGADEVEITEILVKVGDKVEAEQSLITVEGDKASMEVPSPQAGVVKEIKVSVGDKTETGKLIMIFDSAEGAAAAAPAQEEKKEAAPAAAAPAAAAAAKEVHVPDIGGDEVEVTEIMVKVGDTIAAEQSLITVEGDKASMEVPAPFAGTVKEIKINTGDKVSTGSLIMIFEVAGAAPAAAPAQAAAPAAAAPAAAAGVKDVNVPDIGGDEVEVTEVMVKVGDKVAAEQSLITVEGDKASMEVPAPFAGTVKEIKISTGDKVKTGSLIMVFEVEGAAPAAAPAQAAAPAPAAAPAQAAKPAAAPAAKAEGKSEFAENDAYVHATPLIRRLAREFGVNLAKVKGTGRKGRILREDVQAYVKEAVKRAESAPAAAAGGGIPGMLPWPKVDFSKFGEVEEVELGRIQKISGANLSRNWVMIPHVTHFDKTDITDLEAFRKQQNAEAEKRKLDVKFTPVVFIMKAVAAALEQMPRFNSSLSEDGQRLTLKKYINIGVAVDTPNGLVVPVFKDVNKKSITELSRELTTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 43709 - protein, 474 aa, Klebsiella pneumoniae subsp. pneumoniae MGH 78578
MSTEIKTQVVVLGAGPAGYSAAFRCADLGLETVIVERYSTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKSVPKRMLVMGGGIIGLEMGTVYHALGSEIDVVEMFDQVIPAADKDVVKVFTKRISKKFNLMLETKVTAVEAKEDGIYVSMEGKKAPAEAQRYDAVLVAIGRVPNGKNLDAGKAGVEVDDRGFIRVDKQMRTNVPHIFAIGDIVGQPMLAHKGVHEGHVAAEVISGLKHYFDPKVIPSIAYTEPEVAWVGLTEKEAKEKGISYETATFPWAASGRAIASDCADGMTKLIFDKETHRVIGGAIVGTNGGELLGEIGLAIEMGCDAEDIALTIHAHPTLHESVGLAAEVFEGSITDLPNAKAKKK

SEQ ID NO: 43710 - protein, 525 aa, Chlamydia trachomatis D/UW-3/CX
MMGKGFLDCESLVALQEMALHPIDLTASGCLSEERIQKNSLSAEGFTYSYATERVDDRCLEALQGLTEERELIKQMECMQQGAIMNRIEGFQSESRPVLHTATRAWVRDQDLHEEAAAIARHSKEEALRLAEFLYIARAKFSTLVQMGIGGSELGPKAMYFAMQGSCPSDKRIFFVSNIDPDNAAEVLREIDLEQTLVVVVSKSGTTLEPAANEELFRQAYQNKGLSIAEHFVAVTSQGSPMDDKSRYLEVFHLWDSIGGRFSATSMVGGVVLGFAFGYEAFIEFLQGAAAIDAHALTPKMRENLPLLSAMLGVWNRNLLGYPTTAVIPYSTGLKYFTAHLQQCGMESNGKSISREGKEISFRTSPIIWGDVGTNCQHSFFQSLHQGTDIVPVEFIGFLHNQRGLDCVLSGSSSSQKLFANLVAQSLALAQGRDNANSNKRFKGNRPSSILVAQQLSPRIAGSLLAFYEHKFAFQGFCWGINSFDQEGVSLGKELATQIIGIMSGNAPVEFSEARGMLRLFNVLT

SEQ ID NO: 43711 - protein, 533 aa, Oryza sativa Indica Group
MAADTSKPFFPAAPNPALLPSGRKPSRLSPEASYWRSFRASELTPANEFNVTHLAFSPSSAPTLAASWSTSVLLFSGDPLSPLPRIPASQDVAFSPSFRSDGSLLAVGDKKGVVRVFRADKKQSSGALRTLTAHTAETRVVRYPVAGGDKVHLFTAGDDALLAYWDVPSETPVFAAPAAHRDYIRAGAASPADHNIFATGSYDRIVKLWDARMGKTSTLSFSHGELVESVLFLPSGGLLATAGGNVVRIWDVIGGGRLLHSVESHVKTVMALALAKMTNTGETRLLSAGSDGYVKSFDYGELKLTHSMRYPKELLSLACSPCGTVLVAGSSKGTIYMGRRKKKSTGEDEEEGKGVGGELDWAPTKPEKRRLAPSNYRYFLRGQNAKAKEGDLVIEKPKKVKVAEHDKLLRKFRHKDALVSALARNNPRSIVAVMEELVSRRKLVRCIENLDTEELVLLLLFLHRNATLPRYARFLMGVANKVLEMRAEDIRSDENLRGCVRNLKRMAAEEIQIQHTLQGIQGMISPMLALASR

SEQ ID NO: 43712 - protein, 261 aa, Arabidopsis thaliana
MAANFWNSSHYKQLLDPEEVDVVHDLDKERGISIDDFKLIKFHMSNHIMKLAQHIKVRQRLVVATAITYMRRVYIRKSMVEFEPRLVALTCLYLASKAEESIVQARNLVFYIKRLCNIFFFCYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 43713 - protein, 1150 aa, Desulfitobacterium hafniense Y51
MKEVTKQQRIRVTVNGRQMEVYGDLTILQALLQEDIHIPHLCYDIRLERSNGNCGLCVVELGEGSEQQDVKACHTPIQEGMIIHTNSPRLEHYRKIRLEQILADHNADCVAPCVMTCPANIDIQSYLSHAGNGNFETAIKVIKERNPFPIVCGRVCPHPCEAQCRRNLIDEPVAINHVKRFIADWDIAHEQPWAPRKKAATGKKIAVVGAGPSGLSAAYYSAIQGHDVTVFERHPRAGGMMRYGIPEYRLPKETLDREIGLIADLGVKIMTNKALGTHIRLEDLHQDFDAVYLAIGSWRATPLQIEGDNLEGVWLGINFLEQVTKGADIKLGEHVVVIGGGNTAIDCARTALRKGAGSVKLVYRRTREEMPAESYEVEEAIHEGVEMYFLTAPHKIVAEGRRKLLHCIKMTLGEPDRSGRRRPIPIEGSETAFEADTIIGAIGQSTNTQFLYHDLPVKLNKWGDIEINGKTMQTSEMNIFAGGDCVTGPATVIQAVAAGRHAAEAMDSFLMKGYVKEQPVDYSCSRGSLEDLPQWEFEKIPRLKRAPMPALPPAERRDNFREVETGLSEETARAEARRCLKCGCYERYDCDLRQEASLHHIEFKKPVHERPYIPIVEDHSIIIRDHNKCISCGRCIAACAEVEGPDILSFYMKHGRQLVGTKSGLPLDQTDCVSCGQCVNACPCGALDYRSEIGRVFRALNDLGKTTVAFVAPAVRSVVSSQYGVSYQEASRFIAGLLKKIGFDKVFDFTFAADLTIVEETTEFLTRLQSHKRIPQFTSCCPGWVNFVERRYPEIIPYLSSCKSPQMMMGATVKNHFTELSEIDPKDLYVVSIVPCIAKKYEAARPEFATDGIRDVDAVLTSTEMLEMADIKLIEPADVESQDFCEPYKRVSGAGILFGASGGVAEAALRMAVEKLTGEAITDRLDYQEVRGLQGIKEAAVEAKGKKVNVAVISGLHNVEPILEKIIQGTEVGYDLIEVMACPGGCICGAGHPVPEKIDTLEKRQQVLVNIDQTSRYRKSQENPDILRLYDEYYGEANSPLAHKLLHTHYEAVKREPVAKHDRRMADSAFVTHELTLCTCDKCTAQGSRELFAALSGKIRKLKMDSFVTARTIRLKENHPGQGVYAAIDGERIDTPSEQLEQRIFQQLIR

SEQ ID NO: 43714 - protein, 344 aa, Arabidopsis thaliana
MLQKISQSISLCNGDQFKPLIYLAGAPTNFISSPLSGKKKSSSLRIKRIQQLQSTLEDRINPPLVCGTVSPRLSVPDHILKPLYVESSKVPEISSELQIPDSIGIVKMKKACELAARVLDYAGTLVRPFVTTDEIDKAVHQMVIEFGAYPSPLGYGGFPKSVCTSVNECMFHGIPDSRPLQNGDIINIDVAVYLDGYHGDTSKTFLCGDVNGSLKQLVKVTEECLEKGISVCKDGASFKQIGKIISEHAAKYGYNMERFIGHGVGTVLHSEPLIYLHSNYDYELEYMIEGQTFTLEPILTIGTTEFVTWPDKWTIVTADGGPAAQFEHTILITTTGAEILTISS

SEQ ID NO: 43715 - protein, 372 aa, Agrobacterium tumefaciens str. C58
MTQPATAAVLEEKNGRFILREVKLEAPRPDEVLIRMVATGICATDAHVRQQLMPTPLPAILGHEGAGIVERVGSTVSHLKPGDHVVLSYHSCGHCKPCMSSHAAYCDHVWETNFAGARLDGTIGVAAPDGNTLHAHFFGQSSFSTYALAHQRNAVKVPDDVPLELLGPLGCGFQTGAGSVLNALKVPVGASIAIFGVGAVGLSAIMAAKVADAAVIIAIDVNTERLKLASELGATHCVNPREQADVASAIRDIAPRGVEYVLDTSGRKENLDGGIGALAPMGQFGFVAFNDHSGAVVDASRLTVGQSLIGIIQGDAISGLMIPELVGLYRSGRFPFDRLLTFYDFADINEAFDDVAAGRVIKAVLRFPPQAA

SEQ ID NO: 43716 - protein, 136 aa, Brassica napus
MSNDKDSFNVGDLTAALKDEDRAGLVNALKNKLQNLAGQHSDVLENLTPKIRRRVEVLREIQGKHDEIEAKFREERAALEAKYQKLYQPLYTKRYEIVNGAIEVEGAQEDVKMDQGEEKTAEEKGVPSFWLTALKN

SEQ ID NO: 43717 - protein, 168 aa, Avena agadiriana
VMASSATTVAPFQGLKSTAGLPVSRRSSGSLGSVSNGGRIRCMQVWPIEGIKKFETLSYLPPLSEEALLKQIEFLIRSKWVPCLEFSKVGFIFREHGSTPGYYDGRYWTMWKLPMFGCTDASQVIKEVEEVKKEYPDAYVRIIGLDNIRQVQCVSFIAFKPPGCEESG

SEQ ID NO: 43718 - protein, 562 aa, Vibrio angustum S14
MNNDKRPLYIPYAGPALLETPLLNKGSAFSVEERMFFNLEGLLPEAIESIEEQTERAYQQYRKFENDMDKHIYLRNIQDTNETLFYRLVENHITEMMPIIYTPTVGSACEDFSNIYRRGRGLFISYPNRDRIEDMLNNASRQNVKVIVVTDGERILGLGDQGIGGMGIPIGKLSLYTACGGISPAYTLPVVLDVGTNNPQRLSDPMYMGWRHTRISGKEYDAFLEEFIQAVKQRWPEALIQFEDFAQKNAMPLLERYKNKVCCFNDDIQGTAAVTVGSLLAACKAAGTKLSEQRVTFLGAGSAGCGIAEAIIAQMVSEGISDAQARSQVFMVDRWGLLIDKMPNLLNFQQALVQKKEQLVDWDVTENNISLLDVMRNAKPTILIGVSGVPGLFSEEVIREMYAHCERPIIFPLSNPTSRVEATPFDIIRWTDGNALVATGSPFEPVIYEGKTYPIAQCNNSYIFPGIGLGVLAVNARRVTDEMLMESSRALAECSPLAIHGDGALLPPLEDIQKVSRKIAFAVAKKAVEQHKAPKNSDERIREKIDANFWKSEYRRYKRTSF

SEQ ID NO: 43719 - protein, 180 aa, Zea mays
MECVQKFMHADWVWALALRGNTIASTTGINAYVWDIRDDNLTSLISNAHVGSTYSIAWTHLADVLFTGGEDGAIRLFNVSDVSDDEEDIKPVATWVPHSASSGGRIALIDLRKLPTPKRSSKDRIVSAGEDGSVRIWNFSEALDIERRAQALRSLRQENRMRRRKAQCVLIKSKIRPSNL

SEQ ID NO: 43720 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEDVKKKYPDAYVRIIGFVNIRQVQCVSFIAFKPPGCEESG

SEQ ID NO: 43721 - protein, 420 aa, Aspergillus oryzae
MSSTLPTFGTVLVAAGTGTRAGNAKCSKVYRELAGETVISRVVRAFRAWDPGHPIVIVRHENDAALLANAIEGADGQVYETVGEATRQASVLEGLIFLSSLEQPPSHVLIHDAARRFISPSLLDKTRHGMREQPDVGIILAIPVSDTIKSVDENGLISRTVPRKGLYRAQTPQAFSLPTALKIHDQLAYDTSVEYTDDASLFEQAGLSVRVIQGEEKNMKLTYPTDFEQAERILQAKPRLPEVSIPDVRVGHGYDTHRLSPATEITLCDVKIPHTSGLLGHSDADVGLHAVTNALLGTIGADDIRSHFSPSDPKWKGASSDQFVRHARKLVSDADGVITHGDVSLICERPKIGPHRDALKTSVARILSLDKSRVSIKAGTNEKVGFVGREEGIIGFATVTAVFPGGVPQAEINPDYDTTY

SEQ ID NO: 43722 - protein, 168 aa, Avena clauda
VMASSATTVAPFQGLKSTAGLPVSRRSSASLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 43723 - protein, 327 aa, Oryza sativa Japonica Group
MSAPAGLRQHCALGRAIAVVAICLLVIVGTYLLSSPAAGDGDTEEEFFSVDAGDDDLEAAVRGAAYANGTLIVSVLNRAYADEDGGLLDLFLRSMREGEGTEQLIAHVLLVAMDRPAFLRCRRLGGVRCYQLPAAQDGADDLSSEQLYMSDGFIRMMWRRIRLLGDVLKLGYSFIFTDLDVMWLRNPLSRLEYRAEEEDLLISSDQFNGRPGDIAGNELNTGFFFVASNNRTAALFDEWHAARDRSAGMKEQDVLNDMKRRGALRRLGDSRDAREVATVHANCCRTMRAKVADLAAVLAAARRRLDGDGASPVLRWPPHSQCVKSWE

SEQ ID NO: 43724 - protein, 712 aa, Oryza sativa Japonica Group
MAKMMLYLLLLPLLLLTCIFASYVHSMESSTSKCSNIPIPYPFGILGGNPAPAQGFEITCASSGPMVRINNIMFGILNISLLDGFVSILASATSQQCKRNSSFSLEGTNFTFSDTRNKFTALGCDMVAMLLNGSSGYSGGCASFCSTKSNIIDGMCSGVACCQAPVPKGLKKLELEFTNITGQLSRPKEVNNTPTCGEAFIVEQNSYVFSSVDLSNTNRNNPQYRPVVLEWSIDGGYCEEANRFMSYACKENSYCYNSSNGIGYRCNCSLGFQGNPYLQGPDGCQDIDECTIKRPCTHKCINTKGSFYCMCPAGMRGDGLKEGSGCNGIGTLLIGIVTGLALLLLLLVLIFWTHWLVKKRKLAKIRQRYFMQNGGMLLKQKMFSQGAPLRIFTSSELEKATNSFSDDNIIGRGGFGIVYKGILSNQMVVAIKKAQRVDQNQMEQFINELVILSQVNHKNVVQLLGCCLETELPLLVYEFITNGALFSHLQNTSVLISWEDRLRIAVETASALAYLHLATKEPIIHRDVKSSNILLDENFTAKVSDFGASRPIPHNQTHVTTLVQGTLGYMDPEYFQTSQLTEKSDVYSFGVVLIELLTRQKPISDGRTDDVRNLACHFSMLFYQNQLLEIVDSQVAEEAGTKHVKTVAQLALRCLRSRGEERPRMIEVAIELEALRRLMKQHLVLQTEEDPLLCESGQHADVNIEASSEFEP

SEQ ID NO: 43725 - protein, 471 aa, Bacillus pumilus SAFR-032
MQEQHNELERSMKSRHLFMIALGGVIGTGLFLGSGLIIHQAGPGGAILSFIIGGFLMYLVMLCLGELAVAMPTAGSFQEYATKYIGPSTGFMIGWLYWFSWACTIGLEFTSAGILLQRWFPDIPVWLWCLAFSVILFAVNAISARSFAETEFWFSAIKVAAILLFIIIGIGAIFGMIHLKGGEPAPLFHHLTDHGGLFPNGVFAILLTMVTVNFSFQGTELVGIAAGESESPEKTLPRSIRNIIWRTMVFFVLSIAVLAALLPWQTAGAVDSPFVVVLDKVGIPYAADIMNFIIITAVLSVANSGLYASSRMLWSLSKDGKGPDFTKKLSKRKIPINALLVTMGVSALSLLTSVVAPKTVYVWLISISGMVLVVVWMSICLSQYFFRKQFIKDGGDVKDLVFRTPLYPFVPLAGFIAFGIVLISLFFIEEQRIGLYCGVPFMAACYIIYYLKIKPKEEAKRFAEEEGIPKT

SEQ ID NO: 43726 - protein, 504 aa, Solanum tuberosum
MSSRGGGIAESPYLRNYRVGKTLGHGSFGKVKIAEHLLTGHKVAIKILNRRKMKTPDMEEKLRREIKICRLFVHPHVIRLYEVIETPTDIYVVMEYVKSGELFDYIVEKGRLQEDEARKIFQQIIAGVEYCHKNMVVHRDLKPENLLLDARRNVKIADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVPDIRQHQWFKIHLPRYLAVPPPDARQHLKKLDEEILQQVSRMGLDRDQLLDSLQKRIQDDATVAYYLLYDNRSMASSGYLGAEFQESVDCYSPGLFPNLDLQLSTGNGVSEESLRRPFRKEKMWLVGLQSPANPKEIMNQVLGTLLELNVRWKKIGHYNMKCLWCHDLHLHSMANNHMNDDDHFISNATAISTHLQPQPTVKFEMQLYKTEDEKYLLDLQRISGPQFLFLDFCAGFIRQLEGPQ

SEQ ID NO: 43727 - protein, 468 aa, Coprinopsis cinerea okayama7#130
MSTPHVIASSSSHPTHSNSGNGIVGNHYRVGKKIGEGSFGVVFEGTKLVSNTPVAIKFEPRKSDAPQLRDEFRSYRTMNGTLGVPQVHYFGQEGLHNVLVIDLLGPNLEDLFDIKTANVIHIIDFGMAKHYRDPKTKVHIPYRERKSLSGTARYMSINTHLGREQSRRDDLESLGHVFMYFLRGGLPWQGLRAATNKQKYEKIGEKKQTTPIAELCEGFPEEFTIYMNYVRKLGFEETPDYDFLRDLFTKVLKTLGEPEDGVYDWMLLNNGKGWEAGNPHSSSAQRDREREHRRERERERRARQPQQDGTTPNGLLISPAPAHMKSRSRQAGERHRDPGSAQPIPPNSRRGSQQRDLNSSIPTPHPYATAPSPNGYRSSTAQYGRHSPNPQTQHANGLPNGSESFLYGQGQPNKYGSTSRDGIATPRDGYGGTKSMGVYDRDQMRRGNDDDGHGGKRRGFWAALCCRA

SEQ ID NO: 43728 - protein, 380 aa, Glycine max
LLVVLSLIVSLLGNLGNKRSSPDYDDEDYDNDPFAPKKAITKAEEASGVTTGMILSLRESLQNCKDTLATCQNELEAAKSEIQSWHSTLKNQPSILAGITPEPKMLINYLQALKSSEESLREQLEKAKKKEAAFIVTFAKREQEIAELKSAVRDLKVQLKPPSMQARRLLLDPAVHEEFTRLKNLVEEKDKKVKELQDNIAAVSFTPQSKMGKMLMAKCRTLQEENEEIGNQASEGKMHELGMKLALQKSQNSQLRNQFEGLQKHMEGLTNDVERSNEMVLMLQEKLEEKDRQIQRLKHEIKQKNLEDQRLKHELQQKNLEDQRLKHELPFKHNKVGTWTIWPGRPPTTFDWFFFFGIMGIHRFFPAGTKINIFPNRGVF

SEQ ID NO: 43729 - protein, 475 aa, Geobacter sulfurreducens PCA
MAKRYKVLVGGEWTGDDRPGIEVVNPYDDSVIGVVPEATNEDVDHAIRAAQAGFAEMSALPAYRRSDILDRTSELIKRDREEIAEIIAREAGKSWKFALAEADRSAETFRFASLEARNAHGEIVPMDASPVSAGRFGFYLRTPIGVIGAIAPFNFPLNLVAHKVAPAIAAGNAIVLKPATKTPLSSIKLAELMVEAGLPAGALNLVIGSGRTVGNRLVEDDRLAMVTFTGSPPVGVQIKERSGLKRVTLELGSNSPTIIEDDGDVDAAVARCVVGSFANSGQVCISVQRIFVHQRRYREFVDKFVAATQKLKVGDPMDRDCDIGPMISREELQRAVEWLGEATSLGARLETGGTVAGNCLTPAILSGVTPDMKVVCSEVFAPIVSVIPYETFDQALDMADDSIYGLQAGVYTSDINKAFKAIRRLDVGGVIINDIPTFRVDHMPYGGNKQSGLGREGIRYAMEEMTNIKFVCLNL

SEQ ID NO: 43730 - protein, 476 aa, Nostoc punctiforme PCC 73102
MRRTKIICTVGPATSAPENLRGLVEAGMNVARLNFSHGAYEFHAQTAHYLRQISNEQQKPIAIMQDLCGPKIRLGTLPPEGLNLEAGTEVTFVLQEKGESIDELPLPLPTLFAMVRPGEPILINDGRVKLIVTDRDADRIRAQVKTGGLISTHKGVNLPQTPLPVSSITEKDLLDLRFGIQLGVDWVAVSFVQSPQDLEPAKRMIEAAGASIRLIAKIERAEALENFDSILKVADAIMIARGDLGVEVPIHEVPLIQKDIIRRCNRAGKPVITATQMLESMISAPDPTRAEATDVANSILDGTDAVMLSGETAVGQYPIAAVQMMHNIAVRTEQALDEGSKHAWCHEAGSLSVTESVAESVCRIAYETGSRAILCNTSSGNTARMVSKYRPTSPIIALTSDITAYRQLALSWGVEALLIPPVHHAEEMFTNVVNTVVDMGLANKGDKVVITSGVPIGKSGTTSLIKVHSIGQPISA

SEQ ID NO: 43731 - protein, 552 aa, Solanum demissum
MTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVNIDNPAIAEYLYRSFTTDNVFLTLCTLVTLYFANEVPLSPKQYKRLSDSAPLLDSPQNTGFDLSQSKRELQSVNSVANNESEMGRVADNSPKNEEQRPDKDQGDSFADSPGAVLVNLLTSLRHLPPAMHSVLIVMALTWVSCNLSTAANYLSFCSFNQLSWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATRSTQIAALVVFSLLGIPLAVTYSVPFSITAELTADAGGGQGLAIGVLNLAIVVPQMVVSLGAGPWDALFGGGNIPAFVLASLAALAAGIFAMLRLPNLSSNFKSTGFHFG

SEQ ID NO: 43732 - protein, 137 aa, Geobacter sulfurreducens PCA
MERTFAIIKPDAVERNIIGKILEKVETAGFRIVGMKKILLSKCEAEGFYYVHKERPFFNDLCSFMSRSPVVVMVLERENAINTWREVMGATNPANAEAGTIRKDFGLSIEENSVHGSDSPESAAYEIPYFFSQLELL

SEQ ID NO: 43733 - protein, 378 aa, Zea mays
  misc_feature (329)..(329): Xaa can be any naturally occurring amino acid
MANLADSFLADLDELSDNEGYPEEDNAEAAGRDDDEDDDMPDLESLNYDDLDSVSKLQKTQRYNDIMQKVENALQKGTDFSNQGSILEEDPEYQLIVDCNALSVDIENEIIIIHNFIRDKYRLKFPELESLVHHPIDYARVVKKIGNEMDLTLVDLEGLLPSAIIMVVSVTASTTSGKPLSEDNLEKTTEACDRALTLDASKKKVLDFVESRMGYIAPNLSAIVGSAVASKLMGTAGGLGALAKMPACNVQLLGAKRKNLAGFSTATSQFRVGYLEQTEVFQSTPPPLRTRACRLIAAKSTLAARIDSIRGDPTGKAGRNLLEEIRKKXEKWQEPPPAKLPKPLPVPDSEPKKKRGGRRLRTQVQGNLLGGGTQSTYF

SEQ ID NO: 43734 - protein, 568 aa, Oryza sativa Indica Group
MGFLNLVGNSFGCSASGERLVSAARDGDLQEARALLEYNPRLAWYSTFGGRNSPLHYTAAQGHHERYSSSRFASTSVVKQSSGGLFSWLLGEKSSQLPPLDVPLPGITLPPPLPDFVEPSKTKVTTLPNGIKIASETSVSPAASVGLYIDCGSIYETPASSGASHLLERMAFKSTTNRSHLRLVREVEAIGGNVSASASREQMCYTYDAFKAYVPEMVEVLIDSVRNPAFFNWEIKEQLEKIKAEIAEVSDNPQGLLLEALHSAGYSGALAKPLMAPQSAIHRLDSSILEEFIAENYTAPRMVLAASGVDHDDLVSIAEPLLSDLPSVKRPEEPKSVYVGGDYRCQADSDKTHIALAFEVPGGWFEEKTAIIVTVLQMLMGGGGSFSAGGPGKGMHSRLYLRILNNYHQIESFSAFNSIYNHSGLFGIHATTSPNFASKAVDLAAGELLEVATPGKVTQEQLDRAKQATKSAVLMNLESRVVASEDIGRQILTYGERKPIEHFLKDLEAITLNDISSTAKKIISSPLTLASWGDECFLAVIHVPSYESVSQKFFSRVRKPISWLAPDF

SEQ ID NO: 43735 - protein, 177 aa, Zea mays
QDVIQGEVLLAVLSNYMVDIDWLLTACPSLRKVPHVLVLHGQDGASLELMKKLKPANWILHRPPLPISFGTHHSKAMLLVYPQGIRIVVHTANLIHVDWNYKSQGLWMQDFPWKDTVDMNKKTAFENDLVDYLSALKWPEFRVNLPGVGDVNINAAFFRKFDYSNSMVRLIGSVSWY

SEQ ID NO: 43736 - protein, 212 aa, Arabidopsis thaliana
YLESKPRYVAQDELLVQVPAQIGSFLLVVGAYMLFTGSGESFNVGAFLESVSPYAWASIGIAFAISLSVVGAAWGIFITGSSILGGGVKAPRIRTKNLISIIFCEVVAIYGVIMAIVFSAKVSAVTGAELYSPDSYYTGFALFWSGITVGLCNLICGVAVGINGSGAALADAADPSLFVRILVIEIFSSVLGLFGLIIGLLVSSKATEFGKE

SEQ ID NO: 43737 - protein, 309 aa, Chlamydomonas reinhardtii
QVLIGGRDTPEGRAAVESLARLYRRWVPPDRVLSMGLWSSELAKLAANAFLAQRISSINAISALCEETGADVQQVSHAIGTDSRIGPRFLSAGCGFGGPALQKHVLNLVYICESLGLAQAAAYWQQASRAGGQGPRVVDMNDWIKARFVRRVITSMFNTIRGKRIAVLGFSYKAHTTDTRDTASIDVCRGLLLDGAALSVYDPKVTPEQIHLDMCLPKGSLEQPRRQHTAVSLATVDVARSAMEACRGAHGVCVLTDWPEFRRLDFHAIFKAMMKPAFIFDGRNVLDHARLREIGFVVYALGKPLDPFL

SEQ ID NO: 43738 - protein, 122 aa, Leersia oryzoides
PVGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPIAPGKQEVEHAY

SEQ ID NO: 43739 - protein, 400 aa, Bacillus cereus G9241
MKDIVIKTPLQRDTVLSEKYDCDVYVKREDLQLIRSFKIRGAYNLIQSLPKVQLQNGVVCASAGNHAQGVAYTCNLLKIPSKIFMPTTTPKQKVSQVQFFGGDFAEIVLVGDTFDSSFQEAQRYCEKNRMTFVHPFDDPYVIAGQGTVAVEIMHDMEKTVDYIFTAIGGGGLASGVGTYVKGVSPATKIIGVEPMGAASMKEAFLQNENVALEKIDSFVDGAAVKKVGKLTFETCKDVIDDIVLIPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLITRFKENNIQFMELNKNPVLFDLLI

SEQ ID NO: 43740 - protein, 142 aa, Xanthomonas axonopodis pv. citri str. 306
MQTVRQLLGTKQVEVFAVAADAAVIEAIRLMAEKAIGAVLVMEGPRLVGIVSERDYARKVVLRDRSSSTTSVAQIMSGEVVTVSPSETVERCMQLMTDGRFRHLPVVENGRVQGVISIGDLVKAVIEAQQQDIDQLQRYIAS

SEQ ID NO: 43741 - protein, 122 aa, Leersia perrieri
PVGESKRGGEVYRLYDVGGQRNERRKWIRLFEGVNAVIFCAAISEYDQMLFEDETKNRMMETKELFDWVLKQRCFEKTSFMLFLNKFDIFERKIQKVPLSVCEWFKDYQPIAPGKQEVEHAY

SEQ ID NO: 43742 - protein, 122 aa, Leersia perrieri
PVGESKRGGEVYRLYDVGGQRNERRKWIHLFEGVNAVIFCAAISEYDQILFEDETKNRMMETKELFDWVLKQRCFEKTSFMLFLNKFDIFERKIQKVPLSVCEWFKDYQPIAPGKQEVEHAY

SEQ ID NO: 43743 - protein, 394 aa, Chlamydia trachomatis D/UW-3/CX
MKRNPHFVSLTKNYLFADLQKRVAQFRLENPQHTVINLSIGDTTQPLNASVAEAFASSIARLSSPTTCRGYGPDFGLPALRQKLSEDFYRGFVDAKEIFISDGAKVDLFRLLSFFGPNQTVAIQDPSYPAYLDIARLTGAKEIIALPCLQENAFFPEFPEDTHIDILCLCSPNNPTGTVLNKDQLRAIVHYAIEHEILILFDAAYSTFISDPSLPKSIFEIPDARFCAIEINSFSKPLGFAGIRLGWTVIPQELTYADGHFVIQDWERFLSTTFNGASIPAQEAGVAGLSILPQLEAIHYYRENSDLLRKALLATGFEVFGGEHAPYLWVKPTQANISDRDLFDFFLREYHIAITPGIGFGRSGSGFVRFSSLGKREDILAACERLQMAPALQS

SEQ ID NO: 43744 - protein, 191 aa, Gibberella zeae PH-1
MSLPNSKPKLPVAVEKPTPYTFDLGHLLAEDPNPVTLDRENLEQSLAELARDGAQSLINQFLTTCPLSSTAEGVLLTLPAPSTRLPREKPVPQAKAPTKWERFAAKKGIKPKTRESRRNLAFDEQTGEWQRKWGYKALNKKGEDWPIVEVDMEAEKKRKEGTTIRGDGRRERKERVKRNERLMRKNKGIPK

SEQ ID NO: 43745 - protein, 503 aa, Agrobacterium tumefaciens str. C58
MQTTAEAIKGKRLGLFIDGRFVEPRSGKFVDSYDPTTGEAWYQFAEGGADDVDLAISSAQRAFRDPSWRRMTQTARGKLVRRLADLVLEHAEDLALLETRDNGKLIKEMRAQMRAIPDSYLYFAGMADKLQGDTIPVNKLDQLNFNMREPLGVIGMVTPWNSPLMLLTGTLAPCLAIGNTVVIKPSEHATASTLALAELIVEAGFPAGVVNVVTGGGAVTGEALTRHNGIAKFVFTGSTATGRRIAANAAANLVPCQMELGGKSPHVVFSDVDIEKTVNGVVSGVFAAAGQTCVAGSRCFVEANIYDRFIEALVERTRNIKLGDPMDDATDIGPLALESQLSKLEGYVASGVREGSRIAIGGKRPQSEELSRGWYFEPTVMADATNDMSFMRHELFGPMVGVMPFSSEEEMISLANDTNYGLASGIWTQNIDRAMRFANQIDAGTVWINTYRSAAYMSANGGFKESGYGRRGGFDVMREFSRAKNVVIDYSGAMQDPFVIRLR

SEQ ID NO: 43746 - protein, 602 aa, Pseudomonas syringae pv. tomato str. DC3000
MPHEGSLLQAAVVFLLAAVLTVPLAKRLKLGAVIGYLFAGVIIGPSVLGLIGDTESVSHISELGVVLLLFIIGLELSPKRLWVMRKAVFGVGMAQVMLTGLVIGAIALFAFGQSLNTAVILGLGLALSSTAFGLQSLAERKQLNSPHGRMAFAILLFQDIAAIPLIAMVPFLAGADHAMNTGESVNHGLRVLGSIAIVVIGGRYLLRPVFRIVAKTKIQEVSTATALLVVIGTAWLMELVGVSMALGAFLAGLLLADSEYRHELEAQIEPFKGLLLGLFFISVGMGANVGLLLSSPLAVLGLTLLLIAIKLPMLFIIGRTAGGLNNRSALQLGLVLAAGGEFAFVVFKIGSTQGLFEAGLYDMLVLTITLSMAITPLLFIALARWIKPKAKVVNVPDEYRDIQTDKPRVVIAGMGRMGQIVARILRAQKVPFIALDTAVESIEFSRSFGNVPVFYGDPLRPEILRAAKVDEAQYFVIATDDPDTNIKTAELIRKLYPHMKIIARARNRQHVHRLMDIGAHAVRETFYSSLEMSRQTLMGLGLTEAQADARISRFKRHDEQVLAAQHEVYDDDAKVLQTAREARADLAQLFEADRLDEEAAKG

SEQ ID NO: 43747 - protein, 356 aa, Arabidopsis thaliana
MSDISQDLLEEILSRVPITSLRAVKSTCKRWKDLLNDPSFSKKYGGKRDNEFLAIMTSGSRASLMSVNLHGPRDNKDLEDPFIKQIGELNQDQIFKVFHCDGLLLCITNEDNTRLVVWNPYLAQTRCIQPIDKFYIYDWYCLGYDKDKNHKILVVYSPMFGRIEYEIYSFLSKSWIVLSFPTDWQISRDECLSLKGNTYFIAYKKMEVEEVGFQEFLLCFDFTNERFGPLLPLPFQCYNQTSLVLSTVQEEQLAVLCKRCDAYETKIWITTKIEPNAVSWSYFLKFDFKVDISGGSFFVDVEEKVAVLFCINREKEKGINNKTYMIGEDGYYKEVDLGESNWCPSMCSYVPSCVQV

SEQ ID NO: 43748 - protein, 499 aa, Glycine max
MLPLVYILIALPAVVLLLILFKANKNNPPRPPGPRGLPIIGNLHQLDASKLNLQLGQLSKTYGPLFSLRIGFKPALVVSSPKLAKEVLKDHDLDVCTRPPSLGPLKLTYNALELIFSPYNDHWREIRKICVVHFFSSKRISAFSHVRKSEAKRMLQIVSSHVDSSKTTNLTEVLMAVSSAIICRLAFGRKYDDDGAEKSRFHGLLNDSQAMLLSFFVSDYIPFLGWIDKLTGMVTRLEKTFEALDGFLQEVLDEHLDPNRVKVKQNEEKDLVDLLLELKKQGRLSIDLTDDQIKAIILDILIAGTDTTAATSVWVMTGLIKNPRAMGKAQEEIRNLSGNKELIEEEDVQKLVYLKAVIKETLRVYAPTPLVPREAIRSFTIEGYEIQPKTIVYVNGWSIQRDPEAWKDPEEFYPERFLNNEIDFKGQDFEFIPFGAGRRICPGISLGIATVELITANLLNSFHWEMPQGMKPEHIDTEGLPGLARHKKNHLCLVAKKRM

SEQ ID NO: 43749 - protein, 77 aa, Glycine max
  misc_feature (66)..(66): Xaa can be any naturally occurring amino acid
MVSSFTCLKSMAGFPTRKTNNDITSIACNRLRVQCIHVSPPIVKKKFDTFSYLPYLYYSQLSNEVXYLLTKGLIPFF

SEQ ID NO: 43750 - protein, 266 aa, Cryptococcus neoformans var. neoformans JEC21
MAHKSHRHKALQAQLEAQPTISLISQKTRKPPAPSMDVDQDDDVLISTNAASAPNTTDPSDAPVSATTTSSGFAPLTAAAQSTVLKNEFRRIPIPPHRMTPLKRDWVNLYTPMVEMLGLQVRMNPQRKAVELKTSGHTVDSGAIQKGADFVKAYALGFDVNDALALLRLDDLYLDSFEIKDVKTLHGDHLARAIGRIAGEGGKVKFSIENASRTRIVLADTHIHILGSVQNIKIARDAVVSLILGSPPGKVYAHLKAVGARMKQRF

SEQ ID NO: 43751 - protein, 597 aa, Aspergillus oryzae
MSGSPSNGMPKTVVPSQIEPVVSAVEVTEQNAGSDRIVQEPSRDGLSISDKDSALFQGGVQRVRAITSLWSKNTMWLMFVLLYLVSFVDMLLVSVQTSLNPYITSSFHKHGLLTVVSIMSTILGGSSKLTLAKIIDIWGRVEGFLFMLLIVVIGLIMKATCKNIETYVAAHTLYWVGHIGMMYVVDIMLADMTTLKSRMIMLGINGTPSIASTFAGPRIATLFYINLDFRWAFGAFAIMITGTSIPVVGVMLYMQRRAQKVGIYEKTVSERSWWQSIIHYFIEFDVIGIVLITAVFSLILLPFSLASYAPKGWASGYIVAMEVLGVVCIPAFYAWERYLSPVQFLPWKYLKEPTIIGSCLLYCVMFTSCFTWNSYFSSYLQVVHRLDITTANYVLNAFSLTSYIFSPIFGLLIRYTGEFKWTVFTGIPILLLGTALLIPFRQPTTHVGIITMTQILVGLGTCIFTVCGQLAIMAPVTHQEIAVVVAIWGLFGSIGAAVGSAIAGGMWNNILPSELYKRLPDESRNISATIFSDMVMQMSYADGTPEREAIVGAYADVQRKMVIAGVCFVPLCVACVWVWRDINVRKLETEQTRGNVW

SEQ ID NO: 43752 - protein, 516 aa, Solanum tuberosum
MENGTKREGLGKLTVSSSLQVEQPLAPSKLWKIIVVASIAAGVQFGWALQLSLLTPYVQLLGIPHKFASFIWLCGPISGMIVQPVVGYYSDNCSSRFGRRRPFIAAGAALVMIAVFLIGFAADLGHASGDTLGKGFKPRAIAVFVVGFWILDVANNMLQGPCRALLADLSGGKSGRMRTANAFFSFFMAVGNILGYAAGSYSHLFKVFPFSKTKACDMYCANLKSCFFIAIFLLLSLTTIALTLVRENELPEKDEQEIDEKLAGAGKSKVPFFGEIFGALKELPRPMWILLLVTCLNWIAWFPFFLYDTDWMAKEVFGGQVGDARLYDLGVRAGAMGLLLQSVVLGFMSLGVEFLGKKIGGAKRLWGILNFVLAICLAMTILVTKMAEKSRQHDPAGTLMGPTPGVKIGALLLFAALGIPLAATFSIPFALASIFSSNRGSGQGLSLGVLNLAIVVPQMLVSLVGGPWDDLFGGGNLPGFVVGAVAAAASAVLALTMLPSPPADAKPAVAMGLSIK

SEQ ID NO: 43753 - protein, 263 aa, Pseudomonas syringae pv. tomato str. DC3000
MSSAIGIKTEQDLVQLRIAGRLAADVLAMITPYVKAGVSTEALDDLCNEYIVKELKVIPANVGYHGFTKTTCISPNAVVCHGIPSSKDILKEGDIVNIDVAVIKDGWYGDTSRMYLVGEVSPLARRLVETTYEATRAGIHAVRPGATLGDIGYAIQSVAHREGFSVVREYCGHGIGRKYHEEPQVLHYGTQGKGLKLKQGMVFTIEPMINAGKAGTRTLPDGWTVLTSDLSLSAQWEHMVAVTATGFELLTPWPDGTGDYPAI

SEQ ID NO: 43754 - protein, 545 aa, Azospirillum lipoferum
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVRSAATGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADNPLGGLVDALLEWLPRSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDSAFATRGRFQLIEAMIPRGVLSDTLARFVQGQKRLHAAPRD

SEQ ID NO: 43755 - protein, 164 aa, Oryza sativa Japonica Group
MASRLLHLRRLLPSARPSAGGGGRLRRCGRRLLNHEICGLTLIEASSLTDALRGRLGVDQLPPLAILTGGAAPLAGGGAATGAAGEEAKAKEEKMAFDVKLEGFDAAAKLKIIKELRAFTNLGLKEAKELVEKAPAVLKAGVPKEEAESIAEKMRAIGAKIVLE

SEQ ID NO: 43756 - protein, 510 aa, Solanum demissum
MMQDVWTQLGPTIAAIMFIWTMYQNYFPHELRGHIRRYTNKLVSYFYPYMHIIFYELETEGWFERSKAYVAIERYLSKNSSTQAKRLKANAVKDGQSLVLTMDDHEEITDEYKGEKVWWISSQKPASRQTISFYREDEKRYFKLKFHKKNRDLITNSYLKYVLDEGKAISVKERQRKLYTNNKGDGGGYRYRGGRMWSGVVFEHPSTFDTLAMDPNKKQEIIDDLETFSKSKDYYAKIGKAWKRGYLLYGPPGTGKSSMIAAMANFLKYDIYDLELTSVKDNTELRKLLIDTTGQRETNKKKKEEEDKGKNEEDAIKEKMKKGGEVKEKQSEVTLSGLLNFIDGLWSAIGGERLIVFTTNYVEKLDPALIRRGRMDKHIVLSYCCFESFKVLAHNYLDVVESHVHFPEIRRLLEETNMTPADIAENLMPKSSKENADTCLERLIKALETAKEEAKLKAEEEERAKAAEKEKEEKDREEKKEVTDTEEAKNTDGVNEKDNCVKENGDVSKG

SEQ ID NO: 43757 - protein, 826 aa, Nostoc punctiforme PCC 73102
MTTISKNTLSPSAQERSLILWFDEVGIADIPLVGGKNASLGEMIQQLTPKGINVPTGFATTAYAYRHFIKSAGLEAKLRKLFADLDVEDVKNLRERGKKARSLLIHTPFPVELREAIATAYQSLCEIYHTETDVAVRSSATAEDLPDASFAGQQETYLNVVGVEGVLAACHKCFASIFTDRAISYRHTKGFDHFSIALAVGVQKMVRSDLATSGVMFSIDTETGFKDAALITAAYGLGENVVQGSVNPDEYYVFKPTLKAGFRPIIDKKLGSKELKMIYDDGSKFTKNVSVSASERGKFALSDEEILQLGNWTCLIEDHYSQVHGISTPMDIEWAKDGITNQLFIVQARPETVQSQKTGNVLRSYRLVWGNREKSSHSSLHDSQSPIPLVTGSAIGEAISQGKARLILDVQKLEQFQVGEVLVTERTDPDWEPIMKRASAIVTNSGGRTCHAAIIARELGVPAIVGCGNATEILKPGQEVTISCAEGEEGKVYAGLLPFEVEEVALENLPRTHTQILMNVGNPQEALSLSAIPNDGVGLARTEFIIANQIQIHPMALINYELLKDEFAKAKIAEITSLYDDKPQYFVDKLAQGIGRIAAAFYPKPVIVRMSDFKSNEYANLLGGRQFEPHEENPMLGWRGAARYYDEGYREAFALECHALKRVREEMGLTNVIPMIPFCRTPDEGRLVLAEMAKNGLKQGVNGLQVYVMCELPSNVILAEEFAEVFDGFSIGSNDLTQLTLGIDRDSALVARLFDERSPAVKRMVKMVIEAAKKCDRKIGICGQAPSDYPEFAQFLVEQGIDSISLNPDSVLKTMLEVAKAEGTNS

SEQ ID NO: 43758 - protein, 193 aa, Oryza sativa Japonica Group
MGGPGASSTMSFEQAFLKNLLLSLQDCSTTKPLDAMSLHERKRAVKSSADFAMATARGGGARWPKAIVLQQQPASTTARARRCGRIVRRCCGRKTRSGAGGGGEMARRLQVRRRAMALRKVIPGGGDAMDEAALLREAMDYVVHLRAQVDVLRRVSEAVQLQRRYTSSTSLRDYSWSKCALKGEEDSSMNMKR

SEQ ID NO: 43759 - protein, 472 aa, Oryza sativa Japonica Group
MEADSGKLFVGGISWETDEDRLREYFSRFGEVTEAVIMRDRNTGRARGFGFVVFTDAGVAERVTMDKHMIDGRMVEAKKAVPRDDQSITSKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPAARSPAGGQNYAMSRVHSFLNGFNQGYNPNPIGGYGMRVDGRYGLLTGARNGFSSFGPGYGMGMNSESGMNANFGANSSFVNNSNGRQIGSFYNGSSNRLGSPIGYVGLNDDSGSLLSSMSRNVWGNENLNYPNNPTNMSSFAPSGTGGQMGITSDGINWGGPTPGHGMGNISSLGLANLGRGAGDSFGLPSGSYGRSNATGTIGEPFSAPPNAYEVNNADTYGSSSIYGDSTWRFTSSEIDMPPFGNDLGNVDPDIKSNIPASYMGNYTVNNNQTSRGITS

SEQ ID NO: 43760 - protein, 375 aa, Prochlorococcus marinus str. MIT 9303
MVSGMGTARFAPMLKAGIVGLPNVGKSTLFNALVANAQAQAANFPFCTIEPNVGSVAVPDERLQLLCDLSKSKELIPTRMEFVDIAGLVKGASEGEGLGNKFLANIREVDAIVHVVRCFEDEDVIHVSGSVDPSRDAEVINLELGFADLSQIEKRRLRLKKQTRTSNDAQLEDAALERIQSVLEQGGAARAVELSDEEAKMIKPLGLLTAKPIIYATNVSEDDLAGGNAYCEEVTSLATREDAECVRISAQVEAELIELGEAERIDYLEGLGVSEGGLKSLIKATYRLLGLRTYFTTGEKETRAWTFKAGMTAPQTAGVIHTDFERGFIRAQTIAYQKLLEAGSFAEARNKGWLRSEGKDYVVAEGDVMEFLFNV

SEQ ID NO: 43761 - protein, 581 aa, Vibrio parahaemolyticus RIMD 2210633
MDADTINSFFLIGALLIALSVLLSPVSSKLGIPILLVFLAVGMLAGEDGLGGILFDNYSIAYLVSNLALAIILLDGGMRTRVASFRVALWPSVSLATIGVAITTLLTGLMATWLFDLDLLQGILVGAIVGSTDAAAVFSLLKGRSLNERVGSTLEIESGTNDPMAVFLTVTLIAILSSTGTGLSAGFLALSFVKQFGIGALLGFAGGWVLWKVINRNQLPDGLYSILTVSGGLIIFALSNSLGGSGILSIYLVGLLLGNRPTRSRHSILHVLDGMTWLAQIGMFLVLGLLVTPSNLLSIAVPGLALAFGMILFARPISVWIGLLPFKSFTPREKWFVSWVGLRGAVPIILAVFPMMAGLPDAQLYFNLAFFVVMVSLIVQGGTLTKAMSLAKVELPPKPEPISRTGVEIYPTSEWELFIYRLKADKWCIGEPLRSLSMPEGTRIAAVFRNQELLHPSGSTRLEEDDTLCVLAQEKDLAALSLLFSEAPEKASLTRFFGDFFLDIEVKLADVAMMYGLNLGYELQDKTLSNIVEEQLGSTPVLGDQFEWQGLQWVIADVVDHQVTKVGLRLPNEEEEGEEED

SEQ ID NO: 43762 - protein, 131 aa, Triticum aestivum
  misc_feature (51)..(51): Xaa can be any naturally occurring amino acid
  misc_feature (73)..(73): Xaa can be any naturally occurring amino acid
  misc_feature (100)..(102): Xaa can be any naturally occurring amino acid
  misc_feature (109)..(109): Xaa can be any naturally occurring amino acid
  misc_feature (115)..(115): Xaa can be any naturally occurring amino acid
  misc_feature (117)..(118): Xaa can be any naturally occurring amino acid
  misc_feature (123)..(123): Xaa can be any naturally occurring amino acid
MAPTVMASSATSVAPFQGLKSTAGLPVSRRSNGASLGSVSNGGRIRCMQVXWPIEGIKNSKTLSYLPPLSTEXLLKQVDYLIRSSWVPCLQVNKVGSTSXXXNAPPGYXNGRYWXTXXKLPNXRVDTHKFS

SEQ ID NO: 43763 - protein, 122 aa, Leersia hexandra
PVGESKRGGEVYRLYDVGGQRNERRKWIHLFEGVNAVIFCAAISEYDQMLFEDETKNRMMETKELFDWVLKQRCFEKTSFMLFLNKFDIFERKIQKIPLSVCEWFKDYQPIAPGKQEVEHAY

SEQ ID NO: 43764 - protein, 341 aa, Methylococcus capsulatus str. Bath
MKRKGILVTGGAGYIGSHVVKTLGEAGERLVVLDNLSTGFRDAVLYGDFIEGDTGDDVLLDKIMRDYEVEAVMHFAAHTIVPESVENPLKYYGNNTCKTRTLLESCRKAGVSHFIFSSTAAVYGIPEGEFALETSPLAPINPYGSSKLMSEIMLRDLSTASPLRHVVLRYFNVAGSDPEGRIGQSTAKATLLIKVAAEVATGKRDRLCIFGTDYPTPDGTGIRDYIHVSDLADAHVAALAYLRAGGESRTLNCGYGHGYSVREIIDTMNRVNGTPIAVEERPRRPGDPPRLVAGVERIREILEWTPRYDDIELIVRTSLEWERKLAARKAPEVCQRESPAR

SEQ ID NO: 43765 - protein, 488 aa, Artemisia annua
MALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENIFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 43766 - protein, 458 aa, Yarrowia lipolytica CLIB122
MNWESELENDTAVKVAGIDIDGIVRGKSISKAKFLSVISKGFGFCGVIFGWDMHDKNYTKELTVSNKDNGYRDLLAIIDLSSFRRLPWENNIPFFLVHFKDSVTQEEIAPCPRSLLTAVTGLYFKDKMKAMAGAELEFYNFCLDRKDLPDSFAKLPPISTGMFGYSVQRPALNGDYFQAVWDTALKIDAPLEGWHTETGPGVLEAAIAFDEVNKLADKTSLFKLMVKSIAPQYKVIPCFMAKPQQGMPGNSGHLHVSLVDQESGKNLFARDQPDPNPEWPDVEYLSDLGRHFLAGVLDGLPDIMPMFAPTINSYKRLVENFWAPVTVSWGLEHRIASIRLIAPPTGSASATRFEIRTPGADVQPHFALAAILALGHRGIAKKMPLTVPPMGDSSPDKFERLPRDLMRATEHFMRPDSLARELFGDKFVEHYGETRLHECREFMESVTAWEVDRYIETV

SEQ ID NO: 43767 - protein, 424 aa, Bordetella bronchiseptica RB50
MSDTTPAWMAQGYPHIWLPYAQMKTAAPPLPVVRSHGSLLELADGRTLIDGVASWWTACHGYNHPHIAQAVREQLDRMPHVMFGGLAHEPALNLASRLSALLGPGLERVFYTDSGSVAVEVAMKMAVQFWLNQGERGRTRFVAFRGGYHGDTFGTMAVCDPDEGMHAMFRGLLPEHDVLALPRDEAALAALQAHLERHAGRIAGMLVEPLVQGAGGMLLHDPQVLARLRELADRYGILLIFDEIFTGFGRTGTMFAFEQAGVRPDIVTLSKALTGGTLPLAATVASARVFEGFWSDDPGHALMHGPTFMGCALACAAANASLDLFEREPRLRQVAALEQALRAGLEPCRDLPWVRDVRVLGAIGVIELDGIGARDDLRRRLVDAGVWVRPFGNIVYLTPAFTIAEDELQALLAAVRQVVAERRP

SEQ ID NO: 43768 - protein, 624 aa, Moritella sp. PE36
MTGYFIQAFIYLFAAVIAVPIAKRLGLGSVLGYLIAGVIIGPVIGLVGSETATIQHFAEFGVVMMLFLVGLELEPRMLWDMRHRLIGLGGLQVGLTTAAIMGIGLALNLDWGLALTIGLVFSLSSTAIVLQTFNEKGLTKTEGARSAFSVLLFQDIAVIPMLALIPLLAIPELVEQAQNAVQAASAQHEELSLVANISGIYYALVIIVAITGVIVGGHYLSRPLFNFVASSKVPEIFTAAALMLIIGIAALMNLVGLSPALGAFLAGVVLATSEFRHQLETTIEPSKGLLLGLFFMTVGAGINFTILFNDISTILAITLTLMLVKSLVLFILTLVFKIKGSDRWLLALSLAQAGEFGFVLIGFTVSNHVLPVDLAQTLSLSVALSMFLTPALFIFYDRVILPRYVDKTNQQASDDIDEQGDVIVAGIGRFGQIVNRLLLANGVKTVVLDHDVSMIQRVRSFNMKSYFGDATQLRLLETAGIANASLFIVAIDDKARAVDLVRYIKQHYPQVKILARAYDRGHGYSLRHAGADHVVSETYHSALILGSHALTNLGFSEHQAKEVELTFKEIEKQSKTTLYQTWLNNSEDDKFNTAYRDLYLQLEDSLADVMKNKDKSEKPLHFDI

SEQ ID NO: 43769 - protein, 122 aa, Leersia tisserantii
PVGESKRGGEVYRLYDVGGQRNERRKWIHLFEGVNAVIFCAAISEYDQVLFEDETKNRMMETKELFDWVLKQRCFEKTSFMLFLNKFDIFERKIQKVPLSVCEWFKDYQPIAPGKQEVEHAY

SEQ ID NO: 43770 - protein, 336 aa, Methylococcus capsulatus str. Bath
MRILITGTAGFIGSHLAHKLLDRGDEIIGIDNVNDYYDVSLKEARLARLHARPGFSEARIALEERDKLFATFARHRPERVVNLAAQAGVRYSLENPHAYVDANLVGFCNILEACRHYEVEHLVYASSSSVYGANTAMPFSVHHNLDHPVSLYAATKKANELMAHTYSHLFGLPTTGLRFFTVYGPWGRPDMALFKFTRNILAGQPIDVYNYGHHRRDFTYIDDIVEGVVQTLDKVAAPDPAWRGDRPDPGTSRAPYRLYNIGNNEPVELLRFIEVLEHCLGCKAEMNLLPMQDGDVPDTYADVDDLMRDTGYRPATPIETGIARFVEWYRDYYGVR

SEQ ID NO: 43771 - protein, 106 aa, Magnetospirillum magnetotacticum MS-1
MATKTTEKKAAAPKKETATKAASGTKPNALQQPLKPSPELAAIVGDKPLPRGEVVSKVWEHIKKHNLQNPENKREIVADDKLKKIFGKDKCSMFEMNKHLAAHLKS

SEQ ID NO: 43772 - protein, 711 aa, Coccidioides immitis RS
MAIALAEADKYEILERIGSGSFGVIRKVRRKADGYILCRKEINYIKMSQKEREQLTTEFNILSSLRHPNIVAYYHREHLKATQDLYLYMEYCGGGDLSMIIKNLKANNKFAEEEYVWRVLSQLATALYRCHYGVDPPEVGSNVFGALPSTKPTGLKGKQAQVMILHRDLKPENIFLGADQSVKLGDFGLSKLMGSHDFASTYVGTPFYMSPEICAGEKYTLHSDIWAVGCIMYELCMREPPFNARTHMQLVQKIREGRYPSLPDLYSPELKSVIANCLRVNPDHRPDTAALLKLPVIRLMRKEKEVVDLGKALRTKEETALQKMKELELRCAQFDKEKAALKVDIENSVRREWEVKARLEIDRQVQMELETLRKRFEAEVQDRVAAELQRQRIIQSQPLQNEDDGVGSSTDVSRSSLGTDDTDFPSSTDLSSLSLESPTSDQTRAARKYNRTPFSRAKTTLESPMDVQMAEPSPMSIASLSLSPRRMHLGSTARNIFADNGRKVPKWDSALLYSDDEDDIPDLPSPSRPQVKADPFKAPHRPLLRQNTTAMMQKLSTQPSLFPAKATTQSAQASSPTQSETRMSEGRAKSPHRRLSKIPSCTSLALDGGSPVRRTAMKPPNSKANAGGEEMFKAVMQRNMGGRTLVELAQARAGGRPIEELKRPGETRFSTTGLATVKPVERDPPATWDPEKDEMPSPFLVRGTKIIRNLR

SEQ ID NO: 43773 - protein, 361 aa, Zea mays
MSRVASLSPSLSGDEVEVEEEEEDEGVDGYRKGGYHAVRPGDQFAAGRYVAQRKLGWGNFSTVWLAFDVQSQRYVALKIQKSAPEFAQAALHEIEFLSEITKRDPLNCKCTIQLIDHFKHTGPNGQHICLVFELLGDSLLKLVQYNRYKGIGFDRVRQICKSILVGLDYLHNELGIIHSDLKLENILLVSTIDPSKDPIRSGLKPNLERPEGYPNGEAGLNAIENKLKMRARRVLAKLAEKRKSAVESSRSERSLDGIDLTCKIVDFGNACWADKQFTDFIQTRQYLAPEIILGAGYSFSVDMWSFACFVFELATGEILFTPKEGHGYSEDEVYIAFLMSLAILFIFELASIMQCMPTIPL

SEQ ID NO: 43774 - protein, 445 aa, Agrobacterium tumefaciens str. C58
MSATTKEILDLNRFDASRTEGFPAELAERVAKRQATFGASSVLFYEQPIEMVSAQGAYLYDAGGRKYLDVYNNVPSVGHCHPRVVEAIARQVGELNIHTRYLNRVVEAYTENLLSKFPAGLSNVVLTCTGSESNDLALRIARIGTGAEGFIVTEAAYHGNTALVTEVSPSSLRKRKPAAFVAIIPAPAARDGMSVASNFAASVEQAINELNSRGIKFAALIVDTIFSSDGIYADPAGFLKEAVDVVHRAGGLLIADEVQPGFGRTGGSLWGFERHGVTPDIVTMGKPMGNGFPMGGVVTRPDLLQRFCEETGYFNTFGGNPVAAAAGHAVLRVIEEEGLIERSATVGGYFKQSLQALQSRHSEIGDVRGAGLFIGLDFVDPATGEPDSTRATHAINQLRHNSILIGAAGKYGATLKIRPPLCFSNEDVDLFTGTLDIILQARRAA

SEQ ID NO: 43775 - protein, 388 aa, Chlamydia trachomatis D/UW-3/CX
MFEFRFPKIGETASGGIVVRWLKQVGDPVQKDEPLIEVSTDKIATELAPSQAGILEECLVQEGEEVFPGDILARLLETAAANTPVKSPVENPVREENHSVDREQKWFSPAVLGFAQREGLDLQELQKISGTGEGGRITRKDVEHYLSDKREPRDPICSKEENRIPLSPLRRAIASSLRQSSEEVPHASLVVDVDVTDLMNLISAERERFTAAHGVKLTITSFIIQCLAKSLEQFPLLNGSLDGDTIVLKKAINVGVAVNLNKEGVVVPVIHNCQDRGLVSIAKVLADLSSRARSNKLDSSETKGGSVTVTNFGMTGALIGMPIIRYPEVAILGIGTIQKRVVVRDDDSLAIRKMMCVTLTFDHRILDGIYGGEFLTALKNRLESVTMS

SEQ ID NO: 43776 - protein, 425 aa, Oryza sativa Indica Group
MAAAAAATFLPHTPTPRRRLAVAVHSPTRRRLSLVFSGPPDGALSVAAAEEKADAGEEAAAAVSAPRGGGGGGGKERRRVVRKAWEKLVRWSRSWRRRNRSDVVETTRKVVVLGGGSFGTAMAVQVAAKKADLEVSMLLRDDLVCRSINHSHINCKYLRDHRLPENITATTSASDALAGADFCFHAVPVQFSSSFLEGISTHVDPKLPFISLSKGLELNTLRTMSQIIPQALGNPRQPFIVLSGPSFAIELMNKLPTGRNLIVIKLYMAAMVVASKDKKLAAAVQQLLASPNLRISTSNDVTGVEIAGALKNVLAIAAGIVEGMHLGNNCMAALVAQGCSEIRWLATKVAEGVSTAGAVIALAQKYHVKMPVLTAVARIIDNELTPKKAVMELMNLPQVQYLSENILFIQRKLAHGELENIEINE

SEQ ID NO: 43777 - protein, 299 aa, Aspergillus nidulans FGSC A4
MALIKDVHKVPALDLIGWWSTAPPSGPTTAHLPIHRQILQNHNESAVFLTFHPSQVQGASQSQGKLPLTIYESVYEGESVTENGKAMQVDGEEQLLNIRFRELPYTIETGEAEMIGIDTVARTARNAAATETSTVAAPSSQIDSDKQEQQPANTDLLSPEEEELIASLNTRLNAIRTLESRISLIKSYLSSISPSSEEGQKDSATKPDHTILRDINSLLSNLSLLTPHEQSAFSAETLAQNNDVSLVALLGQLSQSVNGMREVGKRTAIVNSVRRNRKQLGAQSRYEDDILGRDGVALG

SEQ ID NO: 43778 - protein, 353 aa, Coprinopsis cinerea okayama7#130
MSFFGATTSTTAASTAADKDVEVAEPPTDSISSVSFSPQADYLAVGSWDNSVRIYEVGPQGQTQGKAMYQHQGPVLDVCWNTDGTKIFSGGADNAGRMFDVTTGQATQVAQHDAPIKVVGWVNAPQAGVLATGSWDKTIKYWDLRTPNPVATVTLPERCYTFDIQYPLMVVGTAERHIQIYNLNSPNTVFKNLTSPLKWQTRVVSCFTASQNSGFAIGSVEGRVAIQYVEDKDSSNNFSFKCHRRDSVPNSKDQAMVFAVNDISFHPVHGTFSTCGSDGTIHFWDKDARTRLKTFEAAPGPISTTAFNRNGTLFAYAISYDWSKGHSGMTPGHPNKLMLHQCKDEEVRKRNRK

SEQ ID NO: 43779 - protein, 100 aa, Arachis hypogaea
AFSNGFLGLKTSLKRGDLAVAMASYKVKLVTPDGTQEFECPSDVYILDHAEEVGIDLPYSCRAGSCSSCAGKVVGGEVDQSDGSFLDDEQIEAGFVLTCV

SEQ ID NO: 43780 - protein, 421 aa, Oryza sativa Japonica Group
MADNVSKRQVASVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 43781 - protein, 242 aa, Agrobacterium tumefaciens str. C58
MSRRSPRKAGERALDHFRSLSSLPVETKGHLDLVTEADKDVEAFLIGSLREAFPDDGIMGEESGEIPGASGRVWVIDPIDGTFNFVRGGQNWAISIGLYENRRPSFGVIYAPVRDLILVGGKTVPTRLNGQPIKPLPALDMSRASTGFSRFISDDLKISFRFCGAATLSMIEVVMGETDGYVSLGDSTWDVMAALPILGHLGISNTIDWDRIDLSSKLRFACGSEEFLSKVRPLIEKVSAAA

SEQ ID NO: 43782 - protein, 378 aa, Weissella paramesenteroides
MNRVLKVHKSHTGVLDIKADISIKTPDDLSEAYTPGVSGIAKMIAEDEALKNVYTMSGKLIPIITDGSAVLGLGNIGPAAGLPIVEGKALIYKEFSGVNAIPMALNQVDVDEFVETIKTMAPSFAGIHLEDIAAPRVFEIEKRLNEELDIPVYHDDQTGTAVVVLAALINAAKVVNKPLKDLKVVINGMGAAGVATAKILLASGMKNLTLVDIHGVIRADDNDYNEYQRELATAVNQVDGRSLDDVIDNQDVFIGLSDANVLSKEQVTRMAQDAIVFALANPVPEILPEEAHEGGATITATGSSQWANQVNNVLVFPGLFKGLLATDIKKVELSLQVKLAEGLAQMVTTPTADHIVPRVFDDGVVDAVSNAVIAYAKA

SEQ ID NO: 43783 - protein, 306 aa, Pseudomonas syringae pv. tomato str. DC3000
MQAKVVIVGSLNMDLVIRAQRLPRPGETLSGETFDTVPGGKGANQAVAAARLGASVAMIGCVGADAYGQQLRAALLAECIDCQAVTVVEGVSTGIASIVVDANSQNAIVIVAGGNGRLTPALIERFDALLAGSEIVICQLEVPTETVFHTLSRARALGKTVILNPAPASEPLPASWYGLIDYLIPNESEAQTLTGVNVDSAASAEQAAMAMLAAGARNVIITLGERGTLFANAAGVEHIPARRVQAVDTTAAGDTFVGGFAAALAAGQGESQAIRFGQAAAAISVTRAGAQPSIPTFEEVQELNSL

SEQ ID NO: 43784 - protein, 188 aa, Vibrio vulnificus CMCP6
MSSIRSYKGIHPQIGERVYIDSTSVIVGDIRIGDDSSIWPLVAARGDVNHIHIGARTNIQDGSVLHVTHKNAENPHGYPLLIGNDVTIGHKVMLHGCDIHDRVLVGMGAIVLDDVVVESDVMIGAGSLVPPGKRLESGYLYVGSPIKQARPLSEKERAFLLKSADNYVQNKNDYLTEVKDLHERQTNR

SEQ ID NO: 43785 - protein, 143 aa, Zea mays
MASEAVVVHTGGCPLPAACGGKVEAPASVVAWICNCSDCSMRANTHFIVPAAKFKLQAGADEFITTYTFGTHTAKHTFCKTCSITSFYTPRSNPDGVAITVACVDPGTLKHVEYRKFDGRNWEDFFRTSDIAGFSKDDAEAAE

SEQ ID NO: 43786 - protein, 174 aa, Arabidopsis thaliana
  misc_feature (48)..(48): Xaa can be any naturally occurring amino acid
  misc_feature (100)..(100): Xaa can be any naturally occurring amino acid
  misc_feature (135)..(135): Xaa can be any naturally occurring amino acid
MASSMLSSAAVVTSPAQATMVAPFTGLKSSAAFPVTRKTNKDITSIAXNGGRVSCMKVWPPIGKKKFETLSYLPDLSDVELAKEVDYLLRNKCIPCVEFXYSTDFVYREHGNTPGYYQWTDWTRWKLPLFPCTDXSAQGVEGKLKKCRKEHPGRPSLRSWGIRQHPVQVQCRQV

SEQ ID NO: 43787 - protein, 573 aa, Oryza sativa Indica Group
MAGVATGGVEDAYGEDRATEDQPITPWAVCVASGHSLLRDPRHNKGLSFTEKERDAHYLRGLLPPVVLSQELQEKRLLQNVRQFQVPLQRYMALMDLQERNERLFYKLLIDNVEELLPVVYTPTVGEACQKYGSIFRRPQGLYISLKEKGRILELLRNWPEKSIQVIVVTDGERILGLGDLGCQGMGIPVGKLALYTALGGVRPSACLPITIDVGTNNEDLLKDEFYIGLRQKRATGQEYSDLLDEFMAAIKQHYGQKVLVQFEDFANYNAFTLLEKYRANNLVFNDDIQGTAAVVLAGLIAAQKFVSGTLADHTFLFFGAGEAGTGIAELVALEISNQSKVPVEDARKKIWLLDSKGLIVSSRKDSLQPFKKRYAHEHEPVKDLLDAVKVIKPTALIGSAGVGQSFTKKVIEAMSSINERPIILALSNPTSQSECTAEQAYSWSKGRAIFGSGSPFDPVKYNDKLFVPAQANNAYIFPGFGLGVVISGAIRVKDEMILAAAEGLADQVTPEHVDKGLIYPPFSCIRKISANIAARVAAKAYDLGLASHLPRPKDLVKYAESCMYSPIYRSYR

SEQ ID NO: 43788 - protein, 187 aa, Oryza sativa Japonica Group
MAAGALLLANPAAPTARHQHRLLQQRRQPRLLASSRPPRWRLSAVQETKEGEAQTAEEITEKYGLEFGLWKVFSSKEGEEEEGKTRKSRTEQAKELLAKYGGAYLATSITLSLISFTLCYLLVSAGVDVQDLLGKVGIATGETGGKVGTFALAYAAHKAASPIRFPPTVALTPVVASWIGRIKKGGD

SEQ ID NO: 43789 - protein, 122 aa, Chikusichloa aquatica
PVGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLGVCEWFKDYQPIAPGKQEVEHAY

SEQ ID NO: 43790 - protein, 431 aa, Bacillus cereus G9241
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFEFIDIIIAMVIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGALVNHRITTFIAWIIAILVIILNIFLLYQTFVG

SEQ ID NO: 43791 - protein, 122 aa, Zizania aquatica
PVGESKRGGEVYKLYDVGGQRNEKEKWIHLFEGVNAVIFCAAISEYDQMLFEDETKNRMMETKELFDWVLKQRCFEKTSFMLFLNKFDIFERKIQKVPLTVCEWFKDYKPIAPGKQEVEHAY

SEQ ID NO: 43792 - protein, 114 aa, Cyanothece sp. PCC 8801
MEEDTMTTTYKVRLIKGKKNQPPEMDVTLEVPEDEYILSVAEDEGLDLPSSCKSGACSSCVGRIVEGTVNQEDQSFLDDELIEKGWVLLWLLIPLPIVPLKPTKKPIFLKIVDS

SEQ ID NO: 43793 - protein, 384 aa, Burkholderia mallei ATCC 23344
MQSAAAPRSKLPDVGTTIFTVIGQLAAEHEALNLSQGAPNFAPDPALVERVARAMRDGHNQYAPMAGIAALREALGVKTERLYGERYDPDSEVTIVASASEGLYAAISALVHPGDEVIYFEPSFDSYAPIVRLQGATPVAIRLSPERFRVNWDEVAAKITPRTRMLIVNTPHNPSATILGEADVARLAQLVAGTDIVVLSDEVYEHVVFDGARHHSMARDRALAERSVIVSSFGKSYHVTGWRVGYCLAPAELTRELRKVHQFMTFAADTPMQHAFAAALAEPASYLELGAFYERKRDLLVRELAGSRFELLPSEGSFFMLARFGHFSDESDADFVLRAIRDARVATIPLSAFYADGANTGCIRLSFSKDDATLVEGARRLCSL

SEQ ID NO: 43794 - protein, 472 aa, Xanthomonas axonopodis pv. citri str. 306
MHRHVHEPEILADPAAAQTAEHWRQRDLAVVWHPCTQMREHPHTLPLVPIVGGEGAWLVGHDGRRYLDAVSSWWTNLFGHTEPRIGAAIARQAGELEQVMLAGFTHTPAVQLAEQLLAIAPRQAGRAPLSKVFYADNGSAGVEVALKMAFHYFHNRGDHRRTRFIALENGYHGETIGALSVGDIPLYRRVYAPLLLEAMFTPSPDAYLAEPGQSAEDHALQAADALQALFEHSPGEICALILEPRVQCAGGMRMYHPAYLRRARELCDAHGAFLIADEIATGFGRTGTLFACEQAGVMPDLLCLSKGLTGGFLPLSAVLATQQLYDAFLDDSRERAFLHSHSYTGNPLACAAALATLKIFADDDVIARNQPIAARMRALAAQIGEHPSVADVRQAGMIVAFELTQGGNKRTPFASAARVGLKAYRAALEKGVVLRPLGDVLYWMPPYCVDEAQLALLADTTRHAITEAVACA

SEQ ID NO: 43795 - protein, 495 aa, Pseudomonas aeruginosa
MLHSLKQTWLSNIRGDILAGIVVALALIPEAIAFSIIAGVDPKVGLYASFCIAVVIAFVGGRPGMISAATGAMALLMVTLVKNHGLEYLLAATLLCGVLQIAAGYLKLGSLMRFVSRSVVTGFVNALAILIFMAQLPELTNVTWHVYAMTAAGLGIIYLFPYVPKIGKLIPSPLVCIIVLTAVAMSVGLDIRTVGDMGELPDTLPIFLWPDVPLTFETLAIIFPYSAALAVVGLLESMMTATIVDDLTDTSSDKNRECKGQGVANIASGLIGGMAGCAMIGQSIINVKSGGRSRLSSLAAGVFLLLMVVFLGDWLKQIPMAALVAVMIMVSIGTFSWDSLRNLKKHPLSTNIVMVVTVVVVVATHNLAFGVLAGVLLAAMFFANKVGHYMAISSLLDEAGEHRSYNVTGQVFFSSADKFVAAFDFKEALNKVTIDLNRAHFWDITAVAALDKVVIKFRREGTEVEVLGLNEASATIVDRFGVHDKPDAIDQLMGH

SEQ ID NO: 43796 - protein, 293 aa, Zea mays
MPRPEFQAPPDVFYNESEARKYTTSSRIIEIQSRISERALELLALPNDGVPKLLLDIGCGSGLSGETLTEHGHHWIGYDISKSMLDVALERETEGDLLLADMGQGLGLRPGVIDGAISISAIQWLCNADKSSHEPRLRLKAFFGSLYRCLARGARAVLQFYADNVKQSEMIVTFAMRAGFAGGVVVDWPHSSKAKKSYLVLTCGPPSVTTSLPKGKGENGEACSDDDDNESSGEDGDRTVGIYERNRPKKRQKTKKNGKGKDWLLRKKEQMRRRGHDVPADTKYTGRKRKGYF

SEQ ID NO: 43797 - protein, 2087 aa, Arabidopsis thaliana
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCVSFSTRIDRGLPQEFCKQLIGMCVSKGMEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTVLGNPFLFNGGGDLNELGSGAAFESSRVFFLLPFLLSQGTGVMDLSKVGEKFLSSVKSATSLGLLPSPSISDRPEIPARAAAAAAVARALAGLPSDQRLSISSTATELNSIYGNRPLPQQVEELEEGFYEEDFDPVRHILENVPDDESELAYFEKQATLRLVQLDKVAETLSHHVMEHHEVMVKGMNLVRELEKDLKIANVICKNGRRNLTSSMNEASRDLIVHTHSKKKQALLDMLPILTDLRHARVMQSNLEDLVEDGNYCKAFQVLSEYLQLLDSLSEFSAAQEMTRGVEVWLGRTLHKLDSLLLGVCQEFKEDSYVMVLDAYALIGDVSGLAEKIQSFFMQEVISETHSVLKSIVGEDNSAATQYSRLTYSDLCLQTPESKFRQCLLRTLAVLFQLIYSYHEIMSFTPEKEAEILVSPSLATTQMVDSVTGSSCDPQDGGLLPGSIPPCTISAEESDGSGTSSSVQLASNIAIDESRNSEDRVSSSESPWYYLRKESAAFVSETLQRGRRNLWQLTTSRVSVLLSSPGASSTSIHQFLKNYEDLSIFILAGEAFCGFEVVDFREKLKGVCENYFTAFHRQSMHALKMVLEKETWTKLSPDTVQAINFAGLVGDGAPLIISSRSASGSSRFPHSDKPSNSIDPSGNRSGFSYWLKSGNPFSAKLTHYREDQDYSSINGEDHEGNDSIHDDVVNPKIRDIKRINGGSPVSEDENEDLLADFIDEDSQLPRRSFTRSQSRTSSSHFSTNDDLTAQTGSSLCLLRSMDKYARLMQKLEIVNAEFFKGICQLFGVFFYFVFQVFGQENTNSGGKGVSDSFNHRLKSCLSRISQECEQWIKPHVSSSPSSSLAFPNTVHSLADVTPASPLNTSGHLSGVSFSLKERCAAVDTVSLVARVLHKSKAHLQSMLMSRNGSLVEDFFGQLVGSVPDLTEHLHRTTARILLHVNGYVDRIANSKWEIKELGMEHNGYVDLMLGEFKHYKTRLAHGGIPQEVQNLLLEYGVEIFAEMLVEGLSRIKRCTDEGRVLMSLDLQVLINGLQHFVPTKVKPKLQIVETFIKAYYLPETEYVHWARAHPEYTKAQVVGLVNLVATMKGWKRKTRLEVIEKIESASM

SEQ ID NO: 43798 - protein, 355 aa, Vitis vinifera
MIVKVGSNSGGYRKGVTEAKLKVAINGFGRIGRNFLRCWHGRKDSPLDVIVVNDTGGVKQASHLLKYDSILGTFEADVKAVGDDAISVDGKVIKIVSSRNPLDLPWGDLDIDLVIEGTGVFVDRDGAGKHIQAGAKKVLITAPGKGDIPTYVVGVNADEYNHDESIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAGFRDSAEKELQGILSVCDEPLVSVDFRCSDVSSTVDSSLTMVMGDDMVKVIAWYDNEWGYSQRVVDLADIVANKWK

SEQ ID NO: 43799 - protein, 508 aa, Coprinopsis cinerea okayama7#130
MSSPSISPGVTKFSEQDREGHSAPWIQPKKNIVLTSHGRPPWYGEDGQRICDAFVIGIAGSIPTVIILSQASSGHFYKYHTPEELVLAHANKLDFDHPDALDMPIFASCLADLKAGKQSNIPIYSFSEHQRLEEKKYLYGASVIIAEGIMALVDPSLRALYDLKVFVQCDPDLMLARRIKRDVKERGRAVDGILDQYLRYVKPSYDNFVRPTAAHADIIVPGSNNAVAIDLMCTHIRQQLQERSKRFRGKIAIPHLYLPSKSGASTPESTIEDLDLHIMPQTRQIEGIFTILRDKDSSRQDFVFFADRLATLLVEHALQFLPYTPKTVVTPVGAEYDGQKQAAKYVCGVTIMRSGGALERGFRRVINDVPVGSLLVQSDFTTGDPLLLQVMLPQYVKLRHLAEETWVFLLDAQIGTAAAAFMAIRVLLDHGVKEDHIIFVTFLVARTGGVSVLRRAFPGVKIICGAVDEHMKEGWMEGYKGEGNPDGRGRAVWLMQPGMGQIGDRYYL

SEQ ID NO: 43800 - protein, 208 aa, Oryza sativa Indica Group
MDRYAFLSFYKCTHQVGKFVGSDTWSNVLRESWFFNNWKELLVPVSLSTFLLLGLKGYLDEQFCQVEDLQDEASPNFVEEVVTLFFKDSGRLMSNIEQALEKYPRDFNRWDTYMQQLKGSCSSIGASRMKNECMSFRDSCGQGNVEGCMRSFQKVKREHAVLRQKLESYFQLLRQAGPAGAATRPVMAHIGHASGSVLPTLFLFSEAC

SEQ ID NO: 43801 - protein, 404 aa, Aspergillus nidulans FGSC A4
MTVSLDSLFLTLIIFLTRLCSVSTAHVVPLEASKDPENITPGRQISQELFDSIEELAHIVDIAYCIGTTGIRKPFQCLSHCDELKGFELINTWHTGPFLSDSCGYIALSHPPSPKRIIVAFRGTYSIPNAIVDLSMYPQEYIPFSPGNDTDGDAPKCEDCWVHLGFMNAWRLTRATILDTISAARDQYPDYALTLVGHSLGGAVAALAGTEMQLRGWEPVVTTFGEPRVGNKAFVDYLDTVFRLESGNERVWKFRRVTHVNDPVPLIPLTEWGYEMHSGEIYIDRVELPFSVDDVRYCQGGSDPNCISDAEGKSTTFSPYSSQGFDLSESNMEQQVLSRSPHQSKDQQQENEKGAFPYLESQSTSCLPWGILPPRFRLWELFYSHRDYFIRLGLCVPKGDLSGG

SEQ ID NO: 43802 - protein, 562 aa, Ralstonia eutropha JMP134
MHPTDSARGGSPMRDVIAGCSIAGLLLPEAVAYAGIANLPPQAGLIGLLIGLVVYGLLGTSRFAVVSATSSSAAVLAAITVSMAGVDLAQRLLLAGGLVILSGFFLVLAGVARLGGITEFIAKPVLRGFTFGLAITIILKQVASVAGVHPTHGDLPRFTYELIQELAVWNMNGLIAALVVLLLLFAMSRWKNVPGPLVVIVLGIMLAHGVDMHHYGISQVGTIDLANVSFDIPDLPRAQWLRLGELAFALVLILYAESYGSIRSFALKYGDKTSADRDLVALGVANLGSGLLHGMPVGAGYSATSANEAAGARSRLAGWCAAVVVAMIVALLLPQLALTPEPVLAAIVAYAVSHTLRLSVFRPYWAWRRDRLLVVAACVAVLLLGVLDGLLAGIGVSLLITLRNFSEPNVSQLGRLGSSHDYVDITAHPEARTLPGVLIVRPEAPIFFANVERILAQVRHLADAGPGAVHTLIFSLEESPDLDGSTIEALHAFAAGATASGRRLLLVRLKPPALEVLSRSADEALPREALHELSVDECVQSLGQGGVAAATKAPGPAVEGSR

SEQ ID NO: 43803 - protein, 362 aa, Haloarcula marismortui ATCC 43049
MGHEESLRHLLRVAAGLESIVLGEDQILGQLRTAYETARGVGGIGPMLEDGVTKAIHVGERARTETKINEGVVSIASAAVRLLKQESSLTDGTALVVGAGEMGQLAAEALSEEVDRLLVANRTVPHAEHIAESVDIDASALALDGIEAAVSEASAVISATGSGDQVFDIGTFSDSGDVSIVDIAQPRDVPAGADRLPSVTVYDLDALESVTAETRNKRQRAAEAVERIVDEEFDRLLTQYKRKRADRVISTMYESAEQVKAAEINSALSAADFDDEQAEVVEAMADAIVSQILAAPTKSLRDAAEEDDWSTIHTALQLFDPDFGGPDQATPPEFTKGMSVEDIPDGMRDEIPNAMLDRLSDD

SEQ ID NO: 43804 - protein, 213 aa, Desulfovibrio desulfuricans G20
MTGMLRRGLGSHLKEHQLELLSGAVVGIAGAGGLGSNCAAMLVRSGIRNLVLADHDHVEPSNLNRQWFTPQQVGKSKVRALADNLYALEPELVLSVHQVRIDRTLLHDLFGSCSVVVEAVDDAATKSMIVSYCMEHGIFFVSASGMGGWGGPGMQVRGVRNAGVVVGDMQTAVVPGVPPMAPRVQMAAAMQADAVLCRILGPCVTADCIREQE

SEQ ID NO: 43805 - protein, 496 aa, Oryza sativa Japonica Group
MAVAVAASLSTPAPSPAAGGRGRRRVNVAVASLRRAAAGGGSSWRSERRLMSELERTVTPGAAERVIRSYVASKSERAALAALSRLLMDSDPFAIPFYEVVTQARWFKWSSIHAAAVAALLESNGSAEESRSLISDSISRLHSTSSSSEEVSLFYCDLMAAFSSRGMRDRAMDFYSQLRASPPLSGKKTYTAMIKSLCLMGLAGEAEAALREMASRGHQPEAFQFGLVAKCYGKAGSMAEMERVISSMSDAGIRLGTGAANIVLSCYTSCRDHSRMLAWLRRMRKLRIAPTTKAFNFVLNSCPTVASMAQELGESLPLSTAELVKKLRSASQWPAEAELVQELLTSSSVLDKAMDWSESEVKLNLHGFSTIAAYVLILQWVDAMKARRALPLEVSVVCGIGKHSDVRGEPKVRELAQEVLSRMGSPLRLSMRNKGRLVAKRDRVKQWLATDWSSPVDEESTDQSPNGDNQQPFLLTLMRKLGQVLSPFLQFSKGKA

SEQ ID NO: 43806 - protein, 556 aa, Ustilago maydis 521
MTTAPHTGIVESSVVATLAKILLTPLSGWPSMLQLLTGSFVLLFGWIVYNLAISPLSRYPGPLSARLGIPFWRFWHSLQGDYAPALYSLHRKHGDVVRIGPTHLSFADPTAMNSIYSLSDGVSSKFRKSNFYRSFQVFKAHPSIFSERDPHQHSKRRRAVASAYSMNSLVKLEEYVEDVTELLLKRLDELVETNSVVEGGGTSEKTKTKAVRLDPWFHYFAMDVVGELAFGQSFNLLHRGKDDERFLTGVLNLSQWGAVAGCMPLLSSLILWLFPRITGQPGGSVIGDKTTSRIQTRYAEVQDNGGVASRPDMLTKFMEARDPDTKEKYSMKQVLFSASSVMSAGSDTTATSLTIFFGYLLEHPACYAKLRQEINEAIQAGHLISPVKYAKGAQLEYLQACIKEALRLSPPISMDLPRYVPAGGALIGKNPHVIPAGTTVGISPYVLHRQPEAFGADAEMFRPERWLEGGEEGRKAMERFNMTFGGGSRACIGKNISLMELSKTIPEILLRYDIKKPAVSTHLHTTPSNAKQPFFQGKSAWFLEAHVSHHRFHNFE

SEQ ID NO: 43807 - protein, 158 aa, Lactococcus lactis subsp. cremoris
MDRKMTVFEGNLTTGNAKYGIVVARFNEFINAKLLAGALDALKRHGVQEEQIDIAWVPGAFEIPLIAQKMASSDKYDAIICLGTVIRGSTSHYDFVCSEVSKGIAHVSLNSNIPVMFGVLTTENIEQAIERSGTKAGNKGFEVAVGAIEMVDLMAKMS

SEQ ID NO: 43808 - protein, 221 aa, Triticum aestivum
MSRRGDWVYENNGGTCVAIAGADYCVVAADTRLSVGYNILTREHSKICELADKCVIASSGFQGDIKALQKNLAARELLYQHQHNKRMSCPAMAQLLSNTLYYKRFFPYYAFNVLGGLDSEGKGCVYSYDAVGSYERTGYSAQGSGSTLIMPVLDNQLKSPSPLLVPARDAVTPLSESEAVDLVKDVFASATERDIYTGDKVEIVVINKAGTRREYIELRKD

SEQ ID NO: 43809 - protein, 86 aa, Neptuniibacter caesariensis
GVLNMTDEAGEDAKLVAVPHEKLTKAYKDVNDISDLPQLELDRIKHFFENYKGLEEGKWVKVEGWDNAEAAKAAIVEAAKAYEAAK

SEQ ID NO: 43810 - protein, 469 aa, Burkholderia mallei ATCC 23344
MQTESNGRPGAGGGAARPALQQTLGTWQLWGIAVGLVISGEYFGWSYGWASAGTLGFVVTALFVAAMYTTFIFSFTELTTSIPHAGGPFAYARRAFGPTGGYLAGVATLVEFVFAPPAIALAIGAYLHVQFPGLEPKHAAMGAYLVFMALNIVGVQIAATFELVVTLLAIFELLVFMGVVSPGFAWSNFVKGGWAGADHFSAGAFHGMFAAIPFAIWFFLAIEGVAMAAEEAKHPKRSIPIAYVAGILTLVALAIGVMVFAGGAGDWTKLANINDPLPQAMKYIVGANSGWMHMLVWLGLFGLVASFHGIILGYSRQIFALAREGYLPEWLAKVHPRFKTPYRAILAGGVVGIAAIYSDELIQFGGQTLTANIVTMSVFGAIVMYIVSMAALFKLRRVQPRMERPFRAPLYPFFPAFALVAALVCLGTMVYFNALVASIFVAFVALGYGYFLATRAQREAAPADALLEE

SEQ ID NO: 43811 - protein, 153 aa, Pavlova lutheri
MGELPRRIQKETQRLLSEPVAGISASPYQDNLRYFNVVLAGPATSPFEGGIFRLELFLPEEYPMAPPKVRFLTKIYHPNIDKLGRICLDILKDKWSPALQVRTVLLSIQALLSAPNPEDPLDAGVADHWKSNEAAAIEEAKRWTQQYATGSLP

SEQ ID NO: 43812 - protein, 387 aa, Oryza sativa Indica Group
MRTNTTTTATVLLAAAVALLLATAARGDGGDGGCGKEDAAAGRDQARARGLKIAAFFSILVCGALGCGLPSLGRHVPALRPDGDVFFLVKAFAAGVILATGFIHILPDAFDNLTDDCLPAGGPWKEFPFAGFGAMVGAIGTLVVDTLATGYFTRAQSKKDAAAAVADEEKQSAAATTQQHNHHYVVGDGGGGEEHEGQVHVHTHATHGHAHGSSALVAAVGEDDKETTLRHRVISQVLELGIVVHSVIIGISLGASQNPETIKPLVVALSFHQMFEGMGLGGCIVQAKFKVRSIVTMVLFFCLTTPVGIAVGVGISSVYNESSPTALVVEGILNSVAAGILIYMALVDLLAEDFMNPRVQSRGKLQLGINLAMLAGAGLMSMLAKWA

SEQ ID NO: 43813 - protein, 672 aa, Gibberella zeae PH-1
MAPQPEKSQLKRQRGSLPEDETETKKPRRTERLAVDADKTPVVNKQHLPSPLTHLTDDSSELNKDSTVTPPEKKETESTPKKSEDNSQSQALSSPPQDTQPLSQFVDRHSAISDDIEDEIREGVWGYLVPLDPKYGDKPIVLKKRSACPLPDTVSDAAKKENKNNTNDKNGKSAAMKDEETFEKKKKEKGAPSGGYLIGRHPECDIVVNDGIVSNRHCLLFTENKGNDTVAIVEDLSSNGTYVNEAIVGRNQRRELEEQDEIAVHGKARFVFRYPQTRQTSAFLQQYTLLEKLGKGHFAEVYLCVEKTTGQRFAVKIFTKHPGVEDRSKTEGLQQEIGVLMGVSHPNVLCLKDTFNERDRVYLVLELAPEGELFNFIVMKQKLSEDESRKLFVQLFQGIKYLHERNIVHRDIKPENILLVDKNLHVKLADFGLAKIIGEESFTTTLCGTPSYVAPEILADSKQRKYTKAVDVWSLGVVLYICLCGFPPFSDELYSRDFPFTLSQQIKSGRFDYPSPYWDSVGDPALDLIDSMLIVDPEKRYTIDQCLQHPWLTQSSPSVNDSTGGLVGGIASLQVQRRAAARERTLLSSLNTVEVTAQLDAGKDKRPVKVFAKNKGRVTNFSKESDPASRRAPDEFIEMGGKGDQELFPDDDSSIYPTGDNGEKIKATKAQR

SEQ ID NO: 43814 - protein, 301 aa, Agrobacterium tumefaciens str. C58
MTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 43815 - protein, 293 aa, Triticum aestivum
MAMASSTTASVAAASLRALAGASPAPLPKPFLVLLSPAPPRRLGLGLRAARPRGPLAPLASSDSFFETSAAVDVAEPEDEAVAEEEPAVAEEEEDVAAEEEVEEVGEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELFSEHGKVVDARVVYDRDTGRSRGFGFVTMASQPELDDAIAALDGQSLEGRALRVNVAEERPPRRF

SEQ ID NO: 43816 - protein, 190 aa, Zea mays
FSEVNQEIASYLGLELGKITIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSDDLVVVSPDVGGVARARAFAKKLSDAPLAIVDKRRPGHN

SEQ ID NO: 43817 - protein, 417 aa, Aspergillus nidulans FGSC A4
MMFSRFFKAVPARAPAFSSPLPVYQARTMATVRNQRPVERATFTIRDGPIFHGKSFGARTTISGEAVFTTSLVGYPESLTDPSYRGQILVFTQPLIGNYGVPSTERDRHGLLKYFESPNLQAAGVVVADVAEQYSHWTAVQSLGEWCAREGVPAISGVDTRAIVTYLREQGSSLARITVGEEYDADQDEAFTDPEQIHLVRQVSTKAPFHVSAADPQCHVAVLDCGVKENILRSLVSRGASITVFPFDYPIHKVAHHFDGVFISNGPGDPTHCQDTTYHLRRLMETSQVPIFGICLGHQLLALAADASTLPSDWKPYFVNLNDSSNEGMIHKSRPIFSTQFHPEAKGGPLDSSYLFDIYIDSVKKYKNSQLAFHPSRETIPSPLLVDLLPKERVDVAPTIGMQNVAAAAAAAAAATA

SEQ ID NO: 43818 - protein, 443 aa, Aeromonas hydrophila
MHEALQQALTSALDSFEDVPGFRRYGRLVRVTGLTLEVVGCQLVMGQRCRVDTATGAPLLAEVVGFNRDISYLMPLQPMSGLYAGARVLPIDGEETIQVGEHLLGRVVDGLLQPLDGRPLRDDGERVALFASPPNPLLRTPVREPLDVGIRAINGLLTVGKGQRLGLFAGSGVGKSMLLGMMTRNTTAQIVVVGLIGERGREVREFIEHSLGPEGLARAVVVAAPADQSPLMRLRAAQLCHRIAEYFREQGRDVLLLMDSLTRYAQAQREIALAIGEPPATRGYPPSVFSMLTQLVERAGNGTHPDGSLSAFYTVLAEGDDQQDPVVDAARAILDGHIVLTRRLAEEGHYPAIDIGASVSRVMPQVVPAEWQTLAVTLRQLWGRYQQVRELLPLGGYQPGADPQMDEAVQRYPAIAAFLQQGIHEETPFAQVMTGLKQVLGKS

SEQ ID NO: 43819 - protein, 373 aa, Arabidopsis thaliana
MTIPELPKDLIEEILCYVPATYLKRLRSTCKGWNRLFKDDRRFAKKHYDKAAKQFLPLMSTNEELCAMSVNLHGTIPSLEVKDKPWLFVSDSKHCDIEISRIFHSGGLLLCFSRDGEISIIVWNPLTSETRLIRTRNRRDKGRNFVLGYYQEDKKTYYKILSFYLDSKDFEIFEFNSDSWRFIDDICPGLSLLYSDQCVSLKGNTYMFAIDDLSVSLLKYDFSTETSVPVPLPYKSRSFEAISLSVVREEKLSVLLQRDKSSKTEIWVTNVIDETTTKVMVVSWSKVLSLDLSPDLKIRYGESFLLDEEKKVIMIFNNRMEEENKSEDKLYIIGDDDNKATQVYTIHGYGPAVFNYFPSLVQIEQSSRQEEKS

SEQ ID NO: 43820 - protein, 2333 aa, Cryptococcus neoformans var. neoformans JEC21
MSIPTPPAFQGVVPPSDIPATQQASSLAPAAHSAVAPEADTPTMERTPSSAPVPRPAGSLYPPATLKGIDYQGMPDEPKWDDSMGEPDAVLELADGLALAGHSFGAKKSVAGECVFQTGMVGYPESLTDPSYSSQILILTYPLVGNYGVPERPDVETSHVPTSEDAHNVPPASSLLDSLPLEFESSHIHVAALVVANYHPSFSHHLATSSLGKWLEEQGIPAIWGVDTRMLTKRLREGGVLLGRVLNKRAGVLDGERGRDGQSGVLGGVQRLINGLSPSTSMAQTQSIDKFNVSWREDFETIPYYDPNHENLVAKVSTKAPVVYTASTSSDKKIHPQTGRQMRVVAIDVGMKWNQIRCFRERGIEVKVVPWNYDINNESEPYDGLFVSNGPGDPSMVKETISNLSQALETSKVPIFGICLGHQLLALASGAKTRKMKYGNRGMNIPCTCATSGRCYITSQNHGYEVDVTTLKNGWEPLFTNANDGSNEGIWCGKNGKPFFSVQFHPESAPGPRDTEFLFDVFIQSIVDTAREGRLISIDVPGGELATNIAAKPREQVKKVLVLGSGGLSIGQAGEFDYSGSQAIKALKEEGIYTILVNPNIATIQTSKGLADKVYFLPVTPEFVLKIIKHEKPDGIYCTFGGQTALNVGIKLKDEFSKLGVKVLGTPIETIITTEDREMFARAMEEIGEKCAESATAVNLTEAIEAANRIGFPVIVRAAYALGGLGSGFAKDVEQLTELCGKAFATSPQVLVEKSMKGWKEIEYEVVRDCRNNCITVCNMENFDPLGIHTGDSIVVAPSQTLSDADYNMLRTTAVNVIRHLGVVGECNIQYALNPYSKEYCIIEVNARLSRSSALASKATGYPLAFIAAKLGLNIPLNEIRNSVTKLTSACFEPSLDYCVVKIPRWDLKKFNRVSTALSSSMKSVGEVMAIGRTFEETIQKAIRCIDDQLPGFGDHAKVEDLDYEIANPTDKRLFAIAAALKKGYSVEKLNEMSSIDPWFLTRLQRLIKTEQVISQYNASNVPSALVLNAKQLGFADRQIAKMLSSNELAVRRLRIEAGITPFVKQIDTVAAEFPAFTNYLYTTYNATEHDVDFEDNGVMVLGSGVYRIGSSVEFDWCAVRAIRTLRENGMKTVMINYNPETVSTDYDEADKLYFENISLETVLDIYDTEHSSGVVLSMGGQTPNNIALALHRQNVKIYGTSPEMIDTAENRYKFSRMLDKIGVDQPLWRELTSFPEAKAFCDKVGYPVLVRPSYVLSGAAMNVVFSQDDLNNYLTQATDVSRDHPVVISKYIEEAKEIEMDAVARDGKMVMHYISEHVENAGVHSGDATLVLPPQDLDAETVRKIEIATQKIGHALNVTGPYNIQFIAKNNEIKVIECNLRAARSFPFVSKVTGIDAIEIATKVMLGLPVTPYPDVKMPANYVGVKVPQFSFSRLSGADPVLGVEMASTGEVACFGKDRYDAYLKALISTGIVPPKKNILLSIGSFKEKLEMLPSVHKLHRMGYNLFATAGTADFIQEHGIPVKYLEQLGSENDLNPQKKEYSLSQHLANNLIDLYINLPSKNRFRRPASYISQGYKSRRMAVDFAIPLITNVKNAKLFIEAIIRKPTFDISSVDYQTSHETFTFPGLVSVQAFVPGAAEESSTDFGEATEAAIEGGFTIMQMVPQGVNSAVEDEISLQRAQANASGAAHCDYSFSVAATADNASRLQDAIAAGAKALYIPFNNFYGANNKVSSVSQHFAAWPADRPIITDARATDLASTLLLASLNNRSIHITSVSTKDDLLLIALAKEKGLAVTCDVSIYSLFYCQTDFPDAAKVLPSKADQEALWDNLASIDVFSVGVLPYELGRALNKPVSARSGVAESLPLLLTAVTEGKLTLEDISLRLSENPRAIFGLPEQSQTYVEIEVNRRSSFTAEDAERTWSPLDGQAIAGNVHRVVANNHSIFLDGQSFSMPFGRDISASGSRPTKQARGSFALQKRPSVTALMSPISEKTSSAGAKLMSLASVAPIRELSPIRGLVSVQTHPTFSRRHILSVKQFDREDLHALFNVASEMRTAVERSGSVDTLRGRVLCTLFYEPSTRTSTSFEAAMKRCGGEVVQVNASTSSVQKGESLADTIRTVGCYADAIALRHPSVGSAKAAAKSSPVPILNAGDGIGEHPTQSLLDVFCIREELGSVNGITVTLIGDLKNGRTVHSLVKLLSLYDVTLNFVSPRSLAMPESVKTEAFRAGIRFTESFTLTDEIVSRSDVLYVTRVQKERFENIAEYEAVKDIYVINNDVLEKAKESAIVMHPLPRVNEIDPEVDFDSKRAAYFRQMRYGLFVRMALLTLVMGA

SEQ ID NO: 43821 - protein, 530 aa, Colletotrichum trifolii
MPTLGFLKKKRTREGNQDPQGSLPTSPVTPTSSKPFDSSISTTLSSLSNNSQATSQPSGPGQKQQEDPASSEAAKNQQMYPVTVHPAPNQQHYNQQGEPQQNLPSISNLINPTQHDASSNGHNYLAHATQTSQPNPSPGTDPTRLQQQQAQSMLHPPTQPQQQQQQQQQQQQQQQQQQQQQQQQQQTQTQQPTAKERHAATGAGPAGRQTKGKYTLQDFDILRTLGTGSFGRVHLVQSKHNQRFYAVKVLKKAQVVKMKQVEHTNDERRMLGEVKHPFLITLWGTFQDSKNLYMVMDFVEGGELFSLLRKSGRFPNPVAKFYAAEVTLALEYLHSRDIIYRDLKPENLLLDRHGHLKITDFGFAKRVPDKTWTLCGTPDYLAPEVVSNKGYNKSVDWWSLGILIYEMLCGYTPFWDSGSPLKIYENILKGKVKYPAYINPDAQDLLSKLITADLTKRLGNLYGGPNDVKTHPWFQEVTWDRLARKDIDAPYTPPVKAGAGDASQFDRYPEDPERYGSSGHDEYGHLFTDF

SEQ ID NO: 43822 - protein, 341 aa, Oryza sativa
  misc_feature (233)..(233): Xaa can be any naturally occurring amino acid
  misc_feature (239)..(239): Xaa can be any naturally occurring amino acid
  misc_feature (253)..(253): Xaa can be any naturally occurring amino acid
ITPPIPSSSAAKHLASSAMATATASSLSLLFAHPHSSNPRPFAGGPHLRRPLRAAPHRARCASDAATTATRHRRPAEENIREEAARLRGPGNDFSAWYVPFPPTPEDDPDERYSLDEVVYRSSSGGLLDVCHDMEALARFPGSYWRDLFDSRVGRTAWPYGSGVWSKKEFVLPEIDSDHIVSLFEGNSNLFWAERLGREHLGGMTDLWVKHCGISHTGSFKDLGMTVLVSQVXNRLRRXPFSRPINGVGCASXTGETLRRGFSAYWAPRKGFPAIRVPPPANRILFWQQFHPGQIAKRGPPGVSGGKPGIFKGGARRVLSRGGGTPPKSNPNFFPLAQTPA

SEQ ID NO: 43823 - protein, 290 aa, Vicia faba
MEAKEQDVSLGANKFPERQPIGIAAQSHDDGKDYKEPPPAPLFEPSELTSWSFYRAGIAEFVATFLFLYITILTVMGVNKSQSKCATVGIQGIAWSFGGMIFALVYCTAGISGGHINPAVTFGLFLARKLSLTRAVFYIVMQVLGAICGAGVVKGFEGKAFFGEKGGGANFVAPGYTKGDGLGAEIIGTFVLVYTVFSATDAKRSARDSHVPILAPLPIGFAVFLVHLATIPITGTGINPARSLGAAIIFNQDRGWNDQWIFWVGPFIGAALAALYHTVVIRAIPFKSRS

SEQ ID NO: 43824 - protein, 463 aa, Cryptococcus neoformans var. neoformans JEC21
MSVRLFRICRTKCAAPLSRGYATELKPNLAYLQVTHPDTAPAPTQSLIQEHSKYLLNTYVRPPILFSHGSSCTLTSTSGKDYLDFTAGIAVTALGHSDQGVNNVMAEQAGKIGHASNVYWNEHAGELAKSLIENTRTHGGLGLGKAEGDDKGGRVFFSNSGTEANEGALKFARAYGKTIAEDKSDIVCFSNAFHGRSLGALSCTPNPKYQAPFAPLIPGVKVGEYNDMSEERLKDLVNEKTCGVIVEPIQGEGGVGEGKKEWFEMLGKRCKEVGAVLIYDEIQCGLFRSGEMWAHSSFPAAAQPDIVTMAKPLANGFPIGAIMVRSKIANAISPGMHGTTFGGQPLACAMGVHVLERLSAPAFLDNLQSTSAYLGKKAEKLPQLFPSLIKEIRGRGLIRGIAFKDESKPGELVKLARERGVLLLTAGKDAVRLVPALVVSKEECDKAMGVIESCLHIIEGDKA

SEQ ID NO: 43825 - protein, 595 aa, Myxococcus xanthus DK 1622
MSFLQQALVFLAAAVLAVPLSRRLGLGSVLGYLAAGAVIGPWGLKLISDVEHIFHVAELGVVLLLFVIGLELQPSRLWALRRSVFGLGGAQVLFTGALLASVGLLCSLTWGAAIVTGFGLSLSSTAFALQLLAERNRLTTPYGQLAFGILLFQDLAVVPLLALLPLLGDGGAPSPGPVWLLLLKDVGVLLAVVLSGRYLVRPVFRAVAATHSQELFTATALLLVVGTASVVNAVGLSMALGAFLAGVLLADSEYRHELEADLAPFKGLLMGLFFISVGMSVNLSLILQKPLLVFGLVLGLVALKGAVLYGLGRMALGRREPALDLAVVISQGGEFAFVLFSLATAQHVMERSLSELLVVVVGLSMATTPVLYAAHERWVRPRFKPKASGREFDVAPTEDNPVIIAGFGRVGQVVGRLLRAKRIGFTAIDASPEQIDFMKRFGSQVFYGDASRLDLLRAARADKAKVFVLAIDDIEASLRTARAVQQHFPHLTLFARARNRVHAYELLDMGIERVMRETFLDSLEMGAGVLQELGLTYSESRRAQERMMEHDERLLRETARFHRDEQKLVELADKARKELESLFEKDEAEHPDRTA

SEQ ID NO: 43826 - protein, 551 aa, Aspergillus nidulans FGSC A4
MSSFLEFDSQLTTRQQELKTSHVEGSQTPEDKTQHRPKDASSVRDTVPDREVSGPVLGPMHDMGPAQTSDGQPLSNRTLIHDLTLPPVPNLDIPASPPGSPNSAANAKFQHFLSLKKQGIHFNDKLANSVSLKNPSLLSQMMQHAGIDDRAQYSSSLPTEMWNTSDLPSWGYKEELLKAQRELNAKVDETRAKGQRDTIEFVSDTGRSYSASHPKSKPRVKRNWTKTCQLEAASMSNSFKCDLERITRFLVDRSCRPGYYDFPPSINTGPLQYRATKTTSLLDIFYKLTFVMNHFPGTWGRPRDDVYGPYDSSYLQTTGPKTHTQSPAVTGTSVIAVKFNGGVAIAADNLASYGSLARFTDVKRLRKFGDAAVIGFSGDVSDMQYIDRLLESIDIRENYSVHGNQLNAKNLHTYLSKVFYKRRSDFNPLWNHILVAGFDSEKKPFLSSADLLGTTFSAPHLATGFGAHLAIPILRRLFPEERPIEEISKEDAVSALKDCLKVLWYRDARSMDKYSLALITQEGIEMHEDQQVEAQNWAFAESIKGYGAQAV

SEQ ID NO: 43827 - protein, 198 aa, Bacillus pumilus SAFR-032
MNLIPTVIEQTNRGERAYDIYSRLLKDRIIMLGSAIDDNVANSIVSQLLFLEAEDPEKDISIYINSPGGSITAGMAIYDTMQFIKPKVSTICIGMAASMGAFLLAAGEKGKRYALPNSEVMIHQPLGGAQGQATEIEIAAKRILSLRDKLNQVLAERTGQPIEVIERDTDRDNFKTAEEALQYGLIDKVLTRNTEEQK

SEQ ID NO: 43828 - protein, 261 aa, Aspergillus nidulans FGSC A4
MTSLFSQDPHINPIGYSFAQPTNAGNKEHSFYPYTDNGGSVLGITGKDFAVLAGDTRSTSGYNINSRYVPKVFKIGGEDETGKGAHILLSVVGFAADGLALKERLDAVVKMYKYQHGKPMSVRACAQRLSTILYQKRFFPYYVQAILAGLDEEGKGALYGYDPVGSYEREQCRSAGAASSLIMPFLDNQVNLKNQYIPGSGEGHALEARKPEPMSRETVEQLVRDAFTSAVERHIEVGDGLQMLVITADGIEEVYHPLKKD

SEQ ID NO: 43829 - protein, 540 aa, Bacillus pumilus SAFR-032
MRFYGRFEGYDTSKLRRDLIAGLVVGVVAIPLGMAFAIASGVGPEYGLYTVIVAGILISLFGGSKYQIGGPTGAFVPILFGIVSQYGIENLLIAGFMAGCILVLFGIFKLGKLMKFIPRPVIIGFTAGIAVIIFSGQIANFLGLKGVEKHESFFLNMREIVVHLGTVNSLAILTAVIGLIVILAAQKYIPKIPGALLGLLASTFLAVLFFQGQVETIGSAYGEIPRQLPSFAFPELTIEKMIYLLPPAIVIALLGGVESILSAMVADNMKGSKHDSNKELVGQGIANMAAPLFGGIPATGAIARTATNIKNGGASPISGVVHGVVVLLILMLFAPYASMIPLAAMAPILMFVAWNMSEKKEFINIVKVKNADSLVLVVTFLLTVIGDLIIGVTAGLILAFIAFIKKMSQITSIRPNVVVPQMETAAALEKQTDQQGISMYAIEGPLFFGTTDSLENSILDHVQTKPKTLILLMNKVNYMDTSAEAVLMNISNRLKHHNGKLMIVGLQSQPKELLRRTGLFHHIGKQYFFERTDDISPQHL

SEQ ID NO: 43830 - protein, 91 aa, Glycine max
  misc_feature (41)..(41): Xaa can be any naturally occurring amino acid
  misc_feature (76)..(76): Xaa can be any naturally occurring amino acid
MDANGNWEEDDDEEFELSRNYFQANELASSSAKTSRHQLIXFYVIDKHELRDAASKIEPNHEYEIPLLLDTYNIMXPEWICALMFCFGLLM

SEQ ID NO: 43831 - protein, 360 aa, Vitis vinifera
  misc_feature (107)..(107): Xaa can be any naturally occurring amino acid
  misc_feature (261)..(261): Xaa can be any naturally occurring amino acid
  misc_feature (359)..(359): Xaa can be any naturally occurring amino acid
MASTQFPSFRAAPVQSVQELIKEPIPAVPQPFILDDPQSPILSASTPLPLLPTIDMKHIIMSETADAELEKKQTCVFMDAQLVNHGVSSSLVEKLKSEIGEFYKLPXEERIKYKMRPRDFEGYGLSPIRSEDQKLDWGDRFYMTTNPIHTRKPYLLPELPPSLRDSLECYLAELQKLAMMLLGFMAKALKLEKGEMEELFEDGMQSVRMTYYPPCPQPELVMGLTPHSDATGITILLQINGVDGLQIKKDGVWIPVSFLPXALVVNIGDILEILSNGVYTSIEHRATVNAAKERISIAMFFNPKSSAQIKPATSLINPHNPSLFKQVSMEKYVKDFFSRKLDGKWYIEHLKIKNEEEYXT

SEQ ID NO: 43832 - protein, 434 aa, Cattleya bicolor
MSKVFGIEAPLSKIALSKAHGEDSPYFAGWKAYEENPYDAMNNPNGVIQMGLAENQLSFDLLEEYLEQHPDAFGWGSDLSGFRENALFQDYHGLQTFRKAMASFMEKIRGGRSKFDPNRIILTAGATAANELLTFILANPGDAILVPTPYYPGFLRDLQWRTGVTIFPVHCDSSNGFQLTLSSLEKAYADAKASNFKVKGLLITNPCNPLGTTASFSLLQDIILFISDKNIHLISDEIYSGSVFSSTNLFSISDLITDAVSEQIHIVYSLSKDLGLPGFRVGALYSYNDRVVKTARRMSSFSLVSSQTQKLLAFMLSDEEFTVRYIEKNRERLTERYELVVEGLKEARIECLKGEAGLFCWVNMEELMEEKTMEEELKLWKVIVEELKLNITPGSSCCCSEPGWFRVCFANMSRETLEVALRRLKDFAQKKDCR

SEQ ID NO: 43833 - protein, 169 aa, Methylococcus capsulatus str. Bath
MANVNIQAGAGEGLQEKLVAVRRVSKVVKGGRQFGFTALTVVGDGNGRVGFGLSKAREVPVAIQKSMEQARKNMRKVALNGQTLHHPVTAAAGAAKVHMQPASEGTGIIAGGAMRAVFEVVGVHNVLAKCIGTNNPINVVRATIKGLTALRDPKSVAAKRGMTVEELLG

SEQ ID NO: 43834 - protein, 361 aa, Coccidioides immitis RS
MAFSNIYGDYEVRMPMTGLAEVYLERAAFLKIGSTPACVTSLSAEARILCDLAGVPGVPQLLWSETVPAHTVIVTDVYRPTLGAIYKQAGRRLGLDLILSLGEQLLSRLEWIHSRSISHGNLTPEALAGGAGGSWQSHQLFITDFQCAKRIDEPSAIWPAQQADLKALGAILIYLLGSCDSWDEFQKEGIPEGAEIPALITTFCECHLQVEKIGKEICLPADDAPGLRLLRSLSEVMELYMSILLQKRMTRQHLLPKPYDLPSRLWRDLRWYLAAVADMTVDFQKVVIEMIYGFMAALSDVVPCYRLHWLGNLITLADERGRVDTDNTKEEALKRAKWGWREHYNTLEVELMPMSSPQILS

SEQ ID NO: 43835 - protein, 123 aa, Desulfovibrio desulfuricans G20
MSKHILIVDDSKTVRNLVAFIMKKEGFRVTMAEDGLDGLEKLYSAEETVDLIISDVNMPRMDGFTFIKTVREQDTYRDLPIVVLSTEGQEKDIQMGMSLGANLYMVKPAQPDKMVKNIKMLLG

SEQ ID NO: 43836 - protein, 321 aa, Arabidopsis thaliana
MKKIQIGAVALLVFLSVVSLFEIGLASPNTVPAFLWSPHLQSANGELDEAVNYQVMSAKDLVGSVFTQGGWSNFLCSEKKLEQPVDVALVFIGRELLSSDVSSKRNSDPALVNTLNNLFTASNFSLAFPYIAAPEEERMENLLLSGLKEACPNNVGVSNIVFSDSCFVEDGTIQKLSDLQSFKDHLLARRETRKEGETDLVVLCSEGSESNSQAGQSHSERESILELVSSVEQSGSKYTALYVSDPYWYTSYKTLQRFLAETAKGNSTPEIATGCDELCKFKSSLLEGILVGIVFLLILISGLCCMAGIDTPTRFETPQDS

SEQ ID NO: 43837 - protein, 446 aa, Yersinia pestis CO92
MSESPALDHALKSIENIHLARVAGRLVRVTGLLLESVGCRLAIGQRCRIESVDETFIEAQVVGFDRDITYLMPFKHPGGVLGGARVFPSEQDGELLIGDSWLGRVINGLGEPLDGKGQLGGSTPLQQQLPQIHPLQRRAVDTPLDVGVNAINGLLTIGKGQRVGLMAGSGVGKSVLLGMITRYTQADVVVVGLIGERGREVKEFIEHSLQAAGMAKSVVVAAPADESPLMRIKATELCHAIATYYRDKGHDVLLLVDSLTRYAMAQREIALSLGEPPATKGYPPSAFSIIPRLAESAGNSSGNGTMTAIYTVLAEGDDQQDPIVDCARAVLDGHIVLSRKLAEAGHYPAIDISQSISRCMSQVIGSQQAKAASLLKQCYADYMAIKPLIPLGGYVAGADPMADQAVHYYPAITQFLRQEVGHPALFSASVEQLTGMFPSFAPTDEA

SEQ ID NO: 43838 - protein, 229 aa, Chlamydia trachomatis D/UW-3/CX
MTDFHNKPNIQIMFDSLAPTYDKINGILSLGLHIAWNNALVSLLGETNHLLDLCAGTGRVALSYVQNYPRASATLVDFSTKMLENVQKRHPSAPFSYITSDVTHLPLPDNTFRLASMAYGLRNLSYPLEALREVYRVLQPGGHLGILELTRPATYNPVYLLHKLYLNLVVPSVGRFYSGNSYAYSYLKESIRDLPRDAALEAIFHAAHLRPIRKRKLLFGTATIWILEK

SEQ ID NO: 43839 - protein, 174 aa, Frankia sp. EAN1pec
MIIIPFNGKSPKVAASALVADNVTLIGDVEIGEECSIWPGVVIRSDTTPIRIGNNVHIEENSVLHTSTHIEDNVMIGHNCTIEAFVGHDCMIGNTAALMPLSRVGAHCAIAAGSVVLEQVEIPEYCFAVGAPAKVHSKIDPGNPKHAMRLASTYLPTMRKIADEYRRQGIWSRA

SEQ ID NO: 43840 - protein, 311 aa, Thermus aquaticus
MRVLVTGGAGFIGSHIAEALLREGLEVAVLDNLSTGKRENVPPGVPFYQVDLRDGEGVERVFREFRPTHVSHQAAQASVKVSVEDPLLDFAVNLVGGMNLLEACRRHGVEKLVFASTGGAIYGEVPEGEAAEETWPPRPKSPYAASKAAFEGYLSAYGQNYGLKWVSLRYGNVYGPRQDPHGEAGVVAIFAERVLKGEPVTLYARRTPGDEGCVRDYVYVGDVAEAHTLALLSLEGVYNVGTGEGHTTLEVLKAVAEAALRTPEVRHAPPRPGDLERSVLPPLKLMAHGWRPRVGFREGIRLTVEHFRGAV

SEQ ID NO: 43841 - protein, 242 aa, Zea mays
  misc_feature (22)..(22): Xaa can be any naturally occurring amino acid
MEYVNPLTGFRVDGRRPNEMRXLKGEVGVVVRADGSALFEMGNTRVIAAVYGPREVQNKGQQVNSKEALVRCEYRMAEFSTGDRRRKPKGDRRSTEISLVIRQTMEASILTHLMPHSQIDIYVQVLQADGGTRSACINAATLALADAGIPMRDIATSCSAGYLCSTPLLDLNYLEDSAGGSDVTVGILAKMDKVTLLQMDAKLPIDTFENVMGLAIEGCKAIATYIREVLLENTKKLECQRG

SEQ ID NO: 43842 - protein, 340 aa, Bacillus anthracis str. Ames
MTKITVVGAGSWGTALAMVLADNGHDVRIWGNRSELMDEINTKHENSRYLPGITLPSTIVAYSSLEEALVDVNVVLIVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEVLESMGMVVEGVRTTKAAHELAEKMEVEMPITAALYDVLFNGNNVKDAVGSLMGRVRKHEVEAIPDLL

SEQ ID NO: 43843 - protein, 311 aa, Thermus aquaticus
MRVLVTGGAGFIGSHIAEALLREGLEVAVLDNLSTGKRENVPPGVPFYQVDLRDGEGVERVFREFRPTHVSHQAAQASVKVSVEDPLLDFAVNLVGGMNLLEACRRHGVEKLVFASTGGAIYGEVPEGEAAEETWPPRPKSPYAASKAAFEGYLSAYGQNYGLKWVSLRYGNVYGPRQDPHGEAGVVAIFAERVLKGEPVTLYARRTPGDEGCVRDYVYVGDVAEAHTLALLSLEGVYNVGTGEGHTTLEVLKAVAEAALKTPEVVHAPPRPGDLERSVLSPLKLMAHGWRPRVGFREGIRLTVEHFRGAV

SEQ ID NO: 43844 - protein, 600 aa, Colletotrichum trifolii
MKEPSLPPRRWRKPSRQPSEAWYSRRGAARGFGILPTRTTQTALASSHPQGSLSTGGALSVAGSVRPGSSQRVAGSFINGAARPQTSGGSGFSGIPTNHGRISGKYMPYALLDFDKMQVFVNSVEGTPENPLWAGGNTQYKFDVSRVTELVIHLYIRNPMAPPGAGRSQDIFLGVVRINPRFEEKQAFVEDPKLSKKDREKAASESPVGTSPRQSESIWVDVQYGTGKLKIGVEYVETRAGKLKIEDFELLKLVGKGSFRKVMQVRKKDTNRIYALKTIRKPHIISRSEVAHTLAERSVLAQINNPFIVHLKNPFIVPLKFTFQSPEKLYFVLAFVNGGELSITCKGTEISRQPLRIYTAEAHVRPRVSHGFNVIYRDLKPENILLDYQGHIALCDFGLCKLDMKDEDATNTFCGTPEYLAPELLMGQGYNKTVDWWTLGVLLYEMLTGLPPFYDENTNEMYRKILSEPLHFPGHDVVPPAAKDLLTKLLNRDPKERLGANGSAEIKAHPFFHAIDWRKLLQRKYEPAFKPKVTDALDTANFDPEFTSEAPQDSYVEGPMLSQTMQNQFQGFSYNRPIAGLGDAGGSVKDPSFVGSIQDR

SEQ ID NO: 43845 - protein, 250 aa, Legionella pneumophila str. Paris
MTNQKQTTHFGFKSVDWNEKEKKVAEVFHSVAKNYDRMNDLMSLGIHHLWKRYTIELSHVRPGQSVLDLAGGSGDLTRLLSQKVGDSGQVVLADINAAMLHVGRDRLLDEGLFKNIRYVQGNAQCLPFADNSFHCITMGFGLRNVTDKDEALQSMYRVCKPGGKLMVLEFSTPVFPGLKPVYDWYSFNILPKIGKFVANDEASYQYLAESIRMHPDQETLKAMIERVGFEDCHYHNLSGGIVALHIAYKY

SEQ ID NO: 43846 - protein, 948 aa, Oryza sativa
  misc_feature (836)..(836): Xaa can be any naturally occurring amino acid
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQXAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 43847 - protein, 173 aa, Zea mays
MMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKEYCEKYAKPEDAGITPEDKSSDEELSDDDDDDDDNDSGDEAILGNPDP

SEQ ID NO: 43848 - protein, 193 aa, Exiguobacterium sibiricum 255-15
MKIYKADFITSGVNPEHYPEPLLPEVALAGRSNVGKSSFINKLVQRKALARTSSKPGKTQTLNFFNINDEVMFVDVPGYGYAKVSKTEREAWGKMMEKYFTTREILKGVVLLVDIRHEPSADDVIMYDFLKYYDLSVIVVATKLDKIKRGQRDKQIAAIKRKLQFDGQDTFIPFSSETGEGVDAAWEAIYRHL

SEQ ID NO: 43849 - protein, 258 aa, Aspergillus nidulans FGSC A4
MPAPTALRAASDASTTETPIAPHAQEHDEEILIDVQPSNNADDVLASANSAEDTDMRIDLEGRPVFTPAKDTPAAYRVETRKVPVPPHRMTPLKANWPKIYPPLVEHLKLQVRINIKSRAVELRTSKFTTDTGALQKGEDFVKAFTLGFDIDDAIALLRLDDLYIRSFEIRDVKASLNGEHLSRAIGRIAGKDGRTRHAIENASRTRIVIADQKIHILGRFQNINAGQEAVVSLILGAPPGKVYGNLRKVAARMKERF

SEQ ID NO: 43850 - protein, 237 aa, Bacillus anthracis str. Ames
MQQSKEERVHDVFEKISDKYDVMNSVISFQRHKAWRKETMRIMDVKPGSKALDVCCGTADWTIALAGAVGEQGKVVGLDFSENMLSVGKQKVEALQLKQVELLHGNAMELPFEDNTFDYVTIGFGLRNVPDYMHVLKEMTRVVKPGGKVICLETSQPTMIGFRQGYILYFKYIMPLFGKLFAKSYKEYSWLQESASTFPGMKELANMFEKAGLERVQVKPFTFGVAAMHLGMKPESK

SEQ ID NO: 43851 - protein, 264 aa, Triticum aestivum
  misc_feature (116)..(116): Xaa can be any naturally occurring amino acid
TRSVLSTIIDPKDGSMASTQALKQMALEHDVPIVSIADLIRYRRKREKLVELIAVSRLPTKWGLFRAYCYQSKLDGTEHIAVAKGDIGDGEDVLVRVHSECLTGDILGSARCDCGXQLDLAMQLIEKAGRGVLVYLRGHEGRGIGLGQKLRAYNLQDQGSDTVEANVELGLAIDSREYGIGAQILRDIGVRTMRLMTNNPAKFVGLKGYGLAVVGRVPVISPITKENQKYLETKRTKMGHLYGSDLPGGLLKEFLNPTEDNATN

SEQ ID NO: 43852 - protein, 637 aa, Oryza sativa Indica Group
MDEEDYSWVRRTRFSHSVVRSKSGREQFGAFVEQFNRGAARRQRGPGSGFMLHGLNLEPRARLPATTSANSSVPRTTGSSNAQPSSETKPASSSSDAKPEQHEKSLNLEPRTRLSATTSANSSVPWTTGSSNAQPLSETKTASSSSDAKPEQQEKPRDHQPSQEVSTKQDDKAENDTQATATSGPLEFSFHPDEQTLRLQRACSSPVPFPSNKNMLVADAAARSSSLKVAGEGPKPKPKQRARSPPLRRDVPELFKEAKSSSKRFSTPPPRRKPSSPPAPSRSPPHAFATARAHGKPKHKKDSSANGRAKVAALEVLEKWTVDRSQLLIGHRFASGAHSRLFHGIYKEQPVAVKFIRQPEDEEDAELAAQLEKQFNTEVTTLSRLNHPNVIKLIGACSSPPVFCVITEFLSGGSLRTFLHKQEHKSLPLEKIISIGLDIANGIGYIHSQGVVHRDVKPENIIFDSEFCAKIVDFGISCEEAECDPLANDTGTFRWMAPEMMKHKPYGRKVDVYSFGLILWEMFTGSVPYEDLNPFQAAFAVFDKNERPVIPSSCPAPLRLLIEQCWASQPDKRPEFWQIVQILDKFKAVLDKDGTLDNMPCLNLQGTHDHKNWLAHWVQKLKHTHHDLSGPPPPKLL

SEQ ID NO: 43853 - protein, 446 aa, Exiguobacterium sibiricum 255-15
MHIVVVGLNNKTAPVSIREQVSFGEHEMKGAVVALRDEKSIFESVIVSTCNRTELYVVTDQPHTGRYYTKRFLANWFGLTMEELEPYLFIHEGFDAMKHLFRVTSGLDSMIVGETQILGQVKTSFFTAQKLETTGTVFNKLFKEAVTLAKRAHAETGIGENAVSVSAAAVTLAEQLLGSLEDKSIVVIGAGETGELTTLNLYEAGARDITVFNRTLAKAEEVANRFEGSAHSINEMQCGLLRADIVISSTGAKRAIIKREDIAAAQLFRSDRPFLLIDIAVPRDIEPTAGDLPGVHLYDVDDLTSIVQQNMAERMKEAAKIERRIEAAIAEFEGWMTTLGVVPIITELRDQSLKIQQETMQSLERKLPNMTNREKTVIGKHMKSIINQLLREPLSYIKDAAAKPDAEQRIAQFMDTFALDEELFDSAAEEMVLQEETTAERKAVNR

SEQ ID NO: 43854 - protein, 310 aa, Pseudomonas syringae pv. tomato str. DC3000
MSSEHFASVMVDAFIAAVDEGLDLVPVVSDSTSTAKIGPFMQRFPERVINVGIAEQSLVSVAAGLALGGKIAATCNAAPFLISRANEQVKVDVCYNQANVKMFGLNAGTSYGPLASTHHCLDDISVMRGFGNVQIFAPSDPLECRQIIDYVLRYHGPVYIRLDGKPLRELHDPGYRFVPGNVDILRQGSDLTIVALGSVVHEAVDAAAQLAEQGLDAQVINLSSIRPLQRDALLSALSGSRGVITVEEHNINGGLGSLVAELLAENALGITLIRLGIGDGEYAAAGAREPTRALHGIDADGIVAAAARLR

SEQ ID NO: 43855 - protein, 279 aa, Aspergillus nidulans FGSC A4
MSRPEDILPPDLFYDDNESRKYTTSSRIRNIQSDMTHRALELLDLKAPSLILDVGCGSGLSGEILSQEPREQGGPHTWIGMDISPSMLDIALQRGVEGDLFLADIGQGVPFRPGTFDAAISISAIQWLCNAETSDVSPEGRLRRFFEGLFASLRRGGRAVCQFYPKNDAQRTMISGAAIKAGFGAGILEDDPGTKNSKLYLVLTVGGGGLQGDITGVVDGMNDVDIMDARRKAQEHGKATISRKGDKAWILRKKEQMAKKGKVVKANSKYTGRKRRPAF

SEQ ID NO: 43856 - protein, 487 aa, Methanosarcina mazei Go1
MRGIRMKDYDLIVIGTGSGMNYVNSIIDSNPKMKIAVIDKDEPGGICLTRGCIPSKLLLYPAELVRDLETAPLFGIKLEIKDIEFRTIMERMRKRIGEDIEMIRQGLTENDYLDYYPETAEFISPYTLKAGDEILHSEMIFLCTGSKPAVPPVRGLEEAGYLTSDTVLGLNECPKSLAILGGSYIGAEYGHFFSAMGAEVTVIGRNQHFLPQEEPEVSELARIKMSEYMRILTNHEAIEVRKEKGGQKTVIAKDRDSGEETEVTADEILVATGRAPNNDILHPEKAGIKTDPHGWILVNEYLETSQPNIWAFGDANGKYLLKHVGNYESGIVYLNAIMQEKVKVDYHAVPHAVFSYPEIAGVGMSEKEAIEEFGEKRVIIGFKLFEDTAKGSAMETRDYFVKVILDGLEDKILGAHIIGPHASVLIHQIIPLMYTASRSAKPMMQMMDIHPALSEVVKRAFYSRLSPEHYHHVMKHLGLEDEDSVEG

SEQ ID NO: 43857 - protein, 569 aa, Geobacter sulfurreducens PCA
MGTPVSSGFSVGKVAVIDHSVADGMEVATVRPTNEERHRFLMALEKARIETIYMEKRVAETLSKEDAAIFHTHLMILEDRGFIARVMDFIEQDYGAVRSVNEAVAHYVNAFSQMEDPYLRERSADMEDIRRRIISCLDGSCKPVPKLRERRIIVAREILPSDMATLDHDKILGIVTEKGDVNSHAAIMAKSLGIPAVVGVGGALQNLGLKDEVIVDGSSGHIYINPSAKIKEEYARLEADFSVRMRELEELRDVPAVTLDGEQVWLRANIGLLSDIRIAQANGAEGVGLYRTEFPYMTRSAFPSRDALFSLYRRVLEGFSPNPVTIRTLDIGGDKTLPYFPMPHEDNPFMGWRSIRVSLEREDIFRVQLAGILLASAHGKIKLMFPMVSSIGEIWQIKKIMNEVRGELTREGLPFDQNLELGIMVELPAAVQTAHILIREVDFFSIGTNDLIQYTMAADRNNPKVSRYYDPYQPAVLHSIKRVVDTATAAGKPVSICGEMAADPINAVLLFGMGIREFSLSAPSIPVVKQTIRALSSTMAEEVAREVLALESSGAVRAYLLDARARLGL

SEQ ID NO: 43858 - protein, 187 aa, Brassica napus
  misc_feature (181)..(181): Xaa can be any naturally occurring amino acid
RTRGFFGLPYIGQGGKTGKLLISASATVGGLLLVALMCFWGCFLYEKLGRDESKRLAIEVGGGASIVMFHGDLPYASKDIIKKLEALNEEHIIGCGGFGTVYKLDMDDGNVFALKRIVKLNGGFDRFFERELEILGSIKHRYLVNLRGYCNSPTSKLLLYDYLSGGSLDQALHERGEQLDXDSRVNI

SEQ ID NO: 43859 - protein, 631 aa, Bordetella bronchiseptica RB50
MRVRGHGFTLAPFDATAGASGRGAGYKVNKMGKTVRGGAAAILGGWVNDITPGTLRADAQAGLLGALLVLPQGVAFAMLAGLPPEYGLYSAIVPCIVAALFGSSRHVLSGPTNANSLALFAVLAPLALPGSPGYIQMALAVTILVGVMQLAVGLLRLGSLANFISPSALFGFTSGAALLIAVHALKDALGLEGVQAHSAGAVLAAVGSRLGEAHWGASAVALTTIIVTLLVRHWDRRKPHMLAGLAAGTLLAAALNAGVFAAAGQPISVLGALAQPWPPFHVPAVQWSVLPDLVGVAVPLTIVALAQSISIAKAVAMRSGQLIDANREFIGQGLSNVVGGLFSSYLSCGSLNRSVPNYEAGARTPMAAVFAALLLVLLVLVSSPVLALIPHAAIAGLLIVVAWSLLDLPRWRVLVRIAPREALIAAATLAATVTIRMEIAILLGTLLSLTAYLYRTARPAMRPMGFDAADPQRHFAVLEGQPGELPECPQLKLLRMEGSVYFGAATHVTDRLQALRAGASAGQRHLLVMSKSMNFIDHAGAQVWEEELRRRRAGGGDLYFHRPRPEVLRDWRRSGFIDRLGADHIFPDKATAIHTIYERLDPEICRGCTARIFTECGPPGTAHQPGAERDE

SEQ ID NO: 43860 - protein, 178 aa, Chlamydia trachomatis D/UW-3/CX
MTEIPSSFVLPDPEWIYRVGIGQDSHRFLPDEDPKPCILGGIIFENTPGFEANSDGDVVFHAICNAFSSVTHKGILGGLADELLKTKGITDSVVYLQEAVASLKPTQRVSHLAITIEGKRPKLLPQLPSMRKRIAEVLHIPLDSINITATSGEGLTAMGQGYGVQCFCVLTIMEYCRY

SEQ ID NO: 43861 - protein, 264 aa, Klebsiella pneumoniae subsp. pneumoniae MGH 78578
MAISIKTSEDIEKMRVAGRLAAEVLEMIEPYVKPGVSTGELDRICNDYIVNEQKAISACLGYHGYPKSVCISVNEVVCHGIPDDGKLLKDGDIVNIDVTVIKDDFHGDTSKMFIVGKPTILGERLCRITQESLYLALRMVKPGINLRAIGAAIQKFVEAEGFSVVREYCGHGIGRGFHEEPQVLHYDSPETNVVLKPGMTFTIEPMVNAGKKEIRSMKDGWTVKTKDRSLSAQYEHTIVVTDNGCEILTLRKDDTIPAIISHDE

SEQ ID NO: 43862 - protein, 222 aa, Magnetospirillum magnetotacticum MS-1
MAALIAPSILSADFANLERDLNAIATADYAHVDVMDNHFVPNLTLGLPVFERLAQVSPVPIDAHLMIEDPDRWAPAYAEAGAASVTFHAEAAAAPVRLARELRRLGARAGVALRPATPVEPFLDLLTEVDMILVMTVEPGFGGQSFIEGTLPKIRRAREAVSESGLDVWIQVDGGVSRSTIERAADAGANVFVAGSAVYGAENVPEEIQALRELAEASAHAH

SEQ ID NO: 43863 - protein, 216 aa, Brassica napus
VQDNREGLVLLIDAIEKAGYTGKIKIGMDVAASEFFTKDGRYDLNFKKQPNDGAHVLSAESLAELYREFIKDFPIVSIEDPFDQDDWSSWASLQSSVDIQLVGDDLLVTNPTRIAEAIKKKSCNALLLKVNQIGTVTESIQAALDSKAAGWGVMVSHRSGETEDNFIADLAVGLASGQIKTGAPCRSERLSKYNQLLRIEEELGNVRYAGEAFRSP

SEQ ID NO: 43864 - protein, 148 aa, Bacillus anthracis str. Ames
MEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIGIFFKEEELVDYSKLMNEWIY

SEQ ID NO: 43865 - protein, 289 aa, Legionella pneumophila str. Paris
MSNYLDKTASLTPATKRIVCNKATEYPHTGSYNQVATHGTYLCRRCGLALFRGVSQFSSGCGWPSFDDEIANAVARKPDADGQRTEILCARCDAHLGHVFTGEYMTYKNLRHCVNSASLDFVADNEVLDTEEAILAGGCFWGVEYYLKRIPGVLKVESGYTGGHVSEPSYEQVCSGTSGHYEAVRVVYNSAKTNYHDIVKRFFEIHDPTQANGQGPDLGHQYLSAVFYFNQEQLQEAELLIQLLKKRGYQVVTQLLQAQPFWPAEDYHQDYYFKHHKIPYCHKPVDRFG

SEQ ID NO: 43866 - protein, 496 aa, Abrophyllum ornans
  misc_feature (16)..(16): Xaa can be any naturally occurring amino acid
INPTTSGSGVSTLQKXNLGRIAQIIGPVLDVAFPPGKMPNIYNALVVKGRDTVGQPINVTCEVQQLLGNNRVRAVAMSATDGLMRGMEVIDTGAALSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNISESKVALVYGQMNEPPGARMRVGLTALTMAEYFRDVNKQNVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGDEHYKTAQRVKQTLQRYKELQDIITILGLDELSEEDRLTVARARKIERFLSQPFFVAEVFTGSTGKYVGLAETIRGFQLILSGELDGLPEQAFYLVGNIDEATAKAMNLEMESNLKK

SEQ ID NO: 43867 - protein, 457 aa, Vitis vinifera
MQTENPQLPPSAEVVGNAFVEQYYYVLHRSPELVFRFYRDSSVMSWPDSNGLMSSVTTMQGINEKILSSEFKNRKTEIMTTDSQSSYEGGVIVLVTGCLMTKDKRRKKFTQSFFLAPQYNGYYVLNDVLRYIVDGEALETIPINGTNDSPAVSLNQGPGHTHDPDPPVPDPATSVVEDDEIVIEKVYDPLENEEQLVNEEEDFTETQSHPIENDDSTIAESSSSSAQEDAPKKSYASIVKVMKGSSGSTKVYVPTKTTKVTPAKTENQSPGLAAPAPVPESSVTSSINAPESSDAPEEVEGHSIYIRNLPLNVTVSQLEAEFQKFGPIKQGGVQVRSNKQQAYCFGFVEFLSLSSMHSAIQASPIIIGDHQAVVEIKRTTTRVGSGRGGRFPSGRGVFRGRGSFGGGRGFVRIEYGIRGEFSGRGRGPSGRSGGEGYRQGRGRAGRPSGHTQNAGSR

SEQ ID NO: 43868 - protein, 386 aa, Aspergillus nidulans FGSC A4
MFGTRTVQPAKSLFRRAAAQPSIVRSPIAARSFATVQQDIFKPTKYGGKYTVTLIPGDGIGAEVAESVKTIFKADNVPIEWEQVDVSGVDTGNKHSEELFKESIASLRRNKLGLKGILFTPVERSGHQSFNVALRQELDIFASVVLIKNIPGYKTRHDNVDLCIIRENTEGEYSGLEHQSVQGVVESLKIITRAKSERIAKFAFSFALANNRKKVTCIHKANIMKLADGLFRSTFHKTAENYPTLEVNDMIVDNASMQAVSRPQQFDVMVMPNLYGGILSNIGAALVGGPGVVPGCNMGRDVAVFEPGCRHVGLDIKGKDQANPSAMILSGSMLLRHLGLDDHANRISKAVYDVIGEGKTRTRDMGGQATTHEFTRAVLDKMEAAL

SEQ ID NO: 43869 - protein, 68 aa, Prunus dulcis
VLVVCLVVFNPVDADETANKIAAQSSLLDKLDCGGACAARCRLSSRPRLCKRACGTCCQRCSCVPPGT

SEQ ID NO: 43870 - protein, 292 aa, Triticum aestivum
FQEHTDRPAMAAAAASREERWSLAGKTALVTGGTKGIGRAIVEELAGFGVRVHTCARSDADVQERLRGWAADADAGRLSGRVTASACDVSVRGDREALMATARAELGGKLDILVNNAGQTFFMPATQSTAEDYARLMATNLESCFHLAQLAHPLLVAAGGGSVVNISSVASAIAYPVLSVYSATKAAMNQLSRNLAVEWASDGIRVNCVAPGGIRSDILQSSGIEVDMEALLAMGKKENERVALGRMGEPEEVASLVTFLCMPAASYVPGQVIYVDRRRTHSGLGLACCLLA

SEQ ID NO: 43871 - protein, 233 aa, Prunus dulcis
RGRGTGPLEGCKLIRKDKSSYGFVDYFDRRSAAYAIVTLNGRHLFGQPIKVNWAYASSQREDTSGHFNIFVGDLSPEVTDATLFACFSVYSSCSDARVMWDQKTGRSRGFGFVSFRSQQDAQSAINDLNGKWLGSRQIRCNWATKGATSNDDKQSSDSKSVVELTNGTSEDGQEKPNEDAPENNPQYTTVYVGNLAPEVTSVDLHRHFHSLGAGTIEDVRVQRDKGFGFVRFS

SEQ ID NO: 43872 - protein, 898 aa, Aspergillus nidulans FGSC A4
MCGIFGYINYLVERDRKYILDTLLNGLSRLEYRGYDSAGLAVDGDKKNEVCAFKEVGKVAKLKQLIEESKPDLTKTFESHAGISHTRWATHGTPSRLNCHPHRSDPNWEFSVVHNGIITNYKELKALLESKGFRFETETDTECIAKLTKYLYDQQPDIDFTVLAKAVVKELAGAFGLLIKSVHYPHEVIAARKGSPLVIGVRTSRKMKVDFVDVEYSEDVALPAEQASQNAAIKNSATGLLAPPDKSLLHRSQSRAFLSDDGIPQPAEFFLSSDPSAIIEHTKKVLYLEDDDIAHIHEGQLNIHRLTKDDGTSNVRAIQTIELELQEIMKGKFDHFMQKEIFEQPESVVNTMRGRLDVANKQVTLGGLRQYISTIRRCRRIIFIACGTSYHSCMAVRGVFEELTEIPIAVELASDFLDRQAPVFRDDTCVFVSQSGETADSLMALRYCLERGALTVGIVNVVGSSISLLTHCGVHINAGPEIGVASTKAYTSQFVAMVMFALSLSEDRASKQKRREEIMEGLSKISDQFREILKLNEPIKQMCERFFKNQKSLLLLGRGGQFPTALEGALKIKEISYLHCEAVMSGELKHGVLALVDENLPIIMILTRDGLFTKSLNAYQQVIARNGRPIVICNKDDPEFSSAQTEKIEVPKTVDCLQGLLNVIPLQLISYWLAVGEGLNVDFPRNLAKSVTVETSSDNCFYIISGSGLRVAIVHARWNMGIIGPLVDGATKTLRAAGVAEDHIEIHTVPGSYELPFAVQRLYSASQLQAANAGSSGEGISATDLLSSSTADVSKTPSTASSAASKPYDAIIAIGVLIKGETMHFEYIADAVTHGLMRVQLDTGVPVIFGVLTLLTEEQGLERAGLGSKGMHNHGEDWGNAAVELGVRRRGWAKGEVA

SEQ ID NO: 43873 - protein, 238 aa, Triticum aestivum
LSRTSLYKKAGRYRSGIPGISSTHASGLIVRAGKLSPDGAATPAGLISAAIAHAFALFVAVSVGANISGGHVNPAVTFGAFVGGNITLFRGLLYWIAQLLGSTAACFLLRFSTGGLPTGTFGLTGIGAWEAVVLEIVMTFGLVYTVYATAVDPKKGSLSTIAPIAIGFIVGANILVGGAFSGASMNPAVSFGPALVSWEWGYQWVYWVGPLIGGGLAGVIYELLFISRTHEQLPTTDY

SEQ ID NO: 43874 - protein, 518 aa, Oryza sativa Japonica Group
MEFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKHGPII

SEQ ID NO: 43875 - protein, 526 aa, Arabidopsis thaliana
MAAIARLPLTHSLPSIFNPSSFLSQSLSFPTYLHRSPFRSFSSVSPILCTSHRDSRSPGSDSNASIVGDLLDYLNESWTQFHATAEAKRQFLAAGFDLLSENEDWNLKPGGRYFFTRNMSCLVAFAVGEKYVPGNGFHAIAAHTDSPCLKLKPKSASSKSGYLMVNVQTYGGGLWHTWFDRDLSVAGRAIVRASDGSFVHRLVKVKRPLLRVPTLAIHLDRTVNSDGFKPNLETQLVPLLATKSDESSAESKDKNVSSKDAHHPLLMQILSDDLDCKVEDIVSLELNICDTQPSCLGGANNEFIFSGRLDNLASSFCALRALIDSCESSENLSTEHDIRMIALFDNEEVGSDSCQGAGAPTMFQAMRRIVSSLGNKQVTECTFDRAIRKSFLVSADMAHGVHPNFADKHEENHRPQLHKGLVIKHNANQRYATSGITSFLFKEVAKLHDLPIQEFVVRNDMGCGSTIGPILASGVGIRTVDCGIAQLSMHSVREICGTDDIDIAYRHFKAFYRSFSSVDKKLVVDD

SEQ ID NO: 43876 - protein, 387 aa, Corynebacterium glutamicum ATCC 13032
MSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 43877 - protein, 122 aa, Vibrio parahaemolyticus RIMD 2210633
MSITNEQILDAVAEMSVMQVVELIEAMEEKFGVSAAAAVVAGGAAAGAAVEEQTEFDVILESAGGNKVAVIKAVRGATGLGLKEAKALVDGAPAPLKEGVDKAEADALKAQLEEAGATVAVK

SEQ ID NO: 43878 - protein, 261 aa, Methanosarcina mazei Go1
MDDGRVLETRRKNVFGAITGKPTSLGGSAGRFDATAKGGLYAVREAAKKLGIELEDAKVAVQGFGNVGYHAAYLAKKLFGCRVVAVSDSKGAIYSGKGLDPEDVSGYKHSTGSVLGYPEAENLSNKELLELDVDILIPAALEDVVSIENAEKVRPKILAEMANGPTTREAEEVLISNGVHIIPDILYNGGGVIVSYFEMVQNESSIQWDEKEVEMRLEKKMKEAYHSVFDFAEKNNAGMRQAAYTLAVGRVVEAMQLRGWI

SEQ ID NO: 43879 - protein, 669 aa, Burkholderia mallei ATCC 23344
MISPLEMTLLLLLASVVGVVVFRSLNLPPMLGYLTVGILVGPHALGFAADLERAEHLAEFGVVFLMFSIGLEFSLSKLRAMRRLVFGLGLAQVLGTIAIALVLGALFERWMHITWEGSVALGGALAMSSTAIVSKMLAERLEIETEHGRNIFGVLLFQDLAVVPLLIVIAAFGGESSKDLAMSLGFAAVKIVVALALLLIVGQRFMTRWLNVVARRRSQELFVLNLLLVTLGAAFITDRFGLSLALGAFIAGMLISETPYRHQVEEDIKPFRDVLLGLFFVTTGMLLDPSVIWRHPLLVLAFFVGQVLLKSVMITGLARAFGATPGVAMRTGLGLAQAGEFGFVLLNLILDRHLVDATLLQSILASMLLSMLAAPFLIQNADRIVMRLSAAEWMQQSLQMTRIATQSIKQKGHVIICGYGRAGQNLARMLEQEGIAYVALDLDPDRVAAAAAAGESVVFGDAARRESLLAAGIHRAAAVAVTYANTPSALRVLHNVHELEPTLPAIVRTVDDADLEKLLAAGATEVIPEIVEGSLMLASHTLVLMGVPMRRVVRRVEEMRDARYSLLRGYFHGADDADDDDHEQVRLQSVPVDARADAVGRSLSELGLFALGLEVTAIRRHGIRGVEPDPETKLRASDIVVLRGLPEALAQAEERLSRHRREGGSAAVA

SEQ ID NO: 43880 - protein, 280 aa, Arabidopsis thaliana
MSKEVSEEGKTHHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 43881 - protein, 574 aa, Physcomitrella patens subsp. patens
MKLLKTGTHAAVGCVLLVLLILQTEATMVRHNWTVDYMFSAPDCVEKLIIAANGQYPSPPIFAVEGDTIVIEVTNHIPTEGIVFHWHGIYQKGTPYYDGAAYVSQCPINPGETFTYKFKVDRAGTYFYHGHFGMQRSAGLYGSLIVTLPDHKKEPFSYDGEHRLLLNDWWHKSIYEQELGLNSVPFRFVGEPQSLLIEGRGKYNCSLLPESTASPPGCLTCNASSPWCAPHVIPVTPGETYRLRIASVASLSTLNFILENHKMTVVMADGHYVKPFDVYNLDIYSGQTYDVLFTANQDTSKNYWAAINVRGRNPLTPTGLAVIQYLPNPATLLPTTSAPVSPVWNDTATSLNFAKKLLAKPGYEPPPPKKCDRTLVLLGTQNEINGNVKWAVNNISYVHNATPTIAALKYKIKGVNNPVPPPDFPAESYNIFAPPSPPSATYGTPVYVFEKDDIVDVIVQNANTMTPNVSEIHPWHLHGHDFWVLGYGDGLYNASRDPASFNLVDPPLRNTVAVFPYGWVAFRYVADNPGAWPFHCHVESHFHMGMGTVFAEGVRHIPKLPLQTLGCGLTKKHL

SEQ ID NO: 43882 - protein, 227 aa, Triticum aestivum
  misc_feature (175)..(175): Xaa can be any naturally occurring amino acid
MAGGGMSREERWSLAGATALVTGGSKGIGHAIVEELAGHGARVHTCARSAAELEECRRRWESRGLQVTVSVCDVSLRAHREQLVETVKQVFDGKLDILVNNAAQALAKAAVECTSEEYTHLMSTNLEPCFHLSKLTHPLLLGASIAGGGSIVNISSIGGTLGFPGYALYGITKGXPDILEKELAKVPMRRVGEPEDVAAVVSFLCMPAASFVTGQVITVDGGRTISA

SEQ ID NO: 43883 - protein, 226 aa, Brassica napus
  misc_feature (78)..(78): Xaa can be any naturally occurring amino acid
MDFSALLLTLFTGIIFLYFLRCLISQRRRGSSKLPLPPGTMGWPYVGETFQLYSQDPNVFFASKQKRYGSVFKTHVLXGCPCVMISSPEAAKFVLVTKSHLFKPTFPASKERMLGKQAIFFHQGDYHAKLRKLVLRAFMPEAIRDMVPDIESIAQDSLRNWDGTMINTYQEMKTYTFNVALLSIFGKDEVLYREDLKRCYYILEKGYNSMPVNLPGTLFHKAMKAR

SEQ ID NO: 43884 - protein, 203 aa, Triticum aestivum
  misc_feature (69)..(69): Xaa can be any naturally occurring amino acid
  misc_feature (139)..(139): Xaa can be any naturally occurring amino acid
MAPTVMASSATSVAPFQGLKSTAGLPVSRRSNGASLGSVSNGGRIRCMQVWPIEGIKKFETLSYLPPLXAREALLKQVDYLIRSKWVPCLEFNKVGFIFREHNASPWGTNEWAGTGTMWKAAYVPGATDATQVINEVEXEVKKEYPDAYVRIIGFDNMRQGAVPSASIAFKATGACEGVPAKGLKQAHSPRATYKVPLRYCQL

SEQ ID NO: 43885 - protein, 147 aa, Nocardia farcinica IFM 10152
MSSDADTSLPAPRIQLTPQEWRAKLNPEEYAVLREAATERPFTGEYTDTKTEGVYSCRACGAELFRSTEKFDSHCGWPSFFDPAKSDAVLLRPDDSLGMRRVEVLCANCHSHLGHVFEGEGYNTPTDKRYCINSIALRLHPSDSAAR

SEQ ID NO: 43886 - protein, 507 aa, Oryza sativa
  misc_feature (68)..(68): Xaa can be any naturally occurring amino acid
  misc_feature (173)..(173): Xaa can be any naturally occurring amino acid
  misc_feature (376)..(376): Xaa can be any naturally occurring amino acid
MQPPILLPLLLLLLLLAAASPRPVLSRRHASPPLATETLDVAASLSRARAAVSAEAVPLHQSAAAAVXSTEVVGEEHEEGRLALRLHSRDFLPEEQGRQRHASYRSLVLARLRRDSARAAAVSARAAMAADGVSRFDLVPANVTAFEASAAEIQGPVVSGVGLGSGEYFSRVXGVGSPARQLYMVLDTGSDVTWVQCQPCADCYQQSDPVFDPSLSTSYASVACDNPRCHDLDAAACRNSTGACLYEVAYGDGSYTVGDFATETLTLGDSAPVSSVAIGCGHDNEGLFVGAAGLLALGGGPLSFPSQISATTFSYCLVDRDSPSSSTLQFGDAADAEVTAPLIRSPRTSTFYYVGLSGISVGGQILSNPPSAFAMXDGTGAGGVIVDSGTAVTRLQSSAYAALRDAFVRGTQSLPRTSGVSLFDTCYDLSDRTSVEVPAVSLRFAGGGELRLPAKNYLIPVDGAGTYCLAFAPTNAAVSIIGNVQQQGTRVSFDTAKSTVGFTTNKC

SEQ ID NO: 43887 - protein, 251 aa, Zea mays
SLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAIEHPYFDSLDKSQF

SEQ ID NO: 43888 - protein, 1128 aa, Bdellovibrio bacteriovorus HD100
MELSKVFRILSSIFLILAGAGCGNLNAEMFGKVGSILAPSEPGPAPLQYPKILKVDADTTGASAVSTLALPRYTTAGIVPIQVHFSGPVNVTGTPTLELETGATKRLATYVSGSGTDILVFEYAVVAGDSALTLDYTGTQAINLNGGSIEPAEDVTGTADEIANLLTLPAPGAAESLSQSTPVLIRTIPEVKRLSTPDTDVYLDGTSLEVIVKYDQPVTVTGNPRITIRIGSNNRIANYVTKVSPSELLFRYEVVVGDDDTDGIEMPAAIELNGATVTNPANEVAVTDLPVKDTTGILTYTSALTASFVSSSQIVNEDAGILNIPVVLSGPAPIAFKVTIAVMGDAGAEDFNLASKEVNFAVGETTKYIPLTILDDAVAEPEKRIRLILAKNSLGNGGMLSVHEVLIRDDDSAVVAPKVVSFKQGVGFACALYDNNDLKCFGANDYGQLGDGTVVNTNEPSATPVMQNVAHFEVGGYTVCAANISGEMWCWGRDNASALPGSVGGKVLQPTKYVNSGVTQVAVSSNALCYLKTNKDLMCWGDDYSGIFGTGSTNASRTLAAPQLVTGQVEEMRLIAAVTGNTLCAVKLDSVTPSQRNLFCWGNRSTWYSSGSTSTVPATPLATNIVSYDLFNDNICVQKDEGAPTVRKNYCWGNGSNGQLTPGTSGAGSTVPVEMSSEYKDMMTSQESIIALKNDGSVWTWGSGGRIPGGNPIVAASAPVQLISGGVKNLLRMSNRYGPTDGLDPRCVLMLDSSVQCWMASPLPVNKTLPVTVIPAGVESVSVSNVFHENYYSACSLMSSGEVLCWGQNSVGQVGDRTLLPRLVPTQALSRNQRQIATGRERSCSVSTYGELRCWGYNSANLSLGVSPAFTSFKTPKIVIGKDVSKVALNDDGGCALLTTGGLNCWGDNNSGQSKPGSASSNTLPNLVLSSGVRDVETSYQAACYIATNDDLFCWGDNTQKQLGLGDTVDRTTIPATPLLSGVDSVSMGGHETSPGSCAVMKNGDLKCWGSGLACLGTNGDTPATLLTDVKKVSVGRSHMCAIVGEERRLVCWGHNPKGQLGIGTTVDKCYSSGPATVVAEGVRAVSAGSDSTCFVLETGEMKCMGDNNKGVVGTADRFPFPRTVWGL

SEQ ID NO: 43889 - protein, 271 aa, Prunus dulcis
VLPDVPEILKGLAEVGLTSLQSGMDNVRNPVGNPLAGIDPEEIVDTRPYTNLLSQYITANSLGNPTVTNLPRKWNVCVVGSHDLFEHPHINDLAYMPAAKDGRFGFNLLVGGFFSPKRCAEAVPLDAWVSADDVIPLCKAVLEAYRDLGTRGNRQKTRMMWLIDELGIEGFRAEVAKRMPFQELERASSEDLVQKQWERRDYVGVHPQKQEGLSYVGLHIPVGRLQADDMDELAHVADKYGTGELRLTVEQNIIIPNVENSKLEALLKEPL

SEQ ID NO: 43890 - protein, 143 aa, Triticum aestivum
MAAELSLRAPFSVRAVAPPAPRVALAPVALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSEIVIETHKEEELTG

SEQ ID NO: 43891 - protein, 512 aa, Petunia x hybrida
MEILSLILYTVIFSFLLQFILRSFFRKRYPLPLPPGPKPWPIIGNLVHLGPKPHQSTAAMAQTYGPLMYLKMGFVDVVVAASASVAAQFLKTHDANFSSRPPNSGAEHMAYNYQDLVFAPYGPRWRMLRKICSVHLFSTKALDDFRHVRQDEVKTLTRALASAGQKPVKLGQLLNVCTTNALARVMLGKRVFADGSGDVDPQAAEFKSMVVEMMVVAGVFNIGDFIPQLNWLDIQGVAAKMKKLHARFDAFLTDILEEHKGKIFGEMKDLLSTLISLKNDDADNDGGKLTDTEIKALLLNLFVAGTDTSSSTVEWAIAELIRNPKILAQAQQEIDKVVGRDRLVGELDLAQLTYLEAIVKETFRLHPSTPLSLPRIASESCEINGYFIPKGSTLLLNVWAIARDPNAWADPLEFRPERFLPGGEKPKVDVRGNDFEVIPFGAGRRICAGMNLGIRMVQLMIATLIHAFNWDLVSGQLPEMLNMEEAYGLTLQRADPLVVHPRPRLEAQAYIG

SEQ ID NO: 43892 - protein, 290 aa, Oryza sativa Japonica Group
MLTLHGTALFIRPSAYQEVKSSPKHAIVPHNNLLGCSAFYNPVEGHHVQKPHIVPSCKVNFTRASHYLYRSLSERTTRHWLHRFHVNASSDEDFRSSRNIAISLFKRYKNVIDRGGGDNLKEFVSAGVNAYALGCTEEGLRKELMDIEDSGLEIEALRSNGGGTSLTFKVHSFEMKSTKSHWQDMKLYVRECILWLSIVFITILCTPQPTIIRWSTTPPVSADVLHQWKGFCALIANAYYTKGMAWLPVKTLQLEQMAVTGSSEEPSVVASRMQLVFSTLEVVSPQWPRV

SEQ ID NO: 43893 - protein, 300 aa, Bordetella bronchiseptica RB50
MSRRPAGAARGSDAIGITRAVAGPAALTATQSPAMAARTAYLGPAGSWTHQACLDLYGADGLVPLSREALFAAYADGKVERACVPVATSVVGLTPYMEDVLALPRVVVVAEYPKMLGYSLLARPGTRREDIKEVHAHPVAFEEVRPWLEREMPGARRVPAASGGAAAQAVAASATQDKASFGPRVGASVYQLVSLADGIEEGPHNVTRWWVLGRDMPAPTGKDKTSLLACIPDARLAPLLADFAQAGVPILTIYERPARKTLDAHRYVVEVAGHVRDDALAGLLARQGELRVLGSYPRRY

SEQ ID NO: 43894 - protein, 250 aa, Magnetospirillum magnetotacticum MS-1
MTVSNDDDLAGLKQIGRIVADTLEVMSRALEPGMTTRELDRIGRTFLETAGARPAPELVYAFPGATCISVNEEIAHGIPGERAIRPGDLVNIDVSAEKDGYFSDTGASFAMPPVTRAVERLCRDGRRAMWTGLREVGAGKPLAGIGRAVGAFARKNGYTLVRNLASHGVGWSLHEEPTEIATWPDASERRIMAEGLVFTVEPFLSLGATLAEDGGDPWTLYSQPRALTVQYEHTVVATRNGPLVLTMPGQ

SEQ ID NO: 43895 - protein, 488 aa, Coccidioides immitis RS
MTTDTDLTKVTLDNLEAVLVRDTQVKLAGIDADGILRGKLVSKKKFLSIAKDGFGFCSVIFGWDMHDQTYFKELAISNKENGYRDMNAIPDLKSFRRIPWENNVPFFLVNFFDPETHAPISACPRGLLRSATAAMEKLGYKAMAGAEYEFYQFRAPSYGNGTERNSSGTARFLKTNPVADLPPLTEGMFGYSLTRPVHNQEYYYRIFDTCQAFKCDIESWHTESGPGVFEAALEFGEIKEIADRAGLFKYVVKSLGSKYGITPVFMAKPVHGLPGNSGHMHVSIVSNDGKNLFFREQPDLSPPYPDVANLSDLGRHFLAGVLAGLPDIMPLLAPTINSYKRLVENFWAPVTVSWGLEHRAASIRLITPPTCSPKGSRLEIRVPGADVNAHYVLAAIVALGWRGVEKKLEIPVPPLARGENVGNESDKGERLAKSLKEAIAKFMAKDSVAREVFGNEFVDHFGGTREHEVRLWEEAVTDWEVKRYIETV

SEQ ID NO: 43896 - protein, 216 aa, Chlamydia trachomatis D/UW-3/CX
MIFTIAKSLVRLLFPLFYRRKILRSKASATVKGAAIIAANHVSFLDPIIIPLAFPGKLYQLAKSGLFSNSFTNRLFRELGCYPISRNAGNAAAFKAALNIFSHGGRLIIYPEGTRHADGEIHQGKVGVGMLAIKGNVPVIPVYVAGTFEAFGKNQKFPKLWRTLTTVIGSPISFQDLIDNPAIDKKEAYQLATDRIMTKITELRTWFQQGCIGEIP

SEQ ID NO: 43897 - protein, 319 aa, Triticum aestivum
QPQLTCKAHGRPDTAYRHWRWQPRGCSLPSFNATLMLEMLRGKRMLFVGDSLNRGQYVSLVCLLHRAIPESAKSMETFDSLTVFRAKDYNATIEFYWAPFLAESNSDDAVVHRVTDRIVRGTAIEKHAKFWKGADVVVFNTYLWWMTGQKMKILQNSFEDKNKDIKEMETEDAYGMVLNAVAKWVENNMDPKSSRAFFVTMSPTHTQSKDWGDKSDGNCYNQTTPIKDLSYWGPGTSKGLMRVIGEVFSASKVPVGVVNITQLSEYRKDAHTQIYKKQWNPLTPEQIANPKSYADCTHWCLPGLQDTWNELLYAKLFFP

SEQ ID NO: 43898 - protein, 631 aa, Nocardia farcinica IFM 10152
MGVLSRVDTPEDVRRLNVAELRELAEEIREFLVRKVAATGGHLGPNLGVVELTIALHRVFDSPADPLIFDTGHQAYVHKILTGRKDRFDDLRKQGGLSGYPSRAESPHDWVESSHASAALSYADGLAKAFALGGQDRHVVAVVGDGALTGGMCWEALNNIAAAPDRPVVVVVNDNGRSYAPTIGGLADRLTALRTQPAYEHALDAGKRLLKSIPRVGESAYSMVHAVKAGIKDAVSPQELFSDLGLKYVGPVDGHDVVAMESALRRAKDFGGPVVVHAVTQKGRGYEHAENHVADQMHACDPIDPLTGRPLGGAKARGWTSVFSEELIEHARRRSDIVAITAAMPGPTGLSAFGERFPDRMFDVGIAEQHAMASAAGLALGGMHPVVAIYSTFLNRAFDQLLMDVALLKQPVTVVLDRAGITGPDGASHNGMWDLSLLGIIPGIRVAAPRDAATLREELGEALAVTDGPTVLRFPKGSVAEDLTAVERIDGVDVLRAADPESAVRTQRGDVLIVAVGPFARIGLAAAELLAPEGVSVTVVDPRWVLPVSDTVVKLAENYRLVVTLEDSGLHGGIGSTVSARLRSVGLDVPTRDLGVPQQFLDHASRDQVLEQLGLTPTDVARRIAGWLDAR

SEQ ID NO: 43899 - protein, 151 aa, Triticum aestivum
MDEQGERGLQLLLPAAAARVLREAPASAATDHQQLDLDLSMSIGPRQQQLQLQLPRPAPPTPPANESRRAAATVAASAATARHVQQQQQQVTVDVRAVKQQTAEQARMASAERAYAERVRELAKRELELAEREFARARMIWEHACMQRFHP

SEQ ID NO: 43900 - protein, 86 aa, Chlamydia trachomatis D/UW-3/CX
MSQNKNSAFMQPVNVSADLAAIVGAGPMPRTEIIKKMWDYIKKNGLQDPTNKRNINPDDKLAKVFGTEKPIDMFQMTKMVSQHIIK

SEQ ID NO: 43901 - protein, 395 aa, Neptuniibacter caesariensis
MFSELMAPPADPILGLSIKFKADENPNKIDLGPGIYKDEAGNTPVLACVKTAEKLRVDNETTKTYLGSAGSSLFNDKIADLLLGEHDIIKQNRIRTVSTPGGTGALRLAGEFLKTCKAGATIWVSNPTWANHQGVFTAAGLTVKTYPYYDYENKCLDFAAMTEALKQVPAGDAVLLHACCHNPSGMDLNNEQWQQVAELAKEKGFMPVIDIAYQGFGNGLDEDAYGLRLMANTVDELIVCSSCSKNFGLYRERIGGCSIIGKDAASADIIGAVLNRVVRVLYSMPPAHGAAIVETILSSEELSAQWHAELKEMRDRINGTRQLLVEKLAEKGVTQDFSFITRQNGMFSFLGIDQAQVTRLQDEFSIYVVDSSRINVAGISQSNVDYLTESLAKIL

SEQ ID NO: 43902 - protein, 448 aa, Clostridium perfringens ATCC 13124
MEVKKYVDNLMEDLKKNNPGESEFLAAAEEVLYSLVPVLEKNPKYMEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSSGYVYDENGIDLEVVKEIKEVKRGRISEYVNYVKTAKFTEGCRGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSRNAASEYGHDGNLIVGANIAGFKKVADAMLDHGII

SEQ ID NO: 43903 - protein, 415 aa, Novosphingobium aromaticivorans DSM 12444
MRGLPPPRSGGMEPPHFAPRNGRPRPMLENLAAQPADALLALIKLHNADPREDKIDLGVGVYRTSEGATPVFKAIKAAEAKLLESQDSKAYLGPEGDMGFVHALIPYVFGKDFDRSKVEGMQAPGGTGAVRLAIEVAKRSGVKRVWMGTPSWPNHAQIIAAAGMELKTFSHMTADGLADLEALKTALAGAEAGDAVLLHGCCHNPTGVDYTEAQWDEIAPLLVERQVLPILDLAYQGLGAGMEADAYGLRKVLSLAPEALVAYSCDKNFGLYRDRVGAFYAVTSDATALANAMGNGATIARASWSMPPDHGAAAVRLILDDAELTAMWLAELDEMRDRMRWVRDRLAAAQHVGPINMAPLGVQNGLFSMLPLRADQILAIREKHGVYMAGSGRINIAGLTTGNIDKFVEALRDVA

SEQ ID NO: 43904 - protein, 387 aa, Zea mays
MLHVRTCVCKQSDQLGSKQQRTNAMMAACLEAKKPYLIALAIQIIGTGMFVISKAAFDDGMSTFVFIFYRMAAASLILVPTAIVHQRKNMRSMSGKLLLKLFLLALIGNTFSLNTYNLTLKLTSATVGSALANSVPVFTFCLVLVLRMETVNLRTAAGVAKAAGVALCVAGVLVLAFYAGPAMSPVNHHRAFAAPRQHAASTGGPPSRSRWITGTLLMVLANVTWALWIVLQSALLKEYPNRMLVTATQCVFSMLQSFVVAVVAERGDLSKWRLRCDITLVAVLYVGFVVTGLSHYLQAWCMELKGPVFLAMTNPLCFVFTIFSSSFFLGEIVHLGSVLGGALLVAGLYSVHWGKLKEEDMASDQEKTNKQEEEAAAAGASSALQQP

SEQ ID NO: 43905 - protein, 333 aa, Chlamydomonas reinhardtii
MALDIRIAGRYRLGRKIGGGSFGDIYLGTNIQTGEEVAIKLESVKTRHAQLLYESKLYKILQGGVGIPNVRWYGVEGDYNVMVIDLLGPSLEDLFNFCNRKFSLKTVLMLADQLLSRVEFVHSRSFIHRDIKPDNFLMGLGKKANQVHIIDFGLAKKYRDPKTHIHIPYRENKNLTGTARYASINTHLGIEQSRRDDMESLGYVMMYFLRGSLPWQGLKATTKRQKYEKISEKKMSTPIEVLCKGYPMEFVTYFQYCRSLRFDDKPDYSYLRKMFRDLFAREGYQWDYVFDWTILKHQQSGTVPRPAVPRVPEPAAGEGEEAADPAYGGRFDF

SEQ ID NO: 43906 - protein, 169 aa, Oryza sativa Japonica Group
MAVGWRPAMLVVVVAVAAWRGEALSVTVTSPGGNTVYTLKGKSGDKFEFKAPRGGMYKFCFHNPYGAPETVSFYIHVGHIPNEHNLAKDEHLDPINVKIAELKEALESVTAEQKYLKAREARHRHTNESTRRRVMFYTIAEYLAFMGASALQVVYIRRLFSKNVAYNRV

SEQ ID NO: 43907 - protein, 476 aa, Novosphingobium aromaticivorans DSM 12444
MTAYPSLHMIIDGARVSGGGRRTHAVVNPATGETIGELPLAEVADLDRALEVAAKGFRIWRDSTPQQRAAVLQGAARLMLERQEDLARIATMEEGKTLPEARIEVLMNVGLFNFYAGEVFRLYGRTLVRPAGQRSTITHEPVGPVAAFAPWNFPLGNPGRKLGAPIAAGCSVILKAAEETPASALGVLQCLLDAGLPKEVAQAVFGVPDEVSRHLLGSSVIRKLSFTGSTVIGKHLMRLAADNMLRTTMELGGHGPVLVFGDADIDKALDTMAASKYRNAGQVCVSPTRFIVEESVFERFRDGFAERVGRIKVGNGLDQDAQMGPMANARRPEAMDRLIGDAVTRGARLHTGGERVGNAGYFYAPTVLSEVPLDAAIMNEEPFGPVALINPFGGEEAMIAEANRLPYGLAAYAWTDSAARAKRLAREIETGMLGLNSTMIGGADSPFGGVKWSGHGSEDGPEGVMACLVTKAVHEG

SEQ ID NO: 43908 - protein, 745 aa, Coprinopsis cinerea okayama7#130
MSRWDLSATLATCLTLEDVSDAERKPDLNYETPVLQVTSKARENKYEVVCLPLTTEAWKRRWSSMCLLPVDATEEEKGEASKAAELWRVRPGFLKDEVTLSRLDEAEGVIAMVSEWLELDSPDDWIRNDAEIALQQELSYASYLNIATAILPPPRNRDHVASYARAINSCLQATSYISLSVRLPIYNPSVFQPTSPLSSYPSSSSHNSLMSPQTPALVVSDANQDRPQNSETSLNATWEMWDLIRSMCDYNPRLTLTLDLSPALPTSLGVLSKWAAEAVRHIFLPASTFIANMKGLVCVAGAGRGPLVARCLTALERAHRDAKVYVIEKNPNAYVTLQHRQEREWGDKVQLVFGDMRVIDVPEQVDILVSELLGSFGDNELSPECLDGAMRFLKPHLAPLSSSKLYNEARSGNTVRNRQLTVVADLKSKNAGSLSIREAMPFWIHEARLPLSNNHNVRSAKLRFYIPHAGVLHGLAGYFEAVLYGNVGLSIHPQRKDQISKDMLSWFPLFFPFKEPLYLPSDSELQVSIWRLTNNQKVWYEWHAESFLSIPKKPAEGDDAFQPARAPTPSIPTSPSGFPSPLIDSVDPFSNQWRPNPLPFHSPLSIPSFFDFTMKILAAIAALISAIPAISGLVINTPSGVVQCQPIMITFGSGSAPYYISAIPAGQVSASPLRTWDPTNAQSLTWNVDMAGGTAISFIVKDSTGAQAYSDQVTIQGSNDSSCLNASSTAAHATASAVATGSAAR

SEQ ID NO: 43909 - protein, 307 aa, Synechococcus elongatus
MISADPPQVHPAGTFDVKAYLKERQALVEAALEASIPVAYPEKIYDAMRYSLMAGGKRLRPILCLATCELMGGTVEMAMPTACALEMIHTMSLIHDDLPAMDNDDYRRGKPTNHKVYGEDIAILAGDGLLAYAFEYVVEQTKNVPAEYLLKIVARLGHAVAATGLVGGQVVDLECEGQPDIGLETLHFIHSHKTGALLEASVVSGALLTGAHESDVARLSRYAANIGLAFQIVDDILDITSTRDVLGKTVGKDVAAQKMTYPRLWGLEKSRQEAERLVAEAKAELAVYGAAAVPLQAIADYITSRSH

SEQ ID NO: 43910 - protein, 300 aa, Synechococcus elongatus
MPGTNSDFQSWARSRQALVEEALNRLLPPAEVAPQRLHQAMRYAVLGGGKRVRPLLCYAAGEVSGAELERLSTAAAALELIHVYSLVHDDLPCMDDDVLRRGKPTCHVEYDEATALLAGDSLQSLAFQLLAEYRVADSPQTQLRMLEHLARAAGSRGMAGGQAIDLEATGKTLTLPELEFMHIHKTGALIRASVILGANCGRALASKDMDRLDHFAKRIGLAFQVVDDVLDAQSTTATLGKTAGKDARQGKPTYVSTVGVEAARAMAQELKREAVESLAPFGERARRLRELAEYIVSREF

SEQ ID NO: 43911 - protein, 256 aa, Agrobacterium tumefaciens str. C58
MTYPSQIPNISKLFDLSGRRAVITGGARGIGRAIADGFLEVGADVVCIDRGWESSDLPADNRQIVTADLSDRSDLKRGFDEAVERLGGQIDVLVNNAGIWDDTPSLHMELEMWDRIIEVNLTAAFALSRHAARLMLPRGRGRIINIGSIRSLRGGHNAAAYAASKGGIALLTQTLSNEWAPSGLRVNAIAPGAMVTVLTEKLRHDPEVVTRFIERIPARRWGSPADVAGLAIFLASDASDYVTGAIIPCDGGFLAG

SEQ ID NO: 43912 - protein, 324 aa, Synechococcus elongatus
MEQHYRDTIEQAIARALDRTELPPILDEPVRYALASGGKRLRPLITLLAAEACGSSPADAAPVAAAVEILHNFTLIHDDIMDRSPLRRGRPTVYRAWDDATAILAGDTMMGIAYRLLSEHYPAEVCQHLVAECSSAFVDVCIGQAEDLAFRTMPSVTMDDYLRMIGRKTARLFATAAVAGGIVARAPHDVLAALRTYGTALGMAFQIRDDVLDLFGSPEFGKELGQDLREGKKTFPTLSAAAHATDPNDLATFAAYFAGTPPTDSEEIAQMRERCRRLGALEHAESLIAHYLSTANAALESHLPSTSARDRLCALARATRNRHL

SEQ ID NO: 43913 - protein, 313 aa, Triticum aestivum
  misc_feature (179)..(179): Xaa can be any naturally occurring amino acid
MAKAFYAVGFWIRETGQALDRLGCRLQGNYFFHEQISRHRTLMNIFDKAPHVHKEAFVAPSASLIGDVEVGQGSSIWYGCVLRGDANNVQVGSGTNIQDNSVVHVAKSNLTGKVFPTIIGDNVTVGHSAVLQGCTVEDEAFVGMGATLLDGVVVEKHGMVAAGALVRQNTRIPCGEVWXGNPAKFLRKLTDEEIAFIAESAANYSNLAKAHAVENAKPLEKIDFEKVLRKKFTHHDEEHDSMLSGTREVPPELAPPSLYPCSISSGYLFFFPFFGAFTVFSLNSYYIFICAVSLAVYLSFNNFGSSNALKLTM

SEQ ID NO: 43914 - protein, 677 aa, Oryza sativa Japonica Group
MASPMPTPTHRVKRRRLDLSPPPHLNDLADELLFLILDRAAAHDPRALKSFSLVSRACHAAESRHRRVLRPFRPDLLPAALARYPALSRLDLSLCPRLPDAALAALPAAPSVSAVDLSRSRGFGAAGLAALVAACPNLTDLDLSNGLDLGDAAAAEVAKARRLQRLSLSRCKRITDMGLGCIAVGCPDLRELSLKWCIGVTHLGLDLLALKCNKLNILDLSYTMIVKKCFPAIMKLQSLQVLLLVGCNGIDDDALTSLDQECSKSLQVLDMSNYYNVTHVGVLSIVKAMPNLLELNLSYCSPVTPSMSSSFEMIHKLQTLKLDGCQFMDDGLKSIGKSCVSLRELSLSKCSGVTDTDLSFVVPRLKNLLKLDVTCCRKITDVSLAAITTSCPSLISLRMESCSLVSSKGLQLIGRRCTHLEELDLTDTDLDDEGLKALSGCSKLSSLKIGICLRITDEGLRHVSKSCPDLRDIDLYRSGAISDEGVTHIAQGCPMLESINLSYCTKLTDCSLRSLSKCIKLNTLEIRGCPMVSSAGLSEIATGCRLLSKLDIKKCFEINDMGMIFLSQFSHNLRQINLSYCSVTDIGLISLSSICGLQNMTIVHLAGVTPNGLIAALMVCGLRKVKLHEAFKSMVPSHMLKVVEARGCLFQWINKPYQVAVEPCDVWKQQSQDLLVQ

SEQ ID NO: 43915 - protein, 466 aa, Burkholderia thailandensis E264
MKITIIGTGYVGLVTGACLAEIGHDVFCLDVDPRKIDILNNGGMPIHEPGLQEIIARTRAAGRITFSTDVAASVAHGEIQFIAVGTPPDEDGSADLQYVLEAARNIGRHMTGYKVIVDKSTVPVGTAQRVRAVVDEVLAARGLEGSAEHRFSVVSNPEFLKEGAAVDDFMRPDRIIIGVDDDAAGAIAREKMKKLYAPFNRNHERTIYMDVRSAEFSKYAANAMLATRISFMNEMSNLADRVGADIEAVRRGIGSDPRIGYHFLYAGVGYGGSCFPKDVQALIRTASENGQPLKILEAVEDVNHAQKNVLLDKIEQRYGADLAGRTFAVWGLAFKPNTDDMREAPSRRLIASLLARGATVRAYDPVALDEARRVFALDLHDGPDALARLAFVDSADDALAGADALVIVTEWKEFKSPDFAHLKSVLKAPVIFDGRNLYEPDAMAELGIDYHAIGRPYVVPFSSERE

SEQ ID NO: 43916 - protein, 474 aa, Arabidopsis thaliana
MSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 43917 - protein, 882 aa, Coccidioides immitis RS
MLPARLLVRGGVRTARLGVATPLIKLSATVPCLGSQRRGYAPGSAPYLSTRSTVVQLLSNIGSKREVQQYLSHFTSVSSQQFAVIKVGGAIITEHLQTLSSALAFLNHVGLYPIVVHGAGPQLNKLLEAAGVEPQFEDGIRVTDGKTLALARSLFLEENLKLVEELERLGVRARPLTTGVFSADYLDKEKYNLVGKINGVNKKPIEGAIKAGCLPILTSMAETPDGQVLNVNADVAAGELARALQPLKIVYLAEKGGLFNGDTGEKISAINLDEEYDDLMKLWWVRHGTRLKIKEMKELLNDLPRTSSVAIIHPADLQKELFTDSGAGTLIRRGNKLHIKSSIDDFEDLHTLRNALVRDREGLDAKATVDRYIQALRGLEFKAYFDEPMDALAVILPPKKGSSFARLSTLTITKAGWLTNVADNVFSSIQKDFPKLVWTVKEDDENLTWFFDKAQGSLNRDGEVLFWSGVNSPEEVGELVHEFSKRGSDMFGDINLEPKLPTSAGGGAKLAAAQQKRTFSTSANTSALRAFGSQKFRANTQSIRSYTTTNPNPPLGKKNASNTQPSRVALIGARGYTGQALINLLNNHPYMDLRHVSSRELAGKPLQGYDKRPITYEELSPDDVKRMAEQGTVDCWVMALPNLVCKPYVDAINEVDKEKAVIIDLSADYRFDSTWTYGLPELVNRGSIAQAKRIANPGCYATAAQLGIAPLVPFLAGQPTVFGVSGYSGAGTKPSPKNDVANLTNNIIPYSLTDHIHEREVSTQLGVDVAFIPHVAVWFQGIHQTISMPLKESMTSRDIRNLYQDRYAGEKLVKVVGEAPVVKDIAGRHHVEIGGFAVHSSGKRVVVCATIDNLLKGAATQCLQNMNLSLGYSEFEGIPEEK

SEQ ID NO: 43918 - protein, 391 aa, Corynebacterium crenatum
MSTLETWPQVIINTYGTPPVELVSGKGATVTDEQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLRAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVTRKGELFKELLAKVDGVVDVRGRGLMLGMVLERDVAKQAVLDGFKHGVILNAPADNIIRLTPPLVITDEEIADAVKAIAETIA

SEQ ID NO: 43919 - protein, 267 aa, Klebsiella pneumoniae subsp. pneumoniae MGH 78578
MAIPAFGLGTFRLKDDVVIASVKTALELGYRAIDTAQIYDNEAAVGQAIAESGVPRDELFITTKIWIENLSKDKLIASLQESLQKLRTDYVDLTLIHWPSPNDAVAVEEFMAALMEAKKLGLTRQIGISNFTIPLMERAIAAVGAENIATNQIELSPYLQNRKVVDWAREHGIHITSYMTLAYGKALKDEVIARIAAKHNATPAQVILAWAMGEGYAVIPSSTKRDNLASNLKALDLQLDDEDRQAIAALDCNDRLVSPEGLAPQWD

SEQ ID NO: 43920 - protein, 319 aa, Corynebacterium crenatum
MTSQPQVRHFLADDDLTPAEQAEVLTLAAKLKAAPFSERPLEGPKSVAVLFDKTSTRTRFSFDAGIAHLGGHAIVVDSGSSQMGKGETLQDTAAVLSRYVEAIVWRTYAHSNFHAMAETSTVPLVNSLSDDLHPCQILADLQTIVGNLSPEEGPAGLKGKKAVYLGDGDNNMANSYMIGFATAGMDISIIAPEGFQPRAEFVERAEKRGQETGAKVVVTDSLDEVAGADVVITDTWVSMGMENDGIDRTTPFVPYQVNDEVMAKANDGAIFLHCLPAYRGKEVAASVIDGPPSKVFDEPQNRLHAHKGLLVLLLANQPR

SEQ ID NO: 43921 - protein, 395 aa, Bacillus anthracis str. Ames
MKLAKRVAALTPSATLEITAKAQALKAEGHDVIGLGAGEPDFNTPEHIMDAAHKAMLEGHTKYTPTGGLQALKQEIVKKFTRDQGIAYDPSEIIVCNGAKHALYTLFQVLLDEGDEVIIPTPYWVSYPEQVKLAGGKPVYVEGLEGNEYKITAEQLREAITEKTKAVIINSPSNPTGMIYSKEELQQLGEVCLEHDILIVSDEIYEKLIYGGAEYTSIAQLSNALKEQTLIINGVSKSHSMTGWRIGYAAGNKQLIKAMTNLASHSTSNPTSIAQYGAIAAYAGSQEPVETMRQAFEERLNIIYDKLIQIPGFTCIKPQGAFYLFPNVKEAVALSGYETVDEWAKALLEEEKVALVPGTGFGAPNNVRLSYATSLEQVEKALERIHTFMKSKVQA

SEQ ID NO: 43922 - protein, 530 aa, Arabidopsis thaliana
MAVSSAFVVTPKLEKLLANHHNPTYSSSPAPLDVIGIRALPMNNRNKRGLIQRARCEISPSNKAASISALEQLKTSAIDRYTKERSSIVVIGLSIHTAPVEMREKLAIPEAEWPRAIAELCGLNHIEEAAVLSTCNRMEIYVLALSQHRGVKEVTEWMSKTSGIPVSEICQHRFLLYNKDVTQHIFEVSAGLDSLVLGEGQILAQVKQVVKVGQGVNGFGRNISGLFKHAITVGKRVRTETNIAAGAVSVSSAAVELALMKLPESSHASSARMLVVGAGKMGKLVIKHLVAKGCTKMVVVNRSEEKVAAVRNEMPPGVEIIYKPLDEMLSCAAEADVVFTSTASETPLFLKEQVETLPPVRDARLFVDISVPRNVGSCVAEIDGTRVFNVDDLKEVVAANKEDRVRKAMEAQAIITDESKHFEAWRDSLETVPTIKKLRGYTERIIAAEIEKSLPKMGIDMNKKMRKTVDDLIRGIVNKLLHGPMQHLRCDGNDSRTLSETLDNMQALNRMYGLDAEILEEKIRAKVEKK

SEQ ID NO: 43923 - protein, 308 aa, Nocardia farcinica IFM 10152
MPHSRMSAAEPTAASPASPTAAESPAAVAELRRTAVELAERAADHVRARRPEVFGPDGEAADAVRTKGHATDPVTVVDTETEELIRGLLARHRPGEAVLGEEGGGSLGADDGAVHWVVDPIDGTVNFLYGIPGYAVSVAAMRGGRSVAGAVVDVARQVTYSAGLGAGAHAHTAGGPAERLHCSAAASLDLALVATGFAYGRHRRTRQAEIIARVLPQVRDIRRFGAAALDLCHVAAGRVDAYFEHGLNAWDWGAGALIAAEAGAVLTLPAAHRSGAEGDLVVAAAPGIAEELAGVLRAAGATDPIPDR

SEQ ID NO: 43924 - protein, 1169 aa, Vitis vinifera
MDDRGSGEGGFTARGEGSRDVTCGCGCGWGWEEDVEKRQFPDRRFDASSKELLAHEKKIGGESNRKGTRTTKDVTADRTSNASDLFTGSDKFRSKKQLAAFCDWLVEKKGDRSGHVRLRSRNDEGDRDVLLPPPPAPVPEVVAGKDQQFDRQVSLPRVSSGSSYAGSLFSGTTVEGNVSSGLKDSHTNSHSQESTRREVDEEKESAAQKSRESYYLQLTLAKRLASQASLACEPVLFLQESGAEGNAVSFDPDVVSYRLWVSGCLSYTDKISDGFYNILGMNPYVWVMCNELEEGRRLPPLMALKAVEPNDTSMEVVLVDRRGDSRLKELEDKAHQLYCASENTLVLVEQLGKLVAIYMGGSFPVEQGDLHKQWKLVSKRLRDFQKCIVLPIGSLSMGLCTRFSHMQKLADYIGLPCRIARGCKYCVADHRSSCLVKIDDKQSSREYVVDLVGEPGNVHGPDSSITGGLLSSMPSPLQISHLKEYQQPYMDNESCCQIQNSKNTCIYPEDPLYLGNEKNTLYTPTDQICERMESSVLPLEFNGNTDRCIIQSAMLQSVQSNVSEAVDASASGVSIHECFRIAGEKIVIQQAHKKEIALSGSPITSKALKQPKVSLSSKSNIKEVEGRLENRGRFHTVTIPRYLNLEPSLAMDWLEISWDELHIKERVGAGSFGTVHRAEWHGSDVAVKVLTVQNFQDDQLKEFLREVAIMKRVRHPNVVLFMGAVTKRPHLSIVTEYLPRGSLYRLIHRPTSAEILDQRRRLRMALDVAKGINYLHCLKPPIVHWDLKSPNLLVDKNWTVKVCDFGLSRFKANTFLSSKSVAGTPEWMAPEFLRGEPSNEKSDVYSFGVILWELVTMQQPWNGLSPAQIPRSEADFMDFALTFPLLVLMRVEMSGIISDPAQRPSFSSIVETLKKLLKSPLQLIQMGGNCGCVAYLTHSKRESERQGGKKERKMEMVNDIAIQVGMILFTVLLFLYMNDIPGKALAKLSLWYNQTNLEAKRHFVLGAQRLAQARSPNTPHSDVISLAKTAAEEADKALSLNPKDAAAHILKALALDLQGFRLSALDSLDAALSPLAVKSLTDEERGDALIKRAQLKIGLDKVGRVDSAVADLVEAVRVGSEKDKAYCLLGECYEMKEMKEEATKAYQEAITIQPNSALARDALDRLTSR

SEQ ID NO: 43925 - protein, 1074 aa, Arabidopsis thaliana
MNISQIIFFASLLLRLHLSTAEHQNSNAGDGDTIIFTTLGRSHYEFDIFALSTTQPPSVSGELRITDGESVNFNGYFPSPSPALLSLLPDETLIQMEDSSPLHLIYVTERNGTSSLYYDLVYGGNSDFKTKRRSVLEAPSRVQVPLLSRFDHLSGMTVNSFKDKPSLSGEFIVYVSTHESSGEPRASWTAVYSTELKTGLTRRLTPSGVADFSPAVSPSGNLTAVASYGERGWTGEVEELRTDIYVFLTRDGSHRVKVVEHGGWPCWVDESTLYFHRRSEEDGWISVYRAILPENGPLTTESVTIQRVTPPGVHAFTPATSPNNHEFVAVATRRPGSDYRHVELFDLKRNEFIELTRLVAPKSHHLNPFLSPDSSRVGYHSCRGDANGRRSPLLFLENIQTTTRDLSLFRIDGSFPSFSPGGDRIAYVKMPGVFVVKPDGSGQREVYKGMAFSTAWDPVRPGIVYSSSGPTFATERTEVDVISIDVDAADKSSSVRRLTTNGKNNAFPWPSPDGKRIVFRSGRTGHKNLYIMDAEKGESGGLWRLTEGAWTDTMCNWSPDGEWIAFASDRESPGSGSFELFLIHPNGTGLRKLIQSGTGGRTNHPIFSPDSKSLVFTSDYAGISAEPISNPHHYQPYGDIFTVKLDGSNVRRLTHNSYEDGTPAWAPRFIHPNNVELQRRNDSRCSFEDCHWLNKSLSVTGEKLEEKRGEEERGMAPVLQSSQPWVEKYRPKQVKDVAHQEEVVRVLTNTLQTADCPHMLFYGPPGTGKTTTALAIAHQLFGVYRPELYKSRVLELNASDDRGINVVRTKIKDFAAVAVGSNHRQSGYPCPSFKIIILDEADSMTEDAQNALRRTMETYSKVTRFFFICNYISRIIEPLASRCAKFRFKPLSEEVMSNRILHICNEEGLSLDGEPFPIQALSTLSSISQGDLRRAITYLQSATRLFGSTITSTDLLNVSGVRMKLTQYLHKCMVVPLEVVNKLFTACKSGDFDIANKEVDNIVAEGYPASQIINQLFDIVAEADSDITDMQKAKICKCLAETDKRLVDGADEYLQLLDVASSTICALSEMAQDF

SEQ ID NO: 43926 - protein, 175 aa, Triticum aestivum
MAPPVMVSSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 43927 - protein, 398 aa, Xanthobacter autotrophicus Py2
MSLLSSPSARPARSLNPLYAELPTTIFEVMSQLARTHEAVNLGQGFPDDPGPEDVRRKAADAVVNGWNQYPPMMGLPELRAAAAAHYRHWQELELDPDAEVMVTSGATEALAGALLALIEPGDEVVLFQPLYDAYLPLVKRAGGIPRLVRLEPPSWSITREALTAAFSERTKLVLFNNPQNPTGVVYSRADLALLAEFCVAFDAYAVCDEVWEHVIFDGVAFTSLMALPGMRERTVKISSAGKIFGMTGWKVGLVFAAPPLMKVLSKAHQFLTFTTPPNLQVAVAYGLGKADDYFTGMRADLQRSRDRLAQGLAGLGFSVLPSAGTYFLSIDLAAHTNAADDEAFCLDLVRTHGVATIPVSAFYAQDAVKSVVRFCFAKRDETIDRALERLAKVPLLR

SEQ ID NO: 43928 - protein, 592 aa, Xanthobacter autotrophicus Py2
MSSVFVSNLVLLVVAALVVVGTLSSLLAARFGAPILLVFLVVGVAAGEGGPGGIHFNDYWATYMVGSAALAVILFDGGLRMRLASMRGAIIPAIGLSTVGVVMTAALVALVAGPLLGLDPLESLLVGAIVASTDAAAVLFLVRAQGLHLGRRVGSVIEIESATNDPAAVFLTVLLVELLTTDTGNPGLAMVFGVLREMALGAAMGVAGGYAIVALLNRVDLPGGLHPVMVMGIAVLLFAVTSLLHGSGFLAVYLAGLVLGNRPVRAIASITSFLDTVTWLCQIVMFVMLGLLVSPEKILLYALPALGVAAFLILVGRPAAVFLCLAPFRFSLKEKLFISWAGLRGAVSIFLATIPMLAHLPQAEVYFNVAFAVVLVSLILHGWTMAAVARRLDVTLSDPAPGIRRFEIDLPGQTDMELVAYPVVAGTPAIGQAALPTWARLMMVVRAGQTLTPEAAGHLKVGDYGYVLAPPKRVHQLDRLFRPQEATPMDDGAAFPFVGEVRLGDLMSFYGLTVPDSELGLTIAEAFADRSDDHPARGMRIKYGNAVIEVREVVDGRVTWAVLRLEAGRLKRSIAKVRRLFGLQPEGEDDEA

SEQ ID NO: 43929 - protein, 457 aa, Ustilago maydis 521
MPPAALQATVSESVKDAIISKLRQPPSAVPSREWSAETRTSLTPADAGIAEARASAEDIELVDLQHHNFSEPRKRIVSPASLSRFEHSQAFAEILAFICVCNTRVVGKTLTEEIQISSACRTILEMLDQVAALRESTPPDASIGSSRFGNPAFRTFYAKIRENTDRLHRMIPGLETDSEWSRAARAELSVYFQECWGNEKRIDYGSGMELNMACWLLCLCKLRILRLPEDGACIVLRIFWTYVQVMRDIQSSYWLEPAGSHGVWGLDDYHFLPFLWGAGQLSSHRHLRPKAIHDAEIVDEFAPKYMYLACIQFINSVKTASLRWHSPMLDDISGAKSWSKVNQGMIKMYRAEVLKKLPIAQHIFFGSLLRFPEPATGELEEEDVEEDAHGHIHPAGKPHAHGTGEGQAAGWGDCCGIPIPSAFAAAEQEKKRQQGNFSSTMLGEKPFGTGVRRIPFD

SEQ ID NO: 43930 - protein, 73 aa, Brassica napus
SQDFGDSIPGHGGITDRMDCQMVMAVFAYIYLQSFIVSQSVSVDKILDQILTNLSFEEQQALFSRLGQMIGNS

SEQ ID NO: 43931 - protein, 226 aa, Bordetella bronchiseptica RB50
MLTQQELKQQAAEAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 43932 - protein, 258 aa, Burkholderia thailandensis E264
MRLQEKVAILTGAASGIGEAVARRYLEEGARCVLVDLKPADGALARLVDAHAGRAIAVSADVTRRDDIARIVAAAVERFGGVDILFNNAALFDMRPLLDESWDVFDRLFAVNVKGMFFLMQAVARRMVEQGRGGKIVNMSSQAGRRGEALVSHYCATKAAVLSYTQSAALALAKHGINVNGIAPGVVDTPMWEHVDALFARYENRPLGEKKRLVGEAVPLGRMGVPDDLTGAALFLASADADYITAQTLNVDGGNWMS

SEQ ID NO: 43933 - protein, 460 aa, Arabidopsis thaliana
  misc_feature (37)..(37): Xaa can be any naturally occurring amino acid
MPLSATADTSKTVKLERYNSYLRKIHSTKVLNASSKXLFRATLLVALVLVLIFAINYPPLSDSRAAAAHHLHRRSFLSTGLFSSSSSSSSIGGAAWEKRVRQSSTAKRPHGLSVLVTGAAGFVGSHCSLALRKRGDGVLGFDNFNDYYDPSLKRARQELLEKQQVFIVEGDLNDGPLLRKLFDVVPFTHILHLAAQAGVRYAMKNPQSYIASNIAGFVNLLEVAKAANPQPAIVWASSSSVYGLNTENPFSEEHRTDQPASLYAATKKAGEEIAHTYNHIYGLSLTGLRFFTVYGPWGRPDMAYFFFTKDILHGKSIDIYRTQDNQEVARDFTYIDDIVKGCVGALDTAEKSTGSGGKKRGQAQLRVYNLGNTSPVPVGRLVSILEGLLGTKAKKHLIKMPRNGDVPYTHANVSLAYKDFGYKPTTDLAAGLRKFVKWYVGYYGIQPRVKKETSHAEDSA

SEQ ID NO: 43934 - protein, 540 aa, Corynebacterium glutamicum ATCC 13032
MADISTTQVWQDLTDHYSNFQATTLRELFKEENRAEKYTFSAAGLHVDLSKNLLDDATLTKLLALTEESGLRERIDAMFAGEHLNNTEDRAVLHTALRLPAEADLSVDGQDVAADVHEVLGRMRDFATALRSGNWLGHTGHTIKKIVNIGIGGSDLGPAMATKALRAYATAGISAEFVSNVDPADLVSVLEDLDAESTLFVIASKTFTTQETLSNARAARAWLVEKLGEEAVAKHFVAVSTNAEKVAEFGIDTDNMFGFWDWVGGRYSVDSAVGLSLMAVIGPRDFMRFLGGFHAMDEHFRTTKFEENVPILMALLGVWYSDFYGAETHAVLPYSEDLSRFAAYLQQLTMESNGKSVHRDGSPVSTGTGEIYWGEPGTNGQHAFFQLIHQGTRLVPADFIGFARPKQDLPAGERTMHDLLMSNFFAQTKVLAFGKNAEEIAAEGVAPELVNHKVMPGNRPTTTILAEELTPSILGALIALYEHIVMVQGVIWDINSFDQWGVELGKQQANDLAPAVSGEEDVDSGDSSTDSLIKWYRANR

SEQ ID NO: 43935 - protein, 386 aa, Clostridium perfringens ATCC 13124
MNKIYFDNAATTFPKPDSVIKAMFDYMSFEGGSANRGSSSTALQSSRAVYECRYEIAKFFNFPKSENVIFTNNITTSLNMLLLGIIKSDWHIITTSMEHNSVLRPLVKISEELPNVELDIVQCNNEGLVSVEKIKEKIKNNTKLIILSHASNLVGTIQPIKEIGKLCKENDIFFILDSAQTAGVIPIDMTELNLNALAFTGHKSLLGPQGIGGFIIDDKLNSICKNIFSGGTGSNSSLIEHPQELPDKFEYGTLNTPGIIGLLEGIKFIEKEGIENIKAKEEVLCQKAMDLLCEIPEVKIYGSMDAKKKTSTISFNIEGIDPEFAGFLLDSEFNITCRTGIHCTPLAHKTVGSYPAGSIRISLGYFNTIEEVYRFVEVIKELISRR

SEQ ID NO: 43936 - protein, 391 aa, Nocardia farcinica IFM 10152
MSGTALGLLELGAVLFALGLLGRVAMRIGMSPIPLYLLGGLAFGSGGFTELHSAGEFSHLAGEIGVVLLLLLLGLEYTAAELVTGLRRSWAAGLFDLVANATPGALVALLLGWGFTGAITMAGVTYISSSGIVAKVLNDLGRLGNRETPVILSILVFEDLAMAVYLPILTTILAGLSFFSGMKALGIALVTVTLVLVVALRYGRYVSALVNSPDNEVFLLKLLGAALLVAGAASALNVSAAVGAFLLGIAISGSTAHQAVKLLEPLRDLFAAIFFVAFGLNTDPRAIPPVLGWAVALAVLTTLTKIGTGWWAARRQGIRRMGRARAGAALVARGEFSIVIAGLAVTMGAVDGRLAALASAYVLLMAVLGPVAARVVEPVAGFAQRRRAPAL

SEQ ID NO: 43937 - protein, 427 aa, Triticum aestivum
  misc_feature (3)..(3): Xaa can be any naturally occurring amino acid
  misc_feature (11)..(11): Xaa can be any naturally occurring amino acid
  misc_feature (13)..(13): Xaa can be any naturally occurring amino acid
  misc_feature (243)..(243): Xaa can be any naturally occurring amino acid
  misc_feature (385)..(385): Xaa can be any naturally occurring amino acid
  misc_feature (401)..(401): Xaa can be any naturally occurring amino acid
  misc_feature (406)..(406): Xaa can be any naturally occurring amino acid
  misc_feature (408)..(408): Xaa can be any naturally occurring amino acid
  misc_feature (421)..(421): Xaa can be any naturally occurring amino acid
  misc_feature (425)..(425): Xaa can be any naturally occurring amino acid
KRXVVGVVVLXTXWGEAPPDPFNCIHVADTPTLDALKKGAPERWRLIKAHGTAVGLPTDDDMGNSEVGHNALGAGQIYAQGAKLVDLALASGKIYEGEGFKYIQQSFETGTLHLIGLLSDGGVHSRIDQLQLLLKGASEHGAKRIRVHILTDGRDVLDGSSVTFVETLENDLAKLREKGVDARIASGGGRMYVTMDRYENDWQVVKRGWDAQVLGETPHKFPSALEAVKKLRDDPKANDQYLXPPFVVLDESGKPVGPIVDGDAVVTFNFRADRMVMLAKALEYEDFDKFDRVRFPRIRYAGMLQYDGELKLPSHYLVAPPEIERTSGEYLARNGVRTYACSETVKFGHVTFFWNGNRSGYFNPNLEKYEEIPSDTGIPFNVQPXMKAVEVAEKARDAILXGKFDXVXVNIPNGDMVGHTXDLEXTI

SEQ ID NO: 43938 - protein, 508 aa, Novosphingobium aromaticivorans DSM 12444
MSANIAEMEKRREAARLGGGQKRIDAQHAKGKLTARERLEVLLDEGSFEEVDMYVEHNCVDFGMPDTVIPGDGVVTGSGTINGRLVYVFSQDFTVFGGSLSERHAQKICKIMDMALKVGAPVIGLNDSGGARIQEGVASLGGYAEVFQRNVLASGVVPQLSLIMGPCAGGAVYSPAMTDFIFMVKDSSYMFVTGPDVVKTVTNEIVTQEELGGAVTHTTKTSVADLALENDIEALLAARDFFDYLPLSNRQEVPERPTSDPYDRLEPSLDSIVPASATQPYDMHEVIRKTVDEGEFFEIQPKHAGNIICGFGRVEGRTVGVVANQPMVLAGVLDINSSKKAARFVRFCDAFNIPIVTFVDVPGFLPGTAQEHNGIIKHGAKLLFAYAEATVPKITVITRKAYGGAYDVMASKHLRGDLNYAWPTAEIAVMGAKGAVEIIFRGLSAEEQAVKTREYEDRFANPFVAASKGFVDEVIHPHSTRRRVALGLRKLRNKSLENPWKKHDNIPL

SEQ ID NO: 43939 - protein, 366 aa, Rhodococcus sp. RHA1
MPRIPVATALPDFPWDSLESAKAKAFAHPGGIVNLSVGTPVDPVAPIIQDALTAVAEVPGYPTTHGTEELRNAAVEALRRRYGITGIDPAAVLPAIGTKELIAWLPRLLGLGADDLVVIPELAYPTYEVGALLAGARVIRADGLNRLGPEGASLIFVNSPSNPTGKVLGLGHLRKVVDWARSRGAIVASDECYLGLTWEGEALSILDERVNDGDLTGLLAVHSLSKTSNLASYRAGFVTGDPALVAELLEVRKHAGMMVPLPIQSAMTAALSDDDHENEQRERYRRRREILLAAVRGAGFTVDNSEAGLYLWATRGEACRDTVEWFAERGILVAPGEFYGPGGGTHVRIALTASDERIAAAAERLV

SEQ ID NO: 43940 - protein, 316 aa, Legionella pneumophila str. Paris
MIYPNILATIGHTPVVKINRLGKDLECELYAKCEFFNPGGSVKDRIGYEMVVKAEKERRIKPGDTLIEPTSGNTGIGIALAGAVLGYKVIITMPEKMSQEKQSVLERLGAIIYRTPTEAAYNDPDSHISLAKKLQAEIPNSHILDQYANPNNPNAHYFGTAQEIIDDFGKDLHMVVAGVGTGGTITGIAKRLKEFNPAIKIIGADPEGSILGGGTEVKSYHVEGIGYDFFPDVLDNTLIDAYIKTNDADSFRTARRLIKEEGLLIGGSCGAAMWAALQAAKSLSKGQKCLVILPDSIRNYMSKFANDEWMKEMGFL

SEQ ID NO: 43941 - protein, 336 aa, Galiella rufa
MVVKVGINGFGRIGRIVFRNAIEHEDIEIVAVNDPFIAADYAVYMLKYDSTHGRFKGEVSHKDGDLIVNGKTIKMYQERDPASIPWSETGAYYVVESTGVFTTIEKASAHLKGGAKKVVISAPSADAPMFVCGVNLEKYSKDINILSNASCTTNCLAPLAKVINDNFGIVEGLMTTVHSYTATQKTVDGPSAKDWRGGRTAAANIIPSSTGAAKAVGKVIPALNGKLTGMSMRVPTQNVSVVDLTVRLEKGASYEEIKKVVKAAAEGDYKGVLEYTEDELVSSDLNGNNASSIFDARAGISLNEKFVKLVAWYDNEWGYSRRVLDLISYIAKVDAK

SEQ ID NO: 43942 - protein, 172 aa, Exiguobacterium sibiricum 255-15
MEFKQHIKEVENWPKEGISFKDITSLMQNGPAYKQSVDALIDYARKQGADVIAGPEARGFVVGCPAAYAMEIGFVPVRKEGKLPRETVRVEYGLEYGKDVLTMHHDAIQPGQRVVILDDLLATGGTIEATIKMIEQLGGTVAGIGFLIELDGLGGREKLEGYDILSLIRYAD

SEQ ID NO: 43943 - protein, 188 aa, Bdellovibrio bacteriovorus HD100
MQTIINTKVPDFKVQAFHHGDFKTVTQNDLKGKWSIFFFYPADFTFVCPTELGDMADKYAEFQKIGVEVYGVSTDTHFTHKAWHDASETIKKIKYPMLADPTFQLTRAFGVHIEEEGLAYRGTFLVNPEGKIVLAEVQDNGIGRNADELFRKTQAAQYIAANPGEVCPAKWTPGKSTLKPGLDLVGKI

SEQ ID NO: 43944 - protein, 578 aa, Xanthobacter autotrophicus Py2
MSDAFLKDAFVYLLAAGILVPLFHRARIGAVVGFIAAGALIGPHGLGRLADSLPFVRFITISSPERAAPFGELGVVFLLFLLGLEFSAPRLWKLRREVFGVGALQVLFCGVPLALGLALVAVPEPEVALVLGFALALSSTALVSQLLIDQHRSLAPLGQLVIAVLLFQDLMVVPILLAAELLSGPATDVLTLAAMALAKATGAVALILVAGRFVLAPLVAVAASTRSRELIMAITLVVVVGSAAVTHAAGLSSALGAFLAGMALSETAYRHQIEVDLEPFKGLLVGVFFVTVGMSLDFAAVLPRALWVVAGVAALIAVKAACTYGAARLLRVSAPAAAEAALLLSQTGEFAFVVLGLLAAKGVLGAQDAATLVAVVSLSLAATPVLARVAARLGRTLDARLHDALAPVASTASGHVIIGGFGRVGRTIADALDEEGVPYVAVDADPRRVAQARTAGRPVFFGDAGRAEILDRLGAERALAFVATLDAPNAAERMVAAVRQHWPGTAVIARAKDAEHARRLAALGVAGVIPEAAEASLQLMAQLLSSLGLADEAVAARTEQTRARIRDDIERRTGAEGI

SEQ ID NO: 43945 - protein, 129 aa, Glycine max
MEQEDNTIIPTFLRKPAADQNNNNNNNNNSPTTPSHKSLHVFRRSRRRWRKEVAVKEDEDVDEGDDREEIERKIHALQRIVPGGESLGVDKLFDETAGYILALQYQVKALRALTGFFDKLEKEKTKFGG

SEQ ID NO: 43946 - protein, 115 aa, Zea mays
LEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVE

SEQ ID NO: 43947 - protein, 607 aa, Triticum aestivum
MVRGGQGQGGGGVEEREVVNVDQDGREEEVRRALPMMPVRVLLAEGDDSTRHVISALLRKCGYHVSAASDGVKAWELLKEKSFKIDLVLTEVELPLMSGFLLLSTIMEHDACKNIPVIMMSSNDAVSMVFKCMLKGAADFLVKPIRKNELRNLWQHVWRKQLANGEIDVQQIQQEENVAEQHGQKTEVTKDEHPTQNVVRKNRECSEQESDAQSSCTRSEPEAESKHANSFLDFKQITERQSSTDPKNALENRDPENPSDNKRKKASTDIEVVHIVDDEPKPSTPMEVDIVRTNSQGNGDKWFSIPAHQLELSLRRSDYGRSEDQEKNDTRTLNHSTSSAFSLYNCRPISSFGNAGDAQPCSTSATHADLANKNGDSAAPFQDKADPICHPIRVVALPVPVGGLTFDGQPFWSGAPVAPLLYPQSGPPIWNGRTPVSQEADTQATSSQQKCQQNDPTEMDSQQTESTQQQEVLPPPTANEKHLHVEIPSDSNPQQVSPMAGDSGSGSSTVLNNSGNALSGSACGSSSNRIATPTEQCNASDGATENPSMEGSHQLSQREIALNKFRLKRKERCFEKKVRYQSRKLLAEQRPRVKGQFVRQEQNIQAR

SEQ ID NO: 43948 - protein, 557 aa, Pseudomonas fluorescens Pf-5
MATEPLTHPTAAPKRTRDLLAGLSIAGLLLPEAVAYSSIAALPPQAGVIALFAGLLCYGLLGTSRFAIVSATSSSAAVLAAATLSLAGGDAQLRLSLAFALVLLTGVFFLLAGLFRLGGVTAFIAKPVLRGFAFGLALTIVLKQFATVVGVHLSTGNLVRFLPQLLEQWPQWNWAGAAVAAVALLVLGICSRIPYVPGGLVAVVIGIGAGQWFNLPAHGVDLIGVIELKLEVPSLPQLPFADWLRLGELAFALVMILYAESYGSISSFALKHGDRVSSNRDLLALGASNLLSGLFHGMPAGAGYSATSANEAAGARSRLAGLTAAAVMLLIVLTVLPYIALTPEPVLAAIVMYALGHGLSLQPLGRYFIWRRDRVLVICAVSAVLVLGVLDGLLLSVGISILLLLRQMSAADIQILGQLGSGHDFVDLSRHPQARQVPGVLILRPGEALFFANAERILGGALRLIRHVQAPIHSIILSLEESPDLDGTSIEALDEFFRQVSLEHKHLALARLKHEAKDALALLPSSREYQVLLSGTSVDDTLQESLRGWKAGAFSQA

SEQ ID NO: 43949 - protein, 148 aa, Brassica napus
MEQTFIMIKPDGVQRGLVGEIICRFEKKGFTLKGLKLITVDRPFAEKHYQDLSAKPFFSSLVDYIISGPVVAMIWEGKNVVLTGRKIIGATNPAASEPGTIRGDFAIDIGRNVIHGSDSVESANKEAALWFPDGPVNWQSSLHSWIYE

SEQ ID NO: 43950 - protein, 113 aa, Zea mays
ELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIEL

SEQ ID NO: 43951 - protein, 578 aa, Prosthecochloris aestuarii DSM 271
MKAESNPILDFATDYVFPGFSEQTGADKIVAFGDHSHKCPIYVRQTPPCSAECPAGEDIRGINRYLNGTTPSDDPMRSAWETAVDRNPFPAVMGRICPHPCQSGCNRGFHDESVAINAVEHAIGNYAIEAGLPLPGPGPDTGKRVAVIGGGPAGLSAAYQLRRKGHAVTIYDANSKLGGMVLYGIMGYRVDRRVLETEIQRIIDLGVETKMGVRVGRDVTLEQLEAQYDAVFLGVGAQVGRDLPVPGFEGTAGVTNAIDFLRNYEVLGDDMPVGRRVVVIGDGNVAMDVARLALRLGSEAAVVSGVPREEMACFDNEFDDALREGTRMYFQTGTLEVLSGPDGVSGLRCSSMTGKEKGEDGWNSPIPFLRYKSCGEPFDIEADMVVAAIGQATDMQGLEDVVNGAPWLRVDRNFRIAGREKLFGGGDALKVDLITTAVGHGRKAAMSIDAFLNGEPMPEHPYREVTKVQKQDVLYFLPVPQAKRTSLEPVDVVGNHDELLQPLSPDETRAESERCMSCGLCFDCKQCVSFCPQEAISRFRDNPEGEKVYTNYAKCVGCHLCSLVCPSGYIQMGMGDGL

SEQ ID NO: 43952 - protein, 449 aa, Thermoplasma volcanium GSS1
MMQEELNGIKIKVTPPGPEAKKIIELNDKYLARSTQSLPVVGKLGKGVYVEDVDGNVYLDFASGISVTNLGHLDPYVTQKVEEQLHKLWHFPGTDFYTEMQVLAAKSLIEVTPGKFNKKVFFTNSGTESVEAAIKIAKSYTHRERFIGFIGAFHGRTQGSLSFTASKPIHHKGFFPSMPGVEHVPFPNPYRNPFNIDGYEEPDELVNRVIDYIETYLLKTYVPPEDVAGILAEPIQGEGGYIVPPMNFFKELRKLADKYHIPLLIDEVQSGFGRTGKFFASEHFGVEPDVITLAKSIASGIPMGAAVMKEEMNFSENGLHSNTFGGNLIASAACVATIDEMKKLNAVENAAKQGAYMKKRLVELQNKYNEIGDVRGLGLMLAIDFVKDRRTKEPNSKLRNDVINNAFKNGLILLSTGSSAIRIIPPLIITQEQVDEGIEVLDKAIKMSK

SEQ ID NO: 43953 - protein, 646 aa, Burkholderia thailandensis E264
MIRFNQFSLARGTKPLFDATSFTLNPGEKAGLVGANGAGKSTLFAVLRGELHADAGDFSMPPAWHIAHVSQETPAVDRSALDYTLDGDAALRAIEARIAQASAAHDGAAEADAHAAFADADGYTAPARAEALLLGLGFTLAQTREPVASFSGGWRMRLNLAQALMCRSDLLLLDEPTNHLDLDAIVWLEDWLHRYPGTLVIISHDREFLDAVCNVTLHLENRQVKRYGGNYSQFEVLRAQQLELQQSAYEKQRKTIAHLQSFVDRFKAKASKAKQAQSRVKALEKMELIAPAHVASPFTFEFRTPDSAPNPMLVMEDVRCGYHADGGGEIPIVERVALSIQNGQRIGLLGANGQGKSTLIKTLAGTLAPLSGDVRTGRGLTIGYFAQHQLETLREDESALAHLARLAPDTREQELRDFLGGFNFSGDMATAPIAPFSGGEKARLALALIIWQKPNLLLLDEPTNHLDLETRHALTMALAQFEGTLILVSHDRHLLRATTDQFMLVAKHRLQPFDGDLDDYRDWLLQHAAEQRAAAKAASGSASDADGGAPAVNRKDQKRQEAEARQRLSLLKKPLQARITKIEKEMERLHAQKVELDAFVADPASYAADQKARLTEAIRKLGDVNGRLETLEADWLGAQDELESIG

SEQ ID NO: 43954 - protein, 336 aa, Hypocrea ceramica
MVPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 43955 - protein, 192 aa, Oryza sativa
  misc_feature (112)..(112): Xaa can be any naturally occurring amino acid
MAPAGCCLLLVLLIAAGGRAAANSAAAVATTNNKPQQLVQSTCNSTTYYDVCVAALAADPSISTAADVRGLCAIAVSAAATNASAAGASLLASAAAYQSQPQAPLLRACAGXYADARQALISAQEAIKEEAYDYAFVHVSAAAQYPTMCRALFRRASSQQRAYPSDLAKREEGLRRLCTVVLDIISLLLLSY

SEQ ID NO: 43956 - protein, 338 aa, Hypocrea ceramica
MAPIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 43957 - protein, 748 aa, Yersinia pestis CO92
MLMRLREVVEKVAMATGLTEALELLVNETCLAMDTEVCSIYLADNDRRCYYLMATRGLKKPRGRTITLAFDEGIVGLVGRLAEPINLADAQSHPSFKYVPQVKEERYRAFLGVPIIYRRQLLGVLVVQQREHRQFDESEESFMVTLATQLAGILSQSQLNAIFGQYRQTRIRALAAAPGVAVAEGWQDISQPSLDLVYEASTLDSTLERERLTQALEEAAAEFRRFSKRFAASSQKESAAIFDLYSHLLNDARLKRELFAQIDAGAVAEWAVKQVVEAFAAQFASLQDTYMRERASDLRALGQRLLFHLDDSTSGASQWPERFILVADELTATLLAEVPQDRLAGVVVRDGAANSHAAILVRAMGIPTVMGADIQPALLSQRLLIVDGYRGEVLVDPEPVLVKEYQRLVTEEIELSKLAEDDVEQPAALKSGERIQVMLNAGLSPEHEQLLGGRVDGVGLYRTEIPFMLQSGFPSEEEQVAQYQGMLQLYPQKPVTLRTLDIGADKQLPYMPISEENPCLGWRGIRITLDQPEIFLIQVRAMLRANAGTGNLGILLPMITSIEEVDEAKRLIDRAGREVEEMLGYVLPQPRLGVMIEVPSMIFMLPYLTSRVDFISVGTNDLTQYLLAVDRNNTRVASLYDSLHPAMLQVLRQILMQATESGLQVSLCGEMAGDPMGALLLVGLGYRNLSMNGRSVARIKYLLRNIELADAQVLAARVLTAQMTTDVRHLTAAFMERRGLGGLIRGGK

SEQ ID NO: 43958 - protein, 387 aa, Zea mays
MEAAPMRKASSQASLADPDDFDLTRLLNHKPRINVDRQRSFDDRSLGEISLAGAGTASRGGWGYGGGGMESYESMYSPGGGLRSYCGTPASSTRLSFEPHPLIGEAWDALRRSMVSFRGQPLGTIAAVDHSSGEVLNYDQVFVRDFVPSALAFLMNGEPEIVRNFLLKTLLLQGWEKRIDRFKLGEGAMPASFRVLKDPKRGVDKLVADFGESAIGRVAPVDSGFWWIIILRAYTKSTGDMTLAETPMCQKGIRLIMNQCLAEGFDTFPTLLCADGCCMIDRRMGVYGYPIEIQALFFMALRCALLMLKPDAEGKEIMERIVTRLTALSYHMRSYFWLDFQQLNDIYRFKTEEYSHTAVNKVNVNPESIPDWLFDFMPTRGGYFVGN

SEQ ID NO: 43959 - protein, 414 aa, Chondrus crispus
MAFVAPVATVRATTKSSVCQVQGRSTFAQFSGMKKVNQSSRLQPAQSGSAFGGYSDANDAFYTRVSGIVAATFGPTMKVRVAINGFGRIGRNFIRCWAGRSDSNMEVVCINDTSGVKTASHLLKYDSILGTFDADVSAGEDTISVNGKTIKIVSNRNPLQLPWKEMNIDIVVEATGVFVDAPGAGKHIEAGAKKVLITAPGKGDGIGTFVVGVNEKDYSHDKYDIVSNASCTTNCMAPFMKVLDDEFGVVRGMMTTTHSYTGDQRLLDAGHRDLRRARSAALNIVPTTTGAAKAVALVVPSLKGKLNGIALRVPTPNVSVCDVVMQVNKKTFKEEVNGALLKASEGAMKGIIKYSDEPLVSCDHRGTDESTIIDSSLTMVMGDDMIKVVAWYDNEWGYSQRVVDLGEVMARQWK

SEQ ID NO: 43960 - protein, 301 aa, Neptuniibacter caesariensis
MSTRHFLTLRDLSSEELRTLVKRASELKAIRNRGEVYEPLKNKVMAMIFEKSSTRTRVSFEAGMAQFGGHAMFLSPRDTQLGRGEPISDSAKVISSMVDVVMIRTFSHQLVEEFAANSTVPVINALTDEYHPCQLLADMQTYFEHRGDIQGKTVTWIGDGNNMCHSYINAARQLDFKLNIACPEGFDPDEKLVAENQERIFITRSPVEAVTGSDLVVTDVWASMGQEEEQKEREAKFDGFQVSPALMDNANKDALFMHCLPAHRGEEVSMDMLEDPRSVVFDEAENRLHAQKALLEFLMVK

SEQ ID NO: 43961 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLASETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 43962 - protein, 317 aa, Oceanobacillus iheyensis HTE831
MTSSYKDSSLKVFSLNSNPELANEIATHIGTNLGKCTVSKFSDGEVQINLEESVRGCDVYVVQSTCAPVNQHIMELLIMIDALKRASAKSINIVMPYYGYARQDRKARSREPIAAKLVADLIEKAGANRVITLDLHAPQIQGFFDIPIDHLQGVPILSSYFEQKNLDDVIVVSPDHGGVTRARKMADRLKAPIGIIDKRRPKPNVAEIMNIIGNIEGKTAILIDDIIDTAGTITLAANALIENGAKEVYACCTHPVLSGPAIERIDNSKIKELVITDSIPLPDEKFSTKITALSVAPLIGEAIIRVHEMQSVSILFD

SEQ ID NO: 43963 - protein, 338 aa, Dianthus caryophyllus
MAPIKIGINGFGRIGRLVARVILQREDCELVAVNDPFITTEYMTYMFKYDSVHGQWKHHDIKVKDEKTLLFGEKAVTVFGNRNPEEIPWGGTGADYVVESTGVFTDKDKAAAHLKGGAKKVIISAPSKDAPMFVVGVNEHEYKPELDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRIEKPATYEQVKAAIKEESEGKLKGILGYTEDDVVSTDFVGDNRSSIFDAKAGIALNDNFIKLVSWYDNEWGYSTRVVDLIAHIHKTCQ

SEQ ID NO: 43964 - protein, 371 aa, Neptuniibacter caesariensis
MAVEAIMSTYNRLSVAFERGEGSWLYDTDGNKYLDALCGIAVCGLGHSHPAVTHAICDQASNVIHTSNLYTIPNQQQLAERLTQISGMDNVFFGNSGAEANEAAIKLARRYGHAVKKVENPTIIVMENSFHGRTMATLSATGNRSAQAGFEPLVSGFVRAPYDDVDAIKAIAENNPNVVAILVEPIQGESGIQIPAPDYLNKLRDICDENEWLLMLDEVQSGNGRSGKYFAYQHNDILPDVVTTAKGLGNGVPIGACLARGTAAKILIAGTHGSTYGGNPLSCAAALAVVNTIMDENLCERATELGNKIVAGFEEQIGHADYVKEIRNKGLLIAIELTEAGTELAVLSKVKGILLNVTGGGKVVRMLPPLT

SEQ ID NO: 43965 - protein, 338 aa, Pisum sativum
MGAKIKIGINGFGRIGRLVARVALKRDDVELVAVNDPFITTDYMTYMFKYDSVHGQWKNDELTVKDSNTLLFGQKPVTVFAHRNPEEIPWASTGADIIVESTGVFTDKDKAAAHLKGGAKKVIISAPSKDAPMFVVGVNENEYKPEFDIISNASCTTNCLAPLAKVINDRFGIVEGLMTTVHSITATQKTVDGPSSKDWRGGRAASFNIIPSSTGAAKAVGKVLPALNGKLTGMSFRVPTVDVSVVDLTVRLEKAATYDEIKAAIKEESEGKLKGILGYTEDDVVSTDFIGDTRSSIFDAKAGIALNDKFVKLVSWYDNELGYSTRVVDLIVHIAKQL

SEQ ID NO: 43966 - protein, 342 aa, Physcomitrella patens
MVGSAKIKVGINGFGRIGRLVARVALERDDIELVAINDPFITPEYMTYMFKYDSTHGQWKKTEVTLHSEGHLTFGGNPVAVYACRDPSEIPWGKHGADFVVESTGVFTDKDKAAAHLKGGAKKVVISAPSKDAPMFVMGVNENKYSDEDIVSNASCTTNCLAPLAKVINDKFGILEGLMTTVHATTATQKTVDGPSSKDWRGGRSAATNIIPSATGAAKAVGKVLPELNGKLTGMAFRVPTTDVSVVDLTVRLEKPASYDAIKTAIKEASEGQMKGILGYTEDDVVSTDFITDSRSSIFDAKAGIALSDTFVKLVAWYDNEWGYSNRVVDLIVHMAKQGTSQ

SEQ ID NO: 43967 - protein, 248 aa, Bacillus anthracis str. Ames
MITIKTKNEIDLMHESGKLLASCHREIAKIMKPGITTKGINTFVETYLEKHGATSEQKGYNGYPYAVCASVNDEMCHGFPNEIPLNEGDIVTIDMVVNLNGGLSDSAWTYIVGNVSDEAERLLLVAENALYKGIDQAVIGNRVGDIGYAIESYVANEGFSVARDFTGHGIGKKIHEEPAIFHFGKQGQGPELQEGMVITIEPIVNVGMRYCKVDLNGWTARTMDGKLSAQYEHTIVITKDGPIILTKL

SEQ ID NO: 43968 - protein, 99 aa, Thalassiosira weissflogii
MATYKVTLISEEHDINTTIDCNDDVFVLDAAEEAGIDLPYSCRAGACSTCAGKVTEGTIDQSEQTFLDDDQMGAGFVLTCIAYPKSDCTILVHQEDELY

SEQ ID NO: 43969 - protein, 300 aa, Salinibacter ruber
IGRLCFRALLEREEDEIEIVGINDLTDAETLATLLKYDSVHGQFPGDVHLEDSTLVVDEQEFPVFSKKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFHEAANGALDGILAYSDDPIVSRDIIHDPHSCIYDAPWTKVAGSQVKLVG

SEQ ID NO: 43970 - protein, 122 aa, Glycine max
NLWDFQHFMVIIKPSSLSQVLVFDFQPKDPEDIYVALAALYGRAVPGTVLVRQLKKLPRNKCWLVGYSKAEADAMEIAREFNKEWETNLRIGLHDCRDYTNSLVRQLTGEKDVLKRLRNVGS

SEQ ID NO: 43971 - protein, 390 aa, Aspergillus nidulans FGSC A4
MATKTLEARFEHLSVKDDSGNGNKGTSYPKHKSSLSTAVSLSGLGVAGQLTSGANRSNLLKLALQNTNDNKVNAMNANASQSPGKGTQNPASLRNLDENGEYEQPAPRKLHLGMFEIGKPLGKGKFGRVYLAKERSSGFVCALKVLHKSELQQGGVQKQVRREIEIQSNLRHPNVLRLFGHFQDSKRIFLILEFAGRGELYKHLRKEHRFPEWKAAHYIAQMASALKYLHKKHVMHRDIKPENILVGIHGEIKISDFGWSVHAPNNRRQTMCGTLDYLPPEMLTSNPQGNFYNEKVDLWSLGVLTYEFLVGEAPFEDTPVMTQRRIQRGDMQVPSFVSPEAKDLIKRLLVLDPEKRISLDEIQRHPWILKHCVKDDRTIKRGSAPHAANE

SEQ ID NO: 43972 - protein, 454 aa, Rhodococcus sp. RHA1
MTDSTSTLGRGLKVRHLTMMGLGSAIGAGLFLGTGVGIATAGPAVLVSYLLAGIIVVFVMRMLGEMGAAIPASGSFSHYARIGIGEWAGFVMGWLYWFMLIMVLGAEITGASGIVSGWLPGVPQWVVALVFVIFFAAVNLAKVSNFGEFEFWFAAIKVTVIIAFLVIGVLLVFGLLPDTEPVGTTNLFGHGGFMPEGFAGVAAGLLVVAFAFGGIEIVTIAAAESEDPERSIAVAMRSVVWRISVFYLGSISIMVLVLPWDSSDLKSGPFVAVLNQAHIPYVAGFMELVVVVALLSAFNANIYGTSRMAYSLSRRGDGPAFMARISNSGVPLNAVLLSVFFGFVSVLLNWWLPDDLLGLLLNAVGSALLVIWIFIVVSHLRLRPRLEREGKLTVRMWLFPWLSYLTLAMLGGFVVLMLFDSDARTQLISTCVLFLVIAALGVLNTRLRQRSQTV

SEQ ID NO: 43973 - protein, 300 aa, Salinibacter ruber
IGRLCFRALLEREEDEIEIVGINDLTDAETLATLLKYDSVHGQFPGDVHLEESTLVVDEQEFPVFSEKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFYEAANGALDGILAYSDDPIVSRDIIHDPHSCIYDAPWTKVAGSQVKLVG

SEQ ID NO: 43974 - protein, 454 aa, Exiguobacterium sibiricum 255-15
MESNLKRELTARQVQMIALGGTIGVGLFLGSSSTIAWTGPSVILAYMFAGAFIFLIMRALGEMVYTHPHTGSYAKFANDYIHPAAGFMTASSNIFNWVIVGMSEVIAVGAYMRFWWPDLPTWIPGVVVIVILTLANLASVKMFGELEFWFASVKVITIILMIIAGLGLILFGFGNDGTPIGFSNLWSHGGFFTNGFSGFFFALSIVFASYIGVELIGVTAGETKDPETNITRAINGVIWRILIFYVGAIFIIVTVYPWDQLADIGSPFVATFAKVGITAAAAIINVVVITAAMSGCNSGIFSSSRMIYTLAEKGQMPSLFLKVNKNGIPLYTVLAVSAGIFVGVILDIVLPLFLGKDTNIFVYVYSASVLPGMVPWFAILISHIQYRKIEADRIADHPFKMPGAPFTNYITIVMLLIVLVGMLFNDETRVSILIGIVFLILSGIYYIVRTPKSF

SEQ ID NO: 43975 - protein, 300 aa, Salinibacter ruber
IGRLCFRALLEREEDEIEIVGINDLTDAETLATLLKYDSVHGQFPGDVHLEDSTLVVDEQEFPVFSEKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFHEAANGALDGILAYSDDPIVSRDIIHDPHSCIYDAPWTKVAGSQVKLVG

SEQ ID NO: 43976 - protein, 302 aa, Triticum aestivum
MDQVMVSPSPSASSGSGKSVGRAKSRSRSRSKSKSRSRSRSRSKSSTKSKSTSRSRSRSRSRSRSRSPRRDRLRSERSSRRSRSPPRRGRSPPRRSERRSYRDIICKNCRRPGHIARDCPSASTCNNCNLPGHFAAECTSKTVCWNCKKSGHIATECKNEALCHTCSKTGHMARDCPASGSNAKLCNNCFKPGHIAVDCTNDRACNNCRQPGHIARECKNDPICNLCNVSGHLARACPKTTTLASEIHGGPFRDISCRMCGQPGHISRNCMATVICDTCGGRGHMSYECPSARVFDRGVRRF

SEQ ID NO: 43977 - protein, 399 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHSIDRTYDVAEKVWAEVFFYLAQNNVMFEGILLKPSMVTPGAEATDRATPEQVASYTLKLLRNRIPPAVPGIMFLSGGQSGLEATLNLNAMNQAPNPWHVSFSYARALQNTCLKTWGGKEENVKAAQDILLARAKANSLAQLGKYTGEGESEEAKEGMFVKGYTY

SEQ ID NO: 43978 - protein, 75 aa, Zea mays
  misc_feature (45)..(45): Xaa can be any naturally occurring amino acid
VAYISLGDFNLTLLDHLIVDPGLRMVGCNNKLNAGYAANRYTHVXGVGAYVVGHLHHGSDIINSNNEINQQKLDA

SEQ ID NO: 43979 - protein, 272 aa, Oryza sativa
FPNDLCNNCKRPGHFARDCPNVALCHACGLPGHIAAECSSKDLCWNCKEPGHMANSCPNEGICRNCGKSGHIARECSAPPMLPGEMRLCSNCYKPGHLAAECTNEKACNNCRKSGHLARNCPNEPVCNLCNVSGHLARECPKSDAINERGGPPPFRGGAPPPFRGGYSDVVCRACNQVGHMSRDCMAGAFMICHNCGGRGHMAYECPSGRLMDRVPPSPFLSDFPVLNQMTPSWDRILNIIIRAFSLKMVVVLRTLVLISGQLTWIWGVLVV

SEQ ID NO: 43980 - protein, 101 aa, Zea mays
  misc_feature (34)..(34): Xaa can be any naturally occurring amino acid
NVVRKKLQLAGVTAMLLACKYEEVSVPVVEDLIXICDRAYTRADILEMERRIVNTLNFNMSVPTPYCFMRRFLKAAQSEKKLELLSFFMIELSLVEYEMLQ

SEQ ID NO: 43981 - protein, 109 aa, Zea mays
FLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLV

SEQ ID NO: 43982 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 43983 - protein, 115 aa, Zea mays
LLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLV

SEQ ID NO: 43984 - protein, 246 aa, Saccharomyces cerevisiae
MSRLEIYSPEGLRLDGRRWNELRRFESSINTHPHAADGSSYMEQGNNKIITLVKGPKEPRLKSQMDTSKALLNVSVNITKFSKFERSKSSHKNERRVLEIQTSLVRMFEKNVMLNIYPRTVIDIEIHVLEQDGGIMGSLINGITLALIDAGISMFDYISGISVGLYDTTPLLDTNSLEENAMSTVTLGVVGKSEKLSLLLVEDKIPLDRLENVLAIGIAGAHRVRDLMDEELRKHAQKRVSNASAR

SEQ ID NO: 43985 - protein, 542 aa, Desulfovibrio desulfuricans G20
MKSSLPVFEFASRRSPVYAPEVMVAASQPLAVSAGLGIAARGGSAADMAVAVAAVLAVVEPCSTGLGGDAFALYYDSATQHVAALNGSGKSGGGHTPEAVFSAGYDAVPARHGLAVTVPGACAAWCELHRKYGRLDLAEVLAPAVRLARDGFAVGPVTARLWATEEALLRGSEGGKSLLVRGRAPRAGERIRNHALARLLKNIARKGAAALYEGAAAAALADAVQAAGGVLTADDMSRCRAQWQTPASTVYGGVRVHECPPNGQGLVALSALNILAALSDKIKGAPVSAERLHCMIESLRLGFADGAAYIADPDFSAVPADGLLSGEYAAARAALIDSGRALPQAVCGVPQSSSDTVQFCVTDRDGNACSMVNSIYMTFGSGVVVPSLGLALQNRGHNFVLRQDHPNCLAPYKRPYHTIIPCLTTHENGELHGVMGVMGGFMQPQGHVQILSALLDDGCNPQQALDRLRFCIQPDGAASVVALEEGMDAGLADSLKARGHDVRPVSGYARDLFGRGQIILRQPNGFWEAGSDGRADGLALGF

SEQ ID NO: 43986 - protein, 257 aa, Thermoplasma volcanium GSS1
MIGTLYVTGPAGTGKSTFSGALKEWLQRMEFDAAIINLDPGADYLPYEPDFDIREYISLEGIMSDYNLGPNGSQIVAADMIINFTDKIKEFTDELQDYYLVVDTPGQIELFTFRTSSTEIVDRISGEKSMIAYIADAPLATYPSGFIAQKMLYASVFSRFFKPMMFVLNKIDLVSDEDVETVKKWERDPDLLNEAFIDEKGNIEKDYFLNLLEAFKESNIMTKVYPVSSRDSFGFEDIYSNMSMFFTGGEDNDTYNE

SEQ ID NO: 43987 - protein, 269 aa, Streptomyces coelicolor A3(2)
MDVRDRNHVTVTGRADGPVVMLAHGFGCDQNLWRLVTPILERDFTVVLFDHVGSGNSNLSAWDPERYGSLDGYVDDVLELCRELALGPVTFVGHSVSAMMGVLAAVREPEAFAGLVLLAPSPCFVDDPDTGYRGGFSAADIEELLDSLDANYLGWSGAMAPVIMGNPERPELGEELTNSFCRTDPDIARVFARVTFLSDNRADLAPVRVPTLVAQCSSDAIAPREVGAFVHAQIPASRLVTLNATGHCPQLSAPQETAAAIAAFAGGAD

SEQ ID NO: 43988 - protein, 340 aa, Pinus sylvestris
MGSTGKIKIGINGFGRIGRLVARVALTRDDIELVGVNDPFISTDYMSYMFKYDSVHGKWKHHEVNVKDSKTLLFGEKSVAVFGCRNPEEIPWGEVGAEYVVESTGVFTDKEKASAHLKAGAKKVVISAPSKDAPMFVVGVNEHQYKSDVNIVSNASCTTNCLAPLAKVINDKFGIVEGLMTTVHSITATQKTVDGPSNKDWRGGRGAGFNIIPSSTGAAKAVGKVLPALNGKLTGMAFRVPTPDVSVVDLTVRLEKSATYDEIKAAIKAESEGNLKGILGYTEDAVVSTDFIGDSRSSIFDAQAGIALSDNFVKLVSWYDNEWGYSSRVVDLIVHMAATQ

SEQ ID NO: 43989 - protein, 518 aa, Corynebacterium glutamicum ATCC 13032
MDIAAGVTVGIVALPLALAFGVSSGVGAEAGLVTAIIAGLVAAIFGGSNVQVSGPTGAMVVVLAPIVAQYGVGAVALLSLMAGVIVLVAGVLRLGRTVSFIPWPVIEGFTAGIGVIIFLQQVPAAFGYSGHLPTNALLAAIHTVSHATKDAILPLLIIIVTAAIMIVLGKIAPKLPASFIAILVVSIGVALLKLPVELIGELPNSLPAPHLPDVNLEMFTSLLGPAFAVAALAAIESLLSARVAASMADTGPYNADRELVGQGLASISAGFFGGMPATGAIARTAVNVRSGGRTRIASIIHALVLLGVVYVAANIVAVIPLAALSGVLMVTASRMVSIEVISRVMRSTRSDAIVFVITAIVTISVDLVIAVGIGIAVATFFMLRRMSMNAGVFRETLPEPATLNDEKIGLFRIEGALFFGAAERLSQQILDYEDLEVVILRLSHIQMIDATGAHQLTELVNALERKNVTVLIKGVRKEHIHVLGVLGAIRSLRHENHLFDDLAPAVEHARKHVKIDNS

SEQ ID NO: 43990 - protein, 200 aa, Neptuniibacter caesariensis
MGVLVGKQAPDFTAPAVLGNGEIVDSFTLSEATKGKKAVVFFYPLDFTFVCPSELLAFDHRIEEFKKRNVEVIGVSIDSHFSHNAWRNTPVNEGGIGAVNYTLVADMTHSICQSYDVESEGGVAFRGSFLIDEDGLVRHQVVNDLPLGRNVDEMLRMVDALAFHQEHGEVCPAGWNQGDKGMDASPEGVAKYLSEEADNL

SEQ ID NO: 43991 - protein, 360 aa, Atriplex nummularia
MAKVKIGINGFGRIGRLVARVILQSDDCELVAINDPFITTDYMTYMFKYDSVHGQWKHHELKVKDEKTLLFGERPVTVFGNRNPEEIPWGQTGADYVVESTGVFTDKDKAAAHLKGGAKKVIISAPSKDAPMFVVGVNEHEYKSELNIVSNASCTTNCLAPLAKVINDKFGIVEGLMTTVHSITATQKTVDGPSAKDWRGGRAASFNIIPSSTGAAKAVGKVLPALNGKLTGMSFRVPTVDVSVVDLTVRLEKEATYEQIKAAIKEESEGKMKGILGYTEDDVVSTDFVGDNRSSIFDAKAGICLNGNFVKLVSWYDNEWGYSSRVVDLIRHMSKTTSKLDSVALACVDAVSTLILSSEC

SEQ ID NO: 43992 - protein, 570 aa, Oryza sativa Indica Group
MACSANTREERATIIRLRARWGRRGEQRPWMSELTSVAKEVATAIVDVEEETLSLSLAQVDWDWVGNLDLMKLFLSKGVDVESESDAGTPLIWAAGHGQQEAVKLLLQHDAKASLCLALNHLSISRSCGLSLTFLLKLVIAWQPNTENDDGITPLLSAVAAGSLPCLDILIQAGAHPNIRAGGATPLHIAADGGNMEIINCLLKAGSDPNACDDDGLKPIQVAALRNNREVVELLLPLTSPIPGVSSWSIDGIIEYTKSVEEKAQVKEATTQKADRLQIPQLVEVSSEAKERSLEAKSRGDDAFRNKDYLVAVDAYTQAIELNPNDATLHSNRSLCWLRAGQAERALEDARACRALRPDWAKACYREGAALRLLQRFEEAANAFYEGVQLEPENGELISTKLIDQLARDDEKIKKKTRKPKPKKTVKQHQQEPQDNSRELPASEPKAPPGWPLQPPMYLPVTPAPPPPPPAFSELEAIRAVLEESEKVQEKLDKQHAGMRDELIKKSKDLRDKEFKLPYQNPTPCTEERSNCRQCYVSNAQDPLKCAEAVKRFEACVRLARQRGNTKVAQ

SEQ ID NO: 43993 - protein, 211 aa, Zea mays
MIVFLLLVATFGKLVTHYVDYYSGIDQLFRIILVKEAMEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGKVGPNRCSACRKRVGLTGFNCRCGNLYCALHRYSDKHDCKFDYRTAARDAIAKANPVVKADKLDKI

SEQ ID NO: 43994 - protein, 338 aa, Glomerella cingulata
MAPIKVGINGFGRIGRIVFRNAIEHPEVEIVAVNDPFIETKYAAYMLKYDSTHGIFNGEIKQEGNDLVINGKTVKFYTERDPAAIPWKETGADYVVESTGVFTTTDKAKAHLQGGAKKVIISAPSADAPMYVMVVNEKSYDGSADVISNASCTTNCLAPLAKVINDKFGIVEGLMTTVHSYTATQKTVHGPSAKDWRGGRTAAQNIIPSSTGAAKAVGKVIPELNGKLTDMSMRVPTTNVSVVDLTARIEKGASYDEIKQAIKEAAEGPLKGVLAYTEDDVVSTDMIGNPNSSIFDAKAGISLNNNFVKLVSWYDNEWGYSRRVLDLLAHVAKVDASK

SEQ ID NO: 43995 - protein, 279 aa, Triticum aestivum
  misc_feature (266)..(266): Xaa can be any naturally occurring amino acid
MAEHLASIFGTEKDRVNCPFYFKIGACRHGDRCSRIHNRPTISPTIVLMNMYQRPDMITPGVDAQGQPIDPRKMQEHFEDFYEDIFEELSKFGEIETLNVCDNLSDHMIGNVYVQFREEDQAAAAHTALQGRFYSGRLIIVDFSPVTDFREATCRQYEENTCTRGGHCNFMHVKQIGKDLRKKLFGRYRRSQRGRSRSPSPPIRKKRRDRDDYRGRDDFRRGGGGGGRRGGSSRHERHDDGGRRRYGGSPPRRARSPVRENSEERXAKIEQWNRERETK

SEQ ID NO: 43996 - protein, 477 aa, Clostridium perfringens ATCC 13124
MVNLMILSGIVLLTCIISSKIFYKWGVPVLLVFIIIGMLFGSDGIGGIYFDNYNITYSLSSIALVFIMFYGGFCTEWKKARSVAIPSIMLSTLGVIITAGLTGLFCHFVLKTSIFEGLLLGCIVASTDAASVISILRSRNLKLKNNIDTLVEFESGSNDPTAYMLTSVMLIFITSNESVGIGLLGMIFKQIVFGVTVGLFLSKLAVFILRKVEFEIEGLYPIFTITVAILAYSISEFLGGNGYLSVFIAGIVMGNSKIPHKKSLNHFFDGLSWIMQIILFFMLGLLAFPSQLPSIAFEGIAISIFLILVGRPIAVFTILSWFKVPIKEQMFISWVGLRGAGSLVFAIYAITKTSAIENDIFHIIFFIALFSVAIQGTLIPWFAKKLDLICYEDDNHEDNMKNNIKDYIFEVKVGENNKVVNKAIMDSEIPDEILIVMIKRDNKVVIPKGFTIIKPNDTLVLTSENNEIMNSFLDEIR

SEQ ID NO: 43997 - protein, 462 aa, Prosthecochloris aestuarii DSM 271
MQEGKISQIIGPVVDVDFPEGQLPSILDALTVARPDGSKLVLETQQHLGDERVRAIAMEGTEGLVRGIPVINTGKPIQVPVGQNVLGRMLNVVGEPIDGMGDIDSDTTRSIHRSAPKFDELSTKSEMFETGIKVIDLLEPYSRGGKTGLFGGAGVGKTVLIMELINNIAKQQSGYSVFAGVGERTREGNDLWEEMKESGVIDKTALVFGQMNEPPGARARVALTGLSIAEYFRDVEHRDVLLFVDNIFRFTQAGSEVSALLGRMPSAVGYQPTLGTEMGELQDRIVSTKDGSVTSVQAIYVPADDLTDPAPATTFTHLDATTVLSRSIAELGIYPAVDPLDSTSRILDPNIVGDDHYDTAQAVKEILQRYKDLQDIIAILGMDELSDEDKLVVSRARKIQRFLSQPFFVAEAFTGLSGKYVKLEDTIKGFKEIIAGRHDNLPENAFYLVGTIEEAIEKAKKL

SEQ ID NO: 43998 - protein, 326 aa, Nocardia farcinica IFM 10152
MKLLVTGGAGYVGGVCALVLLEQGHEVVVVDDLTTGNADGVPAGARFVEGDVAEVAPALLRAETFDGVLHFAAQSLVGESVERPEKYWHGNVVKTLELLEAMRHTGTGRLVFSSTAAVYGEPEQVPITEDAPTRPTNPYGATKLAIDHAITSYAIAHGLAATSLRYFNVAGAYGGLGENRVVETHLIPLVLQVALGHRESISVYGTDWPTPDGTAIRDYIHIRDLADAHLLALTSAEPGSHRIYNLGSGTGFSVREVISACERVTGLPIAAQDAPRRAGDPAVLIASSERAVAELGWRPQHTALDEIVADAWEFLRSLGSRAHSAR

SEQ ID NO: 43999 - protein, 569 aa, Clarkia lewisii
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDSVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSISILLPTLDAYRIGQLLAIYEHRVAVQGFVWGINSFDQWGVELGKSLATQVRKQLHGSRVKGEPVEEGFNFSTKTLLTRYLQATSDVPADPSTLLPNI

SEQ ID NO: 44000 - protein, 317 aa, Clarkia lewisii
LVEKFGIDPNNAFAFWDWVGGRYSVCSAVGVLPLSLQYGFSVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPAQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATTDVPADPSTLLPNI

SEQ ID NO: 44001 - protein, 201 aa, Legionella pneumophila str. Paris
MSVLVGRKAPDFTVAAVMGNGEIVDKFNLHEHLKGKYGLVFFYPLDFTFVCPSELIALDHRIEEFKRRNVEVVAVSIDSHFTHNAYRNTPVKNGGIGPVRFTLAADMTHSICQSYGVEHPVAGVAFRGAFVIDTNGMVRSQIVNDLPIGRNIDEIIRIIDAVQFFEENGEVCPAGWQKGQAGMKASPKGVAEYLSEHSESL

SEQ ID NO: 44002 - protein, 437 aa, Haemophilus influenzae
MIRFIFKHKKMHKPKELVFGQTIIQLNQVNGADKRKLIWLLIIKRSRQAFPYFQREDAVIYLDNAATTLKPQVLIDRTAEFYASAGSVHRSQYDAAQTVQYEQARTQVKEWVHAEDKHAVIWTSGTTHAINLVANGLMPQLNAEDEILISQADHHANFVTWHETAKKCGAKIQVLPILDNWLIDENALISALSEKTKLVALNFVSNVTGTEQPIKRLIQLIRKHSNALVLVDAAQAISHIKIDLQDLDADFLAFSAHKIYGPNGLGVLTGKLTALSQLQPLFFGGKMVDRVSNDRITFAELPYRLEAGTPNIAGVIGFNAVLDWLQKWDFTAAEQYAISLAESVKVRLKSYENCRLFNSPQASTVVCFVFDGIDCSDLSTLLSEQNIALRVGEHCAQPYLARLGERTTLRLSFAPYNTQEDVEAFFTALDKALDLLQ

SEQ ID NO: 44003 - protein, 300 aa, Salinibacter ruber
IGRLCFRALLEREEDEIEIVGINDLTDAETLATLLKYDSVHGQFPGDVHLEDSTLVVDEQEFPVFSKKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFYEAANGALDGILAYSDDPIVSRDIIHDPHSCIYDAPWTKVAGSQVKLVG

SEQ ID NO: 44004 - protein, 389 aa, Legionella pneumophila str. Paris
MSLITSYSPMPVTFTHGEGVWLYDEQGKKYLDGLSGIAVCGLGHAHPDVTRTIQEQAARLIHTSNVFHIKEQELLAAKLTSMARMEQVFFANSGAEANEAAIKLTRLFGHKKGIETPSIIVMEKAFHGRTMATLTASGSRKVQAGFEPLVPGFIRAPFNDLDAIHTIAANREDVVAVMVEPIQGEGGIYPAEEGYLRALANLCEQNDWMLILDEIQTGNGRTGKLYSCMHYDIQPDILTTAKGLGNGMPIGACLMSKRAKDLFKPGNHGSTFGGNPLACATALTVLEVIERDKLCEHVTKNSALLMDKLISNLGEHPHVKAIRGKGYMIGIELDRPANDMRVLGLENQVLFNITAETVVRLLPPLIISEDEIDELVNRITRTINQFTNQ

SEQ ID NO: 44005 - protein, 207 aa, Lilium longiflorum
MSSRPRGRGRGWGRRPQRRSRRTPSRRRQAKLFVGNIPYDDSEKLANLFDKAGVVEVAEVIYNRETDQSRGFGFVTMSTVEEAERAVEMLHRYDINGRNLTVNKAAPRGSRPERPRESDPSLRVYVGNLPWQVDDSRLEQLFSEHGKVIDARVVYDRQSGRSRGFGFVTLATREEVDDAIAALDGQSLEGRALRVNVAEERPRRSSF

SEQ ID NO: 44006 - protein, 195 aa, Nocardia farcinica IFM 10152
MALLTIGDQFPAYNLTAVIGGDLSKVDAQQPDDYFTQVTSDDHAGKWRIVFFWPKDFTFVCPTEIAAFGKLNDEFADRDAQVLGVSVDNEFVHFQWRAQHEDLKTLPFPMLSDLKRELSTATGVLNADGVADRATFIVDPNNEIQFVSVTAGSVGRNVDEVLRVLDALQSDELCACNWKKGDPTINAGELLAASV

SEQ ID NO: 44007 - protein, 300 aa, Salinibacter ruber
IGRLCFRALLEREEDEIEIVGINDLTDAETLATLLKYDSVHGQFPGDVHLEDSTLVVDEQEFPVFSEKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFYEAANGALDGILAYSDDPIVSRDIIHDPHSCIYDAPWTKVAGSQVKLVG

SEQ ID NO: 44008 - protein, 406 aa, Bacillus halodurans
MNAHEIKKLFPVLDQEVNGSPLVYLDSAATSQKPIAVIEALDDYYRRYNSNVHRGVHTLGTLATDGYEGAREKIRRFIHASSTEEIIFTRGTTTAINLVAASYGRANLGEGDEIVITPMEHHSNIIPWQQVAKATGATLTYLPLQKDGTIKIEDVEKTISEKTKIVAIMHVSNVLGTINPVKEIAEIAHRHGAIMLVDGAQSAPHMKIDVQELGCDFFAFSGHKMAGPTGIGVLYGKKAHLEKMEPVEFGGEMIDFVGLYDSTWKELPWKFEGGTPIIAGAIGLGAAIDFLEDIGLDEIEKHEHELAQYALDRLSELEGMTVYGPQKRAGLVTFNIEDVHPHDVATVLDADGIAVRAGHHCAQPLMKWLDVTATARASFYLYNTKEDIDALAKGLEKTKEYFGHVF

SEQ ID NO: 44009 - protein, 685 aa, Mycobacterium avium subsp. paratuberculosis
MTRSPCSTTSRWISSMSTSEYRAVDAESDLPISAAELAALASQLYAASIRPGPDSPPQQAPVAPRGSVPDATAATSAGRTAAGTADVYPGPVPQVGGRDVYLPPPASPAPEAPPQAAPPAPRGSAPDATAATSAGRAAAGTSDVYSSWVPQLGVADIYLGAPTPAGPEAPPQSAPPAPRGQVPDTTAAATAYGADLSAFAVPTGIVSTAPGVQAGTAPPVPVVPRAATAPSWLPEAPSVADLGWSDAPAPDAPAGDEHDYHFLTKTDPVPQFRDEHEVFDVAAIRSDFPILKETVNGKPLIWFDNAATTQKPQVVIDRLSHFYAHENSNIHRAAHELAARATDAYEEARDTVAEFIGAPSSDNIVFVRGTTEAINLVAHAWGAKHLQPGDEIVITHLEHHANIVPWQLISQKTGAILKVAPIDDAGNLLLSEFEGLLGPRTKLVAASHVSNALGTVMPVDKIVELGHRYGARVLIDGAQSIQHIPIDVAELGADFFVFSGHKIYGPTGIGALYGTEEALTETPPWQGGGHMIADVTLERSLYQGPPTKFEAGTGNIADAVGLTEALRYVQRLGVERIAAYEHALLEYATPRLADIPGVRLIGTAQEKASVLSFVLAGHEPLEVGKALNAEGIAVRAGHHCAQPALRRLGLEATVRPSFAFYNTFEEIDVFLRAVRRIAEGGANVG

SEQ ID NO: 44010 - protein, 556 aa, Legionella pneumophila str. Paris
MATKVTKRGMDLLRDPILNKGTAFSLQERDEFALHGLIPTTVETLEQQVIRCLDAYSAKEEPLEKHIYLRALQDRNEVLFYRFIIDNLVDILPIIYTPVVGQACEMFSHIYRQPRGVFLSYPERDKLDSIIQNIASTRSIKVIVVTDGERILGLGDQGAGGLGIPIGKLSLYTSCGGIHPSNTLPIILDVGTNNKERLDDPEYIGWRHARISGKDYDDFVDQFVQSIKRHMPHVLLQFEDFAQQHAYPLLERYKDQLCTFNDDIQGTASVAVAAILAATRVTNTPLKEHRVALLGAGSAGCGISEQLVHAMMNQGLSEEEARSRFYLVDRYGLLHDEMTDLLPFQKGFVRSSTSLQNWKLEKQGEITLTDVINNAQPTILLGVSGQPNQFKEAMIKTMLSYCERPIIFPLSNPTSRAEAIPQDLLNWTAGKALIATGSPFEPVAINGHKIEIAQCNNSYIFPGVGLGVVAGQAKRVTDLMMMAAAVALSELAPAIRTGEGRLLPELNSIREVSQHIARAVILQGIKEGHIGPMNDNEIDDSIKRTMWTPQYEPYVL

SEQ ID NO: 44011 - protein, 418 aa, Schizosaccharomyces pombe 972h-
MAQACKTTYSSRLKTGNTCLIQKNVAVSTRSHSSYTGRNSLRNVPAVNYAAFEQGEDFETPVETPEKEEEKFETDDRGLAVGRPTGNNIYPRFATKTRHIYVTDEQLKCAAEERDVYIPIRLDIELPNNYRLKDTFLWNMNEQVMTPDVFAQILCADLDLSTNVYGTQISSSIRAQIEEYAPVAEVPMPKGQEMLVVFNIQVQLAQLSYNDQVEWNLTSPLTPEEFSVLTCNDLGLSGESRPEIAYAIHECLLKLKKNACEGDLPDYDSDAVPGTKAGPRQDMDTLGALWQPVLETVSLEDAKKNENNRENLVKQWRREASKFGGFAADVSAERWRAAALGNLSQSETANLPSASVSDAQTLLEQERPRWRCRWCNVLGTGTFCVRRGPEGNKSLCNACGVAYAKTGQLPYWRKSLYT

SEQ ID NO: 44012 - protein, 404 aa, Rhodococcus sp. RHA1
MRSQPHVLGIVLAGGEGKRLYPLTADRAKPAVPFGGAYRLIDFVLSNLVNAGYLRLCVLTQYKSHSLDRHISQTWRLSGFAGEYITPVPAQQRLGPRWYTGSADAILQSLNLVYDEDPEYIVVFGADHVYRMDPEQMVQHHIESGAGVTVAGIRVPRSEAFAFGCIDSDESGRIVQFLEKPAHPPGTPDDPNMTFASMGNYVFTTKVLVDAIRADSENSDSDHDMGGDIIPALVEAGEASVYDFKDNIVPGATDRDRGYWRDVGTLDAFYDAHMDLVSVHPIFNLYNRRWPIRGETENLAPAKFVQGGLAQESVVGAGCILSAATVRNSVLSSNVMVDSGATVEGSVLMPGVRIGKGAVVRRAILDKNVVVGDGEIIGVDLERDKQRFAVSNGGVVAIGKGVWI

SEQ ID NO: 44013 - protein, 392 aa, Vibrio fischeri ES114
MTDTHYSLDDIRLRLNELDNELLKLFSERRKLSLDVAKSKVKTAKPVRDPKREQQLLVKLIENGKDFDLDAYYITQLFHTIIEDSVLLQQEYFQNLANPDLSRKPVARVAYLGSKGSYSNLASRRYFSKKNIELAELGCENFKEVIKTVESGHADYGVLPIENTSSGSINQVYDLLQHTSLYIVGELTQKIDHCLLTTTETSLESIKTLYSHPQPHEQCSEFLNRLNNVELISCASTADAMITVKELNSPEVAAIGNSDSGKLYGLQSLITNISNQTENQTRFIVVARKPVDVSEQIPAKTTLIMSTAQDAGSLVESLLVLQKYGINMSKLESRPIMGNPWEEMFYVDLEAHLKSDAMTSAIEELTAITRYLKVLGCYPIENVEPTAIPLSN

SEQ ID NO: 44014 - protein, 338 aa, Mycobacterium tuberculosis CDC1551
MQEAPHRVMPLVRPCPRPSDPGEYVRPMTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 44015 - protein, 711 aa, Legionella pneumophila subsp. pneumophila str. Philadelphia 1
MKISAIKTWLPLLIIIVLLGLFLGLGLNKYVSFASLRDNHEWLIAITKSHFYLVSFVFIIIYTVAVALSIPGAIFLTLIGGFLFGILWGTFLVVLSATLGATILFFAVQSSLGEVFSKRASGWVKRMRSGFKDNAFSYLLTLRLIPLFPFWVINIVSAVLGVSASTFIIATFIGIIPGSIVYVSVGNGLGELFAASLQPNLGIIFEPKFILPLLGLAALSLIPVFYKKKGKQGTEKMKDKDLFCDLAIIGGGSAGLSIAAGCSQLGLQVVLVEPNKMGGDCLNYGCIPSKTLLNTAKIFYQTKHSTVLGIQAKSVKIDFLQVMQQVHNVIACIAKNDSVERFTSLGVQVIQEAGHFIGPKQFKLKRKIIRAKHFVIATGSSPAIPPIQNLNKVSYLTNETIFNLKVQPEHLIVIGGGPIGCELAQAFAMLGSKVTILEAFTILPKDDADCVAIIRSQLESMQIALYEQIKINKIEESADKTISVHLENQDNPITITGSHLLVSTGRVANVDGLGLEKAGVQYTTRGINTNARLQTTNKKIYAIGDVTGPYQFTHMASYQAGIALRNIAFKWPAKVDYKAVPWVTYTEPELAHVGLLASEALKDPTLKITEFAFAEVDRAQAENKVNGKIKIITGKKAKILGVSIVGAHAGELILPWVIAVKERKSLRTFTDAIAAYPTFSEISKRVAGEYYKPFIFSSKIRTFVRWLNKLG

SEQ ID NO: 44016 - protein, 319 aa, Yersinia pseudotuberculosis IP 32953
MSKIVSLGIHVLDVLGRHVNRFPPGGELDIINEIRLTVAGTAAGMSVDLAKLGGDVYAMGAVGLDESGNFIIDTLRRYGVNTDHIVRKSEVQTSCSMLPIRPNGERPVLHVLGANAAYRLEDIHWDVIASADILHFGGTYLLPGLDGPPTATILKFAKEHGVTTTLDLLVNAQPDLLAKLEPALPYIDYFMPGLDEARAICGLDKRADVIAFFLNRGVGHTVFKMGAEGSSIASLDMAEVLIPAYKAQVVDSTGCGDSYCAAFIMGLTKGWDLATSGRFASAAASLVVSGLGSDAGIIDFEHTLKVMNTAETLPIAQET

SEQ ID NO: 44017 - protein, 110 aa, Arabidopsis thaliana
  misc_feature (25)..(25): Xaa can be any naturally occurring amino acid
  misc_feature (33)..(33): Xaa can be any naturally occurring amino acid
  misc_feature (47)..(47): Xaa can be any naturally occurring amino acid
  misc_feature (52)..(52): Xaa can be any naturally occurring amino acid
  misc_feature (54)..(56): Xaa can be any naturally occurring amino acid
  misc_feature (61)..(62): Xaa can be any naturally occurring amino acid
  misc_feature (67)..(67): Xaa can be any naturally occurring amino acid
  misc_feature (69)..(70): Xaa can be any naturally occurring amino acid
  misc_feature (73)..(75): Xaa can be any naturally occurring amino acid
GHIVTVELKSGELYRGSMIECEDNXNCQLEDIXYTAKDGKASQLEHXFIRGXKXXXMALPXXFQYAXMXXRPXXXYSYLPPTISHVPPSLFRYILSYIIIHRTLFSLVAA

SEQ ID NO: 44018 - protein, 180 aa, Marinobacter sp. ELB17
MDYFSQSIKQAIRTVPDWPKPGVTFRDITTVLQNKTAFRKLIDAFVHRYHDQHIDAIAAVDARGFIIGSALAYELNASLVLIRKKGKLPFDTLVEDYELEYGTASVELHKDALKPGDKVVLVDDLIATGGTMLAASRLIRRIGAEIVEVAAMIDLPDLGGSDKLRAEGLTVYTVCSFEGE

SEQ ID NO: 44019 - protein, 104 aa, Saccharomyces cerevisiae
MVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 44020 - protein, 411 aa, Saccharomyces cerevisiae
MPRDPLIGIVGKPSSGKSTTLNSLTDAGAAVGAFPFTTIEPNQATGYLQVECACSRFGKEDLCKPNYGWCSKGKRHIPIKLLDVAGLVPGAHSGRGLGNKFLDDLRHADALIHVVDVSGTTDAEGKNTRGYDPLNDIEWLQDEIRLWVEGNLKKRWGSIVRKHTATKSSIVDTLQAQFGGYGSHAPMIQKALDRLKGLPPLEKWDDEWITRVVKSFMMEKFPTVLALNKIDHPDADKNVSKIMLKYPDTKAVLTSAVTEVFLRKLKKQGFILYEEGTEFVDTFEDEPDKLKPLDDKILNRIENIRDLVLYRFGSTGVVQVLQAATDILGLIPVYTVKNIQTFTGGNGTNVFRDCFLVKRGTPVGKVARYIMGGEVTIASIETVGGVRVSEESLVEPGKNDILGFKIAPRSA

SEQ ID NO: 44021 - protein, 334 aa, Neptuniibacter caesariensis
MSITKQSVVNSILTESTQLGTAAEAFAPSNIALCKYWGKREAELNLPINGSLSISLGELGSRTSIVESDSGSDQVYLNDKLIEPTDRFATKVISFLNLFRRELQQPVVIKTVNNIPTAAGLASSASGFAALMLAINDFYRFGLGNEVLSAFARMGSGSASRSVFQGFVEWQKGLREDGMDSCAQRLDLEWQGFRIGLLKVATGAKKVDSRAGMQRTVESAPLYQAWPEQAAKDLQTIKRAIEDKDIELLGQTAEQNALSMHATMIGSWPPLLYWQPESVAAMHRVWELRALGVPVYLTMDAGPNLKLLFTAEYEAQVRDAFPELTDLDLVAPFG

SEQ ID NO: 44022 - protein, 499 aa, Oryza sativa Japonica Group
MENSQVWLLWGALSVAVLFYLSTLRRRYAGGKPLPPGPTPLPLIGNLHLAGGTFHHKLRDLARVHGPVMTLKLGLATNVVISSREAAIEAYTKYDRHLAARATPDTFRACGFADRSMVFIPSSDPQWKALRGIQGSHVFTPRGLAAVRPIRERKVGDLIAYLRAHAGEEVLLGQAMYTGLLNLVSFSYFSIDIVDMGSQMARDLREVVDDIISVVGKPNISDFYPFLRPLDLQGLRRWTTKRFNRVFSIMGDIIDRRLAHIRDGKPRHDDFLDSLLELMATGKMERVNVVNMLFEAFVAGVDTMALTLEWVMAELLHNPAIMARVRAELSDVLGGKEAVEEADAARLPYLQAVLKEAMRLHPVGALLLPHFAAEDGVEIGGYAVPRGSTVLFNAWAIMRDPAAWERPDEFVPERFLGRSPPLDFRGKDVEFMPFGSGRRLCPGLPLAERVVPFILASMLHTFEWKLPGGMTAEDVDVSEKFKSANVLAVPLKAVPVLIK

SEQ ID NO: 44023 - protein, 335 aa, Paucimonas lemoignei
  misc_feature (42)..(42): Xaa can be any naturally occurring amino acid
MRISILGAGAWGTALAIALAERHDVVLWGRSEDAMAQRARSXENTAYLPGHPLPAALKATADFSLALDHVAQGDGLLIAATSVAGLRPLAQQLQGKAIPNLVWLCKGLEEGSGLLPHQVVREVLGTQLPAGVLSGPSFAQEVAQGLPCALVIAAEDAALRELVVAAVHGPAIRVYSSDDVVGVEVGGAVKNILAIATGILDGMSLGLNARAALITRGLAEITRLGIALGARAETFMGLAGVGDLILTCTGDLSRNRKVGLGLAQGKPLETIVTELGHVAEGVRCAAAVRNLAQQLQIEMPITNAVAGILFDGHSPRATVEQLLARHPRDESISAS

SEQ ID NO: 44024 - protein, 349 aa, Mycobacterium leprae
MAGIVVRSESAVAVMGAGAWGTALAKVLIDAGGPEAGVVLWARRPDVAERINTTRCNRAYLPGTLLPPGIRATADPADALRGASTVLLGVPAQRMRANLERWGGLVADGATLVSLAKGIELGTLMRMSQVIVSVTGVDPAQVAVLSGPNLASEIAQCQPAATVIACSDLGRAVALQRMLSSGYFRPYTNSDVVGTEIGGVCKNVIALACGMAAGVGFGENTAATIITRGLAEIIRLGMALGAQVTTLAGLAGVGDLVATCTSPHSRNRSLGERLGRGEIMQSILHGMDGSDGGDGYVVEGVTSCASVLALASSYDVEMPLTDAVHRVCHKGLSVEKAMALLLGRSTKSE

SEQ ID NO: 44025 - protein, 407 aa, Nocardia farcinica IFM 10152
MNALWHGFADMGAVARDGAFVVARGAGAYVYDEAGNRYLDATAGLWFTNVGHGRAEIADAVAAQLRRIAHYSNFGDIAEPPTRELAERLSAIAPIPGSKIFFTSGGSDSVDTAAKFARRYWHEVGRPGKTIVVGRQRAYHGMHVAGTALSGLPPNRDGYGELMPDARTVDWDDPKGLLALIEEVGAERIAAFFCEPIIGAGGVYLPPEGYLTEVRAICADHDILFVADEVVTGFGRIGGSWFASSRFDLRPDLMTTAKGLTSGYLPMGAVFIAPHLAEPFFAGGVWWRHGYTYGGHAASAAAALANLDILERENLLAEATRLEATLHAELAPLAQHPRVAEVRSGLGAVAAVQLADPAEAPAFVKALRAEGVSSRAAGQGALQISPAFVMTDEQVRELAAAFARALG

SEQ ID NO: 44026 - protein, 389 aa, Zygosaccharomyces rouxii
MAATDRLNQTSDILSHSMKKTDTSMSIVTAENPYKVAVVGSGNWGTTIAKVVAENTKEKPELFQGRVDMWVFEEQIDGTPLTQIINTKHQNVKYLPNIDLPGNLVANPDLISTTKDADVIVFNVPHQFLGRIVSQMKGQIKPDARAISCLKGFEVGPKGVQLLSDYVTQELGIQCGALSGANLAPEVAKEHWSETTVAYQVPDDFKGEGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLITAKEVHQWLESSGHTEEYPLFEAVYQITYENVPMKELPSMIEELDIVE

SEQ ID NO: 44027 - protein, 308 aa, Oceanobacillus iheyensis HTE831
MRVSDNITGLIGGTPIVKLHNVTDEGSADVYAKVEFMNPGSSVKDRIAIAMIEAAEQGGKLKEGDTIIEPTSGNTGIGLAMVAAAKGYRAVLVMPDTMSQERRNLLRAYGAELVLTPGAEGMKGAIAKAVELQEENDYFMPQQFSNPANPDIHEKTTGKEIVEQMKDGLDGFVSGIGTGGTITGAGKVLKNHFQDIKLYAVEPADSPILSGGSPGPHKIQGIGAGFKPDVLDTAIYDEVLTISNEEAYEAARKVATTNGILGGISSGAAVAAAVKVAKQLGAGKKVLAILPDNGERYLSTPLYQFDKE

SEQ ID NO: 44028 - protein, 543 aa, Corynebacterium efficiens YS-314
MIVTNDLEVRVGARTLLTAPGQHLRVQPGDRIGLVGRNGAGKTTTMRILSGETQPYGGSVTVSGDVGYLPQDSREGNIEQTARDRVLSARGLDQLRSSMERQQEIMETTGDAAKLDAAIRKYSRLEEQFQALGGYEADAEAAQICDNLGLEARILDQQLKTLSGGQRRRVELAQILFAATNGSGKSKTTLLLDEPTNHLDADSISWLRDFLSKHEGGLIMISHDVELLDAVCNKIWYLDAVRGEADVYNMGFAKYKDARATDEARRRRERANAEKKAGALKDQAARLGAKATKAAAAKQMIARAEKMMGSLDEIRVADRVANITFPEPAPCGKTPLNAKGLTKMYGSLEVFAGVDLAIDKGSRVVVLGFNGAGKTTLLKLLAGVERTDGEGGIVTGYGLKIGYFAQEHDTIDPDKSVWQNTIEACADADQQSLRGLLGSFMFSGEQLDQPAGTLSGGEKTRLALATLVSSRANVLLLDEPTNNLDPVSREQVLDALRTYTGAVVLVTHDPGAVKALEPDRVIVLPDGTEDLWNDEYMEIVELA

SEQ ID NO: 44029 - protein, 378 aa, Rhodococcus sp. RHA1
MPVLSESAVRSALARVQDPEIRKPITELGMVKSVDIASDDSVDIAIYLTTAGCPMRTEISDRVTKAVADVPGVGAIRVELDVMSDEQRTELRKSLRGDSAEPVIPFAQPGSLTRVYAVASGKGGVGKSSVTVNLAAALAARGLSVGVLDADIYGHSVPRMLGTDAKPTQVERMIMPPVAHDVKMISIAQFTQGNTPVVWRGPMLHRALQQFLADVFWGDLDVLLLDLPPGTGDVAISVAQLIPGAEILVVTTPQQAAAEVAERAGAIALQTRQRIVGVVENMSWMDMPDGSRMDIFGSGGGQAVADRLTKAVGAKVPLLGQIPLEQAVREGGDGGVPIVLGHPDSPAATALRDIADKLAVRKRGLAGMSLGIDTTRHL

SEQ ID NO: 44030 - protein, 342 aa, Exiguobacterium sibiricum 255-15
MTDRYSRQVRFRPIGQKGQDQMADRHVVIIGAGALGTANAEQLVRGGVGHVTLIDRDHVEWSNLQRQQLYTEQDVQDHLPKAVAAKRRLGKVNSVVSVTAIVEDVTPENIERLVRGSDLMIDATDNFSVRMLINDVAAKSGIPWIFGACVGSYGMTYTIRPGQTPCLHCLLEHLPKQQETCETSGVISPVVQLVAAHQVTEALKYLTGADNALRQTLLSFDVWDNHQSQINVGSLRQSACPSCGDDPVYPYLNAPIVQFVTLCGRDTVQIRGEGPRDLVRLEQELTTHGISCLQNPYLLMFKADDYRITAFADGRILLHGEANLQQAKQVYENYFTGIFTKK

SEQ ID NO: 44031 - protein, 699 aa, Oryza sativa
MARSGRERRDQEEEAAVVSVERVFEGRVVPGWKEQVTLRALAVSALLGAMFSVIVMKLNLTTGIIPSLNVSAGLLGFFLLTSWTKLLDKAGVASVRPFTRQENTVVQTCVVACSGIAFSDADLCTGGTGGFGSYIFAMSDRISDQSGEARDEHNIKNPSLGWMIGFLFIVSFLGLFSVVPLRKIMIIDYKLIYPSGTATAHLINSFHTPQGAKLAKMQVKMLGKFFVMSFSWGFFQWFYTGGDGCGFMSFPTLGLEAYRNKFFFDFSATYVGVGMICPYLVNISVLLGGVMSWGIMWPLIEHKKGDWYPADLKPSSLRGIVGYRVFISISLILGDGLYNFLKVMTRTTTALVMQVRAMMSEPTLPVSGGGGGGGGQTPEETFDDKRRTELFLKDQIPNWLALSAYVVIAVVSIATVPRIFHQLRWYHVAVSYVVAPVLAFCNAYGCGLTDWSLATTYGKLAIFTVGAWADASDGGIIAGLAACGVMIGIVSTASDLTQDFKTGYMTLASPRSMFVSQVIGTAMGCVIAPSVFWLFYKAFHDIGMPGSEYPSPNALVYRNMAILGVQGLGSLPKHCLDLCIGFFVAAIAVNLARDLAAPKVARFLPLPMAMAIPFYLGPYFGIDMCIGSLIRFVWDRLDGARAKAFAPPVASGLICGDGIWTLPQSVLALAGVKPPICMKFLSRTTNIKVDAFIAKLPSS

SEQ ID NO: 44032 - protein, 422 aa, Corynebacterium efficiens YS-314
MSDFLKDDGTLNVARIREEFPILNRTVRNGQPLTYLDSGATSQRPERVWRAEERFVLHTNAPVHRGAYQLAEEATDAYEGAREKIAAFVGADQDEIAFTKNATEALNLVAYTLGDDRAGAHRVQAGDTVVVTELEHHANLVPWQELCRRTGATLKWYKITPDGRIDLDSLELDETVKVVTFTHQSNVTGAVSDVPEMVRRARAVGALVVLDACQSVPHMPVDFHALDVDFAAFSGHKMLGPSGVGAVYGKRELLDALPPFLTGGSMIEVVNMDGSTYAPAPQRFEAGTQMTSQVVGLGAAVEMLTEIGMEAIAAHEHELTAYALEKLQGIPGVQIVGPATAENRGGALSFAVDGIHPHDLGQVLDDQGVSIRVGHHCAWPLHRCMNVQSTARASFYLYNTMEEIDRLVDAIEKAKQFFGVEV

SEQ ID NO: 44033 - protein, 355 aa, Schizosaccharomyces pombe 972h-
MNPTTKRAIKEIVVYALAFGCSWYAAHKLLSTLDPYRQKRQDTVSKSRKRLDEWAGEQVKELETLELNEYEQIVASQLVLPSEIDVSFDDIGGMDEHVNQLLQDVLFPLKYPEVFDTHGGLLSCPKGLLLYGPPGCGKTMLAKALAKQSQATFINVSVGLLTDKWFGESNKLVDALFTLARKLEPTIIFIDEIDTFLRQRQRTDHEAMAQIKAEFMSMWDGLLSGQSRVLVLGATNRPADIDEAIRRRMPKVFSIPLPNAEQRRKILELYLKKVPLEANFDWNGVVNATAGLSGSYIKEVCRSALSVPRRELFDKHGNDLEAIKYDIQSGGLRSLKTEDFYHYESLQNVSGIDVE

SEQ ID NO: 44034 - protein, 378 aa, Zea mays
  misc_feature (53)..(53): Xaa can be any naturally occurring amino acid
  misc_feature (92)..(92): Xaa can be any naturally occurring amino acid
MEFLLGVKLGSSLSSIGLFVFLHIAALQLDRKVVDLAELRRLACQGVPDAAVXQLLLGYVPTDRALWPYELEKKRSQYCDFKDELLVNPIHXLFILRKPFVPLSNSVVIHLCSGQSEVTRRMEEMTASEREEHNAEGTGVLPRAEIVRDEHPLSLGKTSVWNQYFQESEIVEQIDRDVKRTHPEMEFFNGDSSDSLSNQESLKRILTIFAKLNPGIRYVQGMNEVLAPLYYVFKNDPDQSQAALAEPDAFFCFVELLSGFRDNFCKQLDNSVVGIRSTITTLSQLLRRHDEELWRHLEVVTKEFQFRDCLSLWDTLLGDPEGPQATLLRVCCAMLILVRRRLLAGDFTANLKLLQNYPPTNIDHILHIANKLRGPLPF

SEQ ID NO: 44035 - protein, 121 aa, Zea mays
LLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 44036 - protein, 148 aa, Arabidopsis thaliana
MICTESNHQRFSFAGDLGQSDKGTPMEQQPSGPVRRDTTLLDSSNSDFEFHISSNFDPGDSSPADEIFADGMILPVLPFQVTATSTMPKRLYKYELPPIVSAPTLSSYLPPLPLPLPEHSRKYSVKETRGSLNGRGSGRANSRPLNQS

SEQ ID NO: 44037 - protein, 264 aa, Pseudomonas fluorescens Pf-5
MTAMQLDIFQVDAFTSHVFGGNPAAVCPLDAWLPDEVLQRIALENNLSETAYFVPRGEVFELRWFTPAVEVDLCGHATLAAAWVLFEQLGERRDVLRFATRSGELRVSREGGLLSMDFPAKQPEAVAIAPALLQALGLPAAEALYRTDDYLLVVDDESLVEALKPDFAALAAFDVRGIAVTAPSREFDFVSRWFGPRVGVNEDPVTGSAHTSLAPYWAARLGKHQLRAQQGGARKGQLQCQVLDNGRVIISGYGALYLKGSIFL

SEQ ID NO: 44038 - protein, 466 aa, Yersinia pseudotuberculosis IP 32953
MTPRLSRWLTSLDKFEERISQTTTIRRYGRLTRATGLVLEATGLQLPLGATCLIERHNGGEVQEVESEVVGFNGQHLFLMPLEDVEGIVPGARVYARVTTSGTSASKQSIPSKQSFASKQLPLGPELLGRVLDGSAKPLDGLPAPETGYRAPLITPPINPLQRTAIVQVLDVGVRTINALLTVGRGQRMGLFAGSGVGKSVLLGMMARYTQADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGVSGGGSITAFYTVLTEGDDQQDPIADSARAILDGHVVLSRRLAESGHYPAIDIEASISRAMTSLIDDDHYSRVRQFKQLLASYQRNRDLVSVGAYAAGSDPLLDKAIALYPQMEAFLQQGMFERSSFDDACQHLKGLFPG

SEQ ID NO: 44039 - protein, 240 aa, Zea mays
MAHPHLVLPSPKSLLPAAATPSRRAVAIRAAISTALSPAKAAAGAEAVRSIRARQIVDSRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGIKELVMPVPAFNVINGGSHAGNNLAMQEFMILPVGATTFAEALRMGSEVYHVLKSII

SEQ ID NO: 44040 - protein, 708 aa, Burkholderia thailandensis E264
MNQQASHATGTVTRERRDKVLVVTIDHPPVNALSADVRRGLVDALDAADADAAVGAVLIVGAGRNFIAGADIREFGKPPVPPLLPDVCNRIETSGKPVVVALHGAALGGGLEIALAAHYRIAVPGAKLGLPEVQLGLLPGAGGTQRTPRLIGAKAALDLMLSGRHASAEEALTLGLVDRLAHSDDTLAEGLAYVHELLAAGAPARRTRDAQGLADRAAAEAALEAARADVAKKSRGLFSPAKIVDAVAAALALPFDEGLRTERRLFVECLDSPQRAGLVHAFFAEREAAKSPETRRGVPRAIERIGVVGGGTMGAGIAVAALDAGFPVTMIERDDASLERGRAHVEKVYAGLVAKGRMTPAAQAARLARFKGGTSYDALAQADVVIEAVFEDMAVKKSVFAELARACKPGAVLATNTSYLDIDEIAASVERTPDVIGLHFFSPANIMKLLEVVVPAKVSADVVATAFELAKKLRKIPVRAGVCDGFIGNRVLAVYRTAADYMMEDGASPYQIDRAIREFGFPMGPYQVVDLAGGDIGWATRKRRAPTRDPRLRYVEIGDRLCERGWFGQKTGRGYYLYPDGARAGAPDPEVEAIIAEARAKKGVSPRAFTDDEIVRRYLAAMINEGANVVHEKIALRPLDVDAVFLHGYGFPRYRGGPMHYADTVGLANVLADIRAFASEDPVFWKPSPLLVDLVARGETFASLNRID

SEQ ID NO: 44041 - protein, 228 aa, Burkholderia thailandensis E264
MRRPSPSCPMAFLLHQARFFTTVNHLRDLPPTVQPEIAFAGRSNAGKSTAINVLCNQKRLAFASKTPGRTQHINYFSVGPAAEPVAHLVDLPGYGYAEVPGAAKAHWEQLLSSYLQTRPQLCGMILMMDARRPLTELDRRMIEWFAPTGKPIHSLLTKCDKLTRQESINALRATQKSLDAYRDAGYAGKLTVQLFSALKRTGLDDAHALIESWLRPAAADEDHAAVAE

SEQ ID NO: 44042 - protein, 401 aa, Zygosaccharomyces rouxii
MAATDRLNQTSDILSQSMKKTDSSMSVVTAENPYKVSVVGSGNWGTTIAKVVAENTKEKPELFQERVDMWVFEEQIDGTPLAQIINTKHQNVKYLPNIDLPDNLVANPDLIATTKDADVIVFNVPHQFLGRIVAQMKGQIKPTARAVSCLKGFEVGPKGVQLLSDYVTQELGIECGALSGANLAPEVAKEHWSETTVAYHIPDDFKGDGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLVTCKEVHQWLESSGNTEDFPLFEAVYQITYENVPMKELPSMIEELDIDSTSKCVLSYKMGL

SEQ ID NO: 44043 - protein, 363 aa, Oryza sativa Indica Group
MDGKKPYVIAIIIQVIYTGLYVVSKAAFDQGMNTFVFIFYRQAAATLLLLPLAIILERNTITMNMYNVSLKYTSATVASATSNSVPVVTFFLAVLLRLEVIRLRTLSGVAKAAGVALCLAGVLVIALYAGPAISPLNHHRALSGGVHGAESSVGTGTRARWMKGTFLMLLSNTTWSLWIVLQASLLKEYPNKLLATLIQCALSTLQSLLLAAAVVRADPAAWRLRLDAGLLAVAYTGFVVTGVSFYLQAWCIEKKGPVFLAMSNPLCFVFTIFCSSFFLAEIVHLGSIVGGVLLVAGLYSVLWGKSKEHNINMQLTLAAAASTEQVKQRQDEDHKMEIAGGDEQEEIKQQQQGKMAASPEQQV

SEQ ID NO: 44044 - protein, 121 aa, Oceanobacillus iheyensis HTE831
MDKIIIKQMQFYGYHGLFPEENKLGQRFNVDLELHVPLDKAGISDDMNESIHYGQAYETVKKVVEGPSYNLIEAVAEGISKELFASFSLLNACLVRVVKPDPPIPGHYQSVAVEIYREREK

SEQ ID NO: 44045 - protein, 162 aa, Idiomarina baltica OS145
MMNIRVGHGYDVHRWGAENKPLMLGGVEVPHADGLLAHSDGDVVLHAISDAVLGALGLGDIGRHFPDTDDQFAGADSGELLTHIMQLAASRKFAVGNIDVTIVAQQPKMAPHIDAMRQRIADLLDVVSDAVNVKATTTEKLGFVGRNEGIACHAVVLMAGQS

SEQ ID NO: 44046 - protein, 847 aa, Zea mays
MKESDQLATSFITPFGMYCYITMPFGLRNAGATYQRCMNHVFGEHIGRTVEAYVDDIVVKTRKASDLLSDLETAFKCLKAKGIKLNPEKCVFGVPRGMLLGFIVSERGIEANPEKIAAITNMGPIKDLKGVQRVMGCIAALSRFISCLGERGLPLYRLLRKTERFTWIPKAEEALGNLSPSSSSSVRPGSHQLPPSGQAAISRTTADRAWLGGLGWSRWQGGLGLRADRCRAGALGLTAGRRGAAALPGAMGRRRAAQGRRAALEGGAQAGAAAWGGGAQARLLGRRGGGHKHRHRGGGLVFCAFILVQELYTGTQGKFYLVDAGYGAKRGFLPPFRGVRYHLNEWGVNPVQNEKELFNLRHSSLRITVERAFGSLKRRFKILDDVIPFFPFSTQVEIVVASCIIHNWVIEDGGDELILLESDDTLPSITHQTSTHGQAQDHAFMVFLANLVVDGIKTSTGGFKRVHLNACAKALNEHFKLNRTAEQISNHLKTVKKKYVRINQLRAESGSGWDEDLFMVTMDHEQYTTHFANDKNKGDDEYINKPLPYYGNLATIYGNSTTTGRFVKTSNDPLGVDELNTQKEMENIGTPTNGLNDKEGSPPKRDEGGPSRPSKRAKKDECGADPLVQAFQSGAETIANAIEKAAASKGLPNGLFEAVDSLPRFELEHKSRYYSHMLGDPNLANGFMNKLLYAVILTRRKLRHYFESHPMTVVSSFPLGEIIQCREASGRVAKWAVEIMGETISFAPRKAIKSQVLADFMAEWVDTQLPAAPIQPELWTMFFDGSLMKTGAGAGLLFISPIGKHLRYVLRLHFPASNNVAEYEALVNGLRIAIELGVRRLDARGDS

SEQ ID NO: 44047 - protein, 400 aa, Magnaporthe grisea 70-15
MTVLPLEPEFSQAYNELAGTLEDSTLFEKYPELRTALSVVSIPERVIQFRVVWEDDSGALRSDAEIRRFCVAFMTELSKHIGADTDVPAGDIGVGGREIGYMFGAYRKLRNRFEGVLTGKGLDWGGSLIRPEATGYGLVYYVGHMLEYAGVGGWAGKRVAISGSGNVAQYAALKIMELGGTVVSLSDSRSALVAVEGGRTITEADVKRVMELKDRRRPLSDLLPESEEGGSTSPGGLKHLPGARPWTHVGKVDVALPCATENEVSKEEAEALVAAGCRFVAEGSNMGCEQGAIDVFEANRRSKGKGDAVWYAPGKAANCGGVAVSGLEMGQNSSRLKWSREKVDKELANIMETAFRTGLDTAKEYVNRASDDELPSLVAGSNIAGFVKVARAMQAQGDWW

SEQ ID NO: 44048 - protein, 198 aa, Glycine max
  misc_feature (62)..(62): Xaa can be any naturally occurring amino acid
SYMVLKAPGMKPLNICLSKQHEVTDAVTVWEWTGSAWDEGAEASQWFSDFLGKPSTSPLQFXESLDALNELLKERIPINRFRPNILVEGCDPYSEDLWTEIKISRFSFLGVKLCSRCKVPTINQETGIAGSEPTETLMKTRSGKVIRPNAKNKNKVYFGQNLVWNWMDSSVKGSGKTIKVGDNVYILGNVSSAEEAAA

SEQ ID NO: 44049 - protein, 1145 aa, Populus euphratica
MGSAIEKGVGLPYRILESSSSSSAASDEWNPTDTVLFFGFSLLLGIACRHLLRGTRVPYTVALLVVGIALGSLEYGTSHKLGRIGDGIRLWAHIDPDLLLAVFLPALLFESSFSMEVHQIKRCMGQMLLLAVPGVLISTCCLGCALKLIFPYNWSWTTSLLLGGLLSATDPVAVVALLKELGASKKLSTIIEGESLMNDGTAIVVYQLFYRMVLGESFNSGAIIKFLTQVSLGAVGIGIAFGIASFLWLGFIFNDTVIEIALTLAVSYVTYFTAQEGAAVSGVLAVMTLGMFYAAVARTAFKGDGQQSLHHFWEMVAYIANTLIFILSGVVIAEGVLSSGNTFHRHAHTWGYLFLLYAFVLLSRFIVVGVLYPILRYFGYGLEWKEAIIVIWSGLRGAVALSLSLSVKRTSDSSVYLSSDTGTLFVFFTGGIVFLTLIVNGSTTQFILHLLDMDKLSATKKRLLNFTKYEMLNKALEAFGDLGEDEELGPVDWPTVKRYIPSLNSLEGSCEHPHGASEADNNLDPTNLKDIRIRLLNGVQAAYWGMLDEGRITQTTANILMQSVDEAIDLASHEPLCDWKGLQSNVHFPNYYKFLQASIFPQKMVTYFTVERLESACYICAAFLRAHRIARRQLHDFIGDSGIASLVINESNAEGEEARKFLEDVRVTFPQVLRVVKTRQATYSVLNHLIDYVQNLEKVGLLEEKEMLHLHDAVQTDLKRFLRNPPLVMLPKITDLISVHPLLEALPSIVREPLERSSKEIMKPRGVPLYKEGSKPNGVWLISSGVVKWTSKSVRSKHSLHPTFTHGSTLGLYELLVGKRCICDIITDSVVFCFFIESENMLSLLGSDPAIEDFLWQESAIVIAKLLLPQVFEKMPMQELRALVAERSVMTTYLRGETIEIPHHSIGFLLEGFIKAHGFQDELIASPAVLLPPQGNQSFQKIGMSGAQAASFSHQGSRYQVEARARVIIFDIAAFEADGALRRGSSSLVLGDHPHRYFTREHGGLMSWPENFYKPREREQNGVGTSRSENSLSVRAMQLSIFGSMVDMRRHAHSFSGSQVKRSHSLSVLRNASYQQVRVPSDEATYARKSLEVRKLIGKTHAPPPQSTGTNETRIIDNYSDESDAEDELVVRIDSPRTLSFHHAS

SEQ ID NO: 44050 - protein, 482 aa, Arabidopsis thaliana
  misc_feature (182)..(182): Xaa can be any naturally occurring amino acid
  misc_feature (218)..(218): Xaa can be any naturally occurring amino acid
MVKICCIGAGYVGGPTMAVIALKCPDVEVAVVDISVPRINAWNSDTLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIKDLFNPDRVLIGGRETXPEGFKAVQTLKNVYAHWVPEGQIITTNLWSAELSKXLAANAFLAQRISSVNAMSALCEATGADVTQVSYAVGTDSRIGPKFLNSSVGFGGSCFQKDILNLVYICECNGLPEVAEYWKQVIKINDYQKSRFVNRVVSSMFNSVSNKKIAVLGFAFKKDTGDTRETPAIDVCKGLLEDKARLSIYDPQVTEDQIQRDLSMNKFDWDHPLHLQPMSPTTVKQVTVTWDAYEATKDAHGICIMTEWDEFKNLDFQKIFDNMQKPAFVFDGRNIMNLQKLREIGFIVYSIGKPLDDWLKDMPAVA

SEQ ID NO: 44051 - protein, 498 aa, Novosphingobium aromaticivorans DSM 12444
MRLIDHFIVGGPGGAPARKSPIFDPNNGGVQAEVALGTAETLERAVQAALKAQPAWAATNPQRRARVMFRFKELVEANMDSLAHMLSSEHGKVIADSRGDIQRGLEVVEFACGIPHVLKGEYTHGAGPGIDVYSTRQPIGIGAGITPFNFPGMIPLWMSAIAIATGNAFIIKPSERDPSVPVRLAELFIEAGLPEGICQVVHGDKEMVDAILDHPAIGAISFVGSSDIAHYVYNRGVAAGKRVQAMGGAKNHGVVMPDADLDQVVNDLCGAAFGSAGERCMALPVVVPVGHDTAERLRAKLIPAIHALKVGISTDPEAHYGPVVTQAHKEKVEGWIDKCIEEGGELVVDGRGFTLQGHENGFFVGPTLIDHVTPDMDSYHNEIFGPVLQIVRAENFEQALELPSKHQYGNGVAIFTRNGHAAREFAARVNVGMVGINVPIPVPVAYHTFGGWKRSAFGDTNQHGMEGVKFWTKVKTVTQRWPDGSPDGGNAFVIPTMG

SEQ ID NO: 44052 - protein, 328 aa, Corynebacterium efficiens YS-314
MVNVGCMKAIQVSRTGGPEVLEYTDVDAPVPTDDQVLVKVTMAGVNYIDTYYREGMYHTRLPFIPGNEGSGEVLHDPQGLIAPGTKVAWYDGLGSYAEQVCVSRERLVAIPEGVAPEVAASMLLQGMTAHYLTHGVAQLGPGDSCLITAGAGGVGLMLTQMAVAAGARVYSVVSTDEKAELSLDAGATEVFRYSDNLAEQVRRHNGGIGVDVVYDGVGKATFSESLEAVRPRGMVCLFGAASGAVEPFDPQLLNTHGSIFLTRPTLGAWIAEEGEFAMRAQAVTQAIVDGTLRVRVTGIYELADAATAHSDLQNRATTGSIVLRVAQD

SEQ ID NO: 44053 - protein, 477 aa, Salinibacter ruber DSM 13855
MTDPVSYDLIVIGAGQGGGPLAGAVAEAGHDVALLERRHVGGTCVNRGCTPTKTMIASARVAHLARRAGDYGVETGDVSVDLETVRQRKRDIVGMFRSGSRSSIEEKDTLDLIEGDGRFVDPNTVEVTLNGDANDGGPRALTADRIVINTGTRPAIPPIDGLDAVDFLTSTSIMELGAVPGHLLILGGGYIGLEFGQMFRRFGAEVTIIDRGEHVLGREDADVAGALEDILREDGIRLLNETSMTAVEEAGGTITAHLEGDDAPARITGDELLVAAGRRPNTDALNPGAAGVATTEQGYVQVDARLATTADGIYAIGDVTGGPAFTHVSYDDYRVLQDHWLHGGDRTTEDRLIAYTLFTDPQLGRVGLTEEQARSRGLDVTVAQMPMTRVARALEVDETRGLMKAVIDSTTNRLLGAAVLGIEGGEVMSVLQTAMMGDLPVGRLRAAPFAHPTLAESLNNLFAGLDLGPAAERRADG

SEQ ID NO: 44054 - protein, 360 aa, Bacteroides fragilis YCH46
MTSKDNYCVIMGGGIGSRFWPFSRKTMPKQFLDFFGTGRSLLQQTFDRFNKIIPTENILIVTNAIYADLVKEQLPELDPKQILLEPARRNTAPCIAWASYHIRALNPNANIVVAPSDHLILKEGEFLAAIEKGLDFVSKSDKLLTLGIKPNRPETGYGYIQIAEQEGDNFYKVKTFTEKPELELAKVFVESGEFYWNSGLFMWNVNTIIKAGETLLPELASKLAPGREIYGTPEEKDFIEENFPACPNVSIDFGIMEKADNVYVSLGDFGWSDLGTWGSLYDLSPKDEQRNVTLKCDSLIYNSNDNIVVLPKGKLAVIEGLEGFLVAESDNVLLICKKDEEHAIRKYVNDAQMKLGEDYI

SEQ ID NO: 44055 - protein, 249 aa, Schizosaccharomyces pombe 972h-
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLAEREANETINVVVRQLNAIADKVQNWSKIVIAYEPVWAIGTGKTATPEQAQEVHAEIRKWATNKLGASVAEGLRVIYGGSVNGGNCKEFLKFHDIDGFLVGGASLKPEFHNIVNVHSL

SEQ ID NO: 44056 - protein, 100 aa, Arabidopsis thaliana
  misc_feature (81)..(81): Xaa can be any naturally occurring amino acid
  misc_feature (89)..(89): Xaa can be any naturally occurring amino acid
MAWAMLSSGTMVASPAQATMDAPFNGLKSYAAFPATRNANNDITYITSNCGRVNCMQVWPPIGKKNVETLSYLSDLTDFQXAKEVDYLXIRNKWISLVKY

SEQ ID NO: 44057 - protein, 590 aa, Xylella fastidiosa Dixon
MPHSAHRSTPTLHTQMNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDHLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLLLQKITNGDMLIIDGNSGEIIVNPSPQDLRHYHSRLRERAKEQRELEQLRSKHSRTRDNVDIVVQANAESPDDVSQAYTLGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGTLKTSATTLLRARDRKSIEEWMAAHANTTPT

SEQ ID NO: 44058 - protein, 349 aa, Zea mays
MDSHAAVSSSVGSGDGAAQPRRNSRKPKYSKFTQQELPACKPILTPKWVISVFVLVGVIFVPIGIVSLRASHQVVEIVDRYDDVCVPANVTEKLAYIQNDSIPKTCTRNLTITKDMKQPIFVYYQLDNFYQNHRRYVKSRNDAQLRDKSKASETTNCDPEAKTVDGKPIVPCGLIAWSLFNDTYTLIHNNKTLRVDKKDISWKSDRDHKFGSDVFPTNFQKGPLQGGKILNPKIPLSEQEDLIVWMRTAALPTFRKLYGRIYVDLKENDTITVQLENNYNTYSFSGKKKLVLSTATWIGGKNDFLGLAYLTVGGICFVLAFAFTLLYLIKPRKMGDNNYLSWNRPTLGR

SEQ ID NO: 44059 - protein, 291 aa, Zea mays
MALAVVRKNATAALLLLLLLSSTVSEARHKIWHGPIIYASPPPPPPSHHRDLYLPYIAEQKTLAAPSPEDATGGTSTAGSSNKFRHAILRNLLLRLSNKDGAASPSWSSAMSLRERRDAVRHAADAALAAARGAAPRWSRALAAELSSQSQSQQHGRWHWHDDDAPHLLVAGADARPSGHQTCLPCGTAAAVAAAGCRKTVPRRRRLRVRARPKSGATTAWSAGAVARVVARRRARAGALRRMVPGGRGMADECTLLGETLDYAVSLRAQVDAMQLLLRTLQPPGHANNNP

SEQ ID NO: 44060 - protein, 707 aa, Aspergillus nidulans FGSC A4
MIPMLAATLAEAFILQRSVFTDTPLRTVVFGSAAVNLLILAIYNVWIWPFFLDPLRHLPRAPGRFNMLRFIFDNPRGRLPLLWMKTVPNDGLIYFRDLLNRTQLLATNHQALLDVMSTNTYDFEKPWRAREFLARIIGFGLILSEGAAHKRQRRALTPFFTIKNVRALYTLMWDKTNQLLVEMDKQISRCPMEGTSPDSGWGKVEMSVWARYFTLSRLTLDVIGPAAMGRDFRSLQNAENKVADSFLAILEPTKEKIAFLAINFLLPQWFAKKLPWRLNQVIEEQVGYLRDLCKEIVHEKRAAITATKVTASELEADILGSMMLSGDFTDDELVDQMLTFLAAGHETTASALTWTCYLLTLHPEVQDRLRAEIRTAIPHSTHPVTHSDLESLPLLNGVCQEVLRLYPTVPSTIREAVRDTTVAGKHVPKGTKIMLCPYAINRAPEFWGADGDAFRPERWIDTDPVTGKTSVNNHGGAATNYAQITFLHGQRSCIGKDFARAELRCAVAGVVGRRLTTYMQMEDTYTGCWGMSNAHSGHHEECQKLHRIGTGIDINDSGIILYLKNHGALHIPALVSAEAAMKKGKRMKKTIIMKTALASLITAYVPAECTRPESMNERDPTRNLRREAGSGPKNIPPRTENGWVHPRICSQPRRNDVQTAYGEQCDSGPDAIDKSVAGYPARGRQQKSADKLFACLWGDVVLEAKVI

SEQ ID NO: 44061 - protein, 149 aa, Vitis vinifera
MGKAKKAQKFAVMKKMVTSKALKKHKEEVLNPTKKDENKEKTSRNVPYVPSALFFKYNTALGPPYRVLVDTNFINFSIQNKLDLEKGMMDCLYAKCTPCITDCVMAELEKLGQKYRVALRIAKDPRFERLLCTHKGTYADDCIVDRVTQ

SEQ ID NO: 44062 - protein, 225 aa, Triticum aestivum
SKYKDGRPTTVEEVVGLIIGLLFAGKHTSSHTSTWTAACLLSHPTFLRAAIEEQQQISSKYKDMGLDYNAFIEMDTLHSCIKEALRKHPPTPMLVRRAHKQFMVKTKEGKEYDIPQDHIVATPTIVTNNISYIYKDPQVYDPCRFGPERREDKVGGKFSYTSFSGGRHICTGEAYAYMQLKVIWSHLLRNFELELISPFPKTDWGKFLPEPQGKLLVKYKRNGIL

SEQ ID NO: 44063 - protein, 560 aa, Zea mays
  misc_feature (98)..(98): Xaa can be any naturally occurring amino acid
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGXAKLVDQALASGKIYDGDGFNYIKESFESGTLHLIGLLSDGGVHSRLDQLQILLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPNANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 44064 - protein, 226 aa, Oceanobacillus iheyensis HTE831
MGIFKMMKEDMDVVFEQDPAARTYVEVMLTYSGLHAVWSHRVAHWFYNKRLLFIARVISQISRFITGIEIHPGAKIGQRLFIDHGMGVVIGETCEIGNNVTIFQGVTLGGTGKEKGKRHPTLKDNALIATGAKVLGAITIGENSKVGGGSVVLKDVPDNSTVVGVPGQVVVQDGKRVGRDLDHHKLPDPVFDKCAQLQTQIDELKAEMASMKEEKRRVLENDHTNI

SEQ ID NO: 44065 - protein, 399 aa, Idiomarina baltica OS145
MGRAAAPSGASTGSREALELRDGDKNRYLGKGVEQAVANINGAIAEALRGAEAVNQNAIDEIMLRLDGTDNKEKLGANAILAVSLAVAKAAAAYKNMPLYQHIAELNNTPETYSMPLPMMNILNGGEHADNNVDIQEFMIQPVGASSFKEGLRMGAEIFHALKKVLQQRGLSTAVGDEGGFAPNLGSNEEALQVIVEAVEKAGYRMGDDVTLALDCAASEFYKDGQYNLSGEGKSFDAEGFASYLAELCDRYPIISIEDGLDESDWDGWKVLTEKLGDRVQLVGDDLFVTNTRILQEGIDKGIANSILIKFNQIGSLTETLAAIEMARKAGYTAVISHRSGETEDATIADLAVGTAAGQIKTGSLCRSDRVAKYNQLLRIEGELDGKAPYRGRQEVKAG

SEQ ID NO: 44066 - protein, 523 aa, Oryza sativa
MGACFSSHTATAAADGGSGKRQQRKGDHKGKLPDGGGGEKEKEAARVEFGYQRDFEGRYQVGRLLGHGQFGYTFAATDRASGDRVAVKRIDKAKMVRPVAVEDVKREVKILKELKGHENIVHFYNAFEDDSYVYIVMELCEGGELLDRILAKKNSRYSEKDAAVVVRQMLKVAAECHLHGLVHRDMKPENFLFKSTKEDSPLKATDFGLSDFIKPGKKFHDIVGSAYYVAPEVLKRRSGPESDVWSIGVITYILLCGRRPFWNKTEDGIFREVLRNKPDFRKKPWPGISSGAKDFVKKLLVKNPRARLTAAQALSHPWVREGGEASEIPVDISVLSNMRQFVKYSRFKQFALRALASTLKEEELADLKDQFDAIDVDKSGSISIEEMRHALAKDLPWRLKGPRVLEIIQAIDSNTDGLVDFEEFVAATLHIHQMAELDSERGGLRCQAAFSKFDLDGDGYITPDELRMHTGLKGSIEPLLEEADIDKDGRISLSEFRKLLRTASMSNLPVQEDLQIHNPCERR

SEQ ID NO: 44067 - protein, 519 aa, Shewanella sp. ANA-3
MFDLFRHKTSSHKADILSGLTVALALIPEAVAFAFVANVEPMVGLYAAFIMGLVTALIGGRPGMISGATGAMAVVMVSLVVEHGVQYLFAAVVLAGLIQISAGIFKLGKFIRIVPYPVMIGFVNGLAIVIFLAQLGQFKVKNAAGELVWLPQEPLMLMLGLVALTMAIIYFLPKLTTAVPSSLVAILSVTAIVVGFDLETRNVLDFLKTMSGDEHATIAGSLPSFAIPQVPFNLETLYIILPYSFILAAVGLIESLLTLTVIDEMTNTRGRSNKECIGQGVGNITSGFFGAMGGCAMIGQSMININSGGRGRLSGITAAIGLLTFILFGASFIEIIPLAALVGVMFIVVLGTFEWASFKFMGKIPKHDAFVIVLVTTVTVFTDLAFAVFVGVVVSALVFAWQHAKHISVKVTSNSLGWKVYELNGPLFFGSVASFLELFDASQDPQDVVIDFKHSRVADHSALEAIDTLAERYVALGKKLHLVHLSADCKALLHKAGDLVEVNLLDDPHYKVADDKLDS

SEQ ID NO: 44068 - protein, 85 aa, Oryza sativa
LIPAPRGTGLVASPAVKRFLQLGGVEDAYTSSAGSTKTLENTLKATFVAVSNTYGFLTPNLWKETKLIKSPLDEYADTLREGKRY

SEQ ID NO: 44069 - protein, 514 aa, Corynebacterium efficiens YS-314
MSSHTNPTTWINPLRDPQDKRLPRIAGPSGLVIFGVTGDLARKKLLPAIYDLANRGLLPPGFALVGYGRRDWSKEDFENYVREAVEAGARTEFRGNVWERLAEGMEFVKGNFDDDSAFDNLADTLKRLDETRGTAGNWAFYLSIPPDSFAAVCHQLERSGMAASTDESWRRVIIEKPFGNDLKTAHELNETVNAVFPEESVFRIDHYLGKETVQNILALRFANQLFEPLWNSNYVDHVQITMAEDIGLGGRAGYYDGIGAARDVIQNHLIQLLALVAMEEPISFTPTQLQAEKIKVLRATKPSLPIAENSARGQYSAGWQGSEYVKGLREEDGFDPESTTETYAACTLEITSRRWAGVPFYLRTGKRLGRRVTEIAVVFKDAPHQPFDPGMTAALGNNAIVIRVQPDEGVLIRFGSKVPGSAMEVRDVNMDFSYSESFTEESPEAYERLILDALLDESSLFPTNEEVELSWKILDPILEIWEENGQPEEYPAGTWGPKSADEMLARNGHQWRRP

SEQ ID NO: 44070 - protein, 506 aa, Oryza sativa
MEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRSSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 44071 - protein, 397 aa, Rhodococcus sp. RHA1
MSIVSEPTTPQKVELTDEEIFAGHIGGKLSVETTTALDTQRALSIAYTPGVAQVSRAIAADETLADRYTWTSRLVVVVSDGSAVLGLGDIGPRASLPVMEGKSALFKNFAGLNSIPLVLDTKDPDEIVETLIRLRPSFGAVNLEDISAPRCFEIEKRVIEALDCPVMHDDQHGTAIVVLAALKGAVKVQDRDIHQLRVVISGAGAAGVACANILLAAGIADVTVLDSKGIVSKDRQDLNEVKVDLAARTNPAGRRGGIVEALDGADVFLGVSAGTVPEELIATMAEGSIVFALSNPDPEIHPDVARKHAAIVATGRSDFPNQINNVLAFPGVFRGALDAGARRITEGMKLAAAEAILSVVGDELAVDKIVPSPLDPRVAPAVAEAVAAAARAEGVTG

SEQ ID NO: 44072 - protein, 459 aa, Oryza sativa
MEFFTEYGEASQYQIQEVVGKGSYGVVAAAVDTHTGERVAIKKINDVFEHVSDAIRILREIKVLRLLRHPDIVVIKHIMLPPTRREFRDIYVVFELMESDLHQVIEANHDLSPEHHRFFLYQLLCALKYIHSANVFHRDLKPKNILANSDCKLKICDFGLARVAFNDSPSTIFWTDYVATRWYRAPELCGSFFSKYTPAIDIWSIGCIFAEILTGRPLFPGRNVVHQLDLITDLLGTPSSETLSRIRNENARGYLTGMQRKHPIPFSHKFHNADPLALRLLERLLAFDPKDRPTAEEALADPYFRGISKLSREPSRLPVSKFEFEFERRKLTKDDVREMIYREILEYHPQMLQEYIRGGEQISFLYPSGVDRFKRQFAHLEENYSRGERSTPLRRQHASLPRERVCSSVDSNNQDSDNEERRAISSIARTMISPPRSQEKGKNLCICLSKWHNQSKLQS

SEQ ID NO: 44073 - protein, 269 aa, Vibrio fischeri ES114
MRELTTPASESYDQRFGGTRRLYGNSEVEIMRAAHVCVVGIGGVGSWAVEALVRTGLGEITLIDMDDVCVTNINRQIHAMTGTIGQSKIEVMAERIKLINPECKINLIDDFITPENLSEYISKEFDYVLDAIDSMKPKAALLAYCKSNKIKVITTGGAGGQTDPTQIQITDLTKTIQDPLAKKLRDTLRRHHNFTKNPKRKFGIDCVYSTEHLKYPQADGSVCATKATAEGPKRMDCASGFGAATVVTATFGFVAVSRIVEKLIEKHSK

SEQ ID NO: 44074 - protein, 457 aa, Bacteroides thetaiotaomicron VPI-5482
MKQYDAIIIGFGKAGKTLAAELSNRGWQVAVVEQSDEMYGGACPNVACIPTKTLIHESEISTLLYHNDFDKQSNMYRQAIARKNKLTSFLRENNYEKLSKRPNVTIYTGKGSLVSANTVKVALPEEEIELQGKEIFINTGSTPIIPSIEGIQQSRNVYTSTTLLELDILPKHLIIVGGGYIGLEFASMYAGFGSKVTLLEAGNRFMPRNDSDIAKSVREVMEKKGVEIRLNVRTQSIHDTHDGVTLTYSDTSDGTPYFVDGDAILIATGRKPMIEGLNLQAAGVEVDAHGAIVVNDQLHTNAPHIWAMGDVKGGAQFTYVSLDDFRIIRDQLFGDKKRDINDRDPLPYAVFIDPPLAHIGITEEEALRKGYSFKVSRLPATSVVRSRTLQQTDGMLKAIINSHSGKIMGCTMFCTDAPELINMVAMAMKTGQTSTFLRDFIFTHPSMSEGLNQLFDV

SEQ ID NO: 44075 - protein, 706 aa, Pseudomonas fluorescens Pf-5
MSRDTAQPSVASALHGNILVLTLDNPPVNALGVEVRRGLLAAMDSAADDPTVAAILLVGAGRHFCGGADIREFGQTPQAPALPAVVKRIEDSAKPVVAAIQGVALGGGLEVALAAHYRLALGSARLGLPEVLLGLLPGAGGTQRLPRLIGARAALELMLSGRHLNAREALDLGVVDRLAEGEDALAAGLAYARELVDSHAGVRRTRDARALGDQHLQREQINAAREQLTHKAKGLLSPQNIIRAVEAALDRPFDQGLEEERRLFQECLDSPQRAGLVHAFFAEREVLKAPETRIAQPRPIEQVAVVGGGTMGAGIAVSALDAGLQVTMIERDQQALDRGRGNVEKVYDGLIEKGRLDAAGKAATLARFRASLDYQDLARADLVIEAVFEDMAAKQAVFKELDRVCKPGAVLASNTSYLDLNAIADSVSRPADVIGLHFFSPANIMKLLEIVVPAKVAPDVVATAFELAKKLRKVPVRAGVCDGFIGNRILAVYRQAADYMMEDGASPYQIDQALRDFGFPMGPFQVADLAGGDIGWATRKRKAATRNPDARYVQIADRLCERGWFGHKTGRGYYLYAQGPRNATQDPEVLAIIDAERARAGITPRPFGNPEILRRYMAAMINEGANVVHEGIALRPLDVDITFIHGYGFPRYRGGPLKYADQYGLPQVLADIREFAEQDPLFWKASLLLEQLVERGENFDSLNHSH

SEQ ID NO: 44076 - protein, 410 aa, Vibrio fischeri ES114
MKKILMTAFNVELVRSQFPALLQEVNEQPIAYFDSAATTQKPLAVLNAIQDYYQKSNANVHRGSHSLTASATLQFEQARETVQHFINAKSSKEIIWTRGATEAINLIAQTYARNTLQVNDEILVSELEHHANIVPWQIVAEQTGAKVIKIPMKSNCTLDMDAFESLVTQNTKIVAVAQVTNVTGTLNPIEEIIKIAHNVGAIVVVDGAQGIVHHTIDVQAMNADFYVCSGHKLFAPAGIGALYGKQHLLESMPVWHGGGKMVEKVSFEKTTFAELPGKFEAGTPNVAGAIAFATAINWVKQFAHDDLNAHINELRQIAIDGIKDIEDLRFIGLQDNASLFSFVIDGVHHQDIATLLDQQGIAVRSGNHCAHPMLDALGLTGTVRVSFALYNTKQDVQRFIDALNKAADML

SEQ ID NO: 44077 - protein, 311 aa, Oryza sativa Japonica Group
MAATVASTSSASAPSSRGVPAGDWFCPSCASPSPHSKKSHAAKKPKQFPLVQTKIVDFFKIQRGPAAALAAAAESSEGKKRKRKVGGIRLVSKKKRKLLPFNPSDDPARRLRQMASLATALTATGAVFSNELTYVPGMAPRAANRAALESGGMQVLPKEDVETLNLCKRMMARGEWPPLLVVYDPVEGFTVEADRFIKDLTIITEYVGDVDYLTRREHDDGDSMMTLLSAATPSRSLVICPDKRSNIARFINGINNHTPDGRKKQNLKCVRFDVGGECRVLLVANRDISKGERLYYDYNGSEHEYPTHHFV

SEQ ID NO: 44078 - protein, 128 aa, Vibrio fischeri ES114
MNSRLCLLIASISGALTVGLGAFGAHGLKAFLSPYLLDVYETAVQYQMWHTLALFGCGILLRNSFSKGVSYAALLFTIGMLFFSGSLYALVFTGIKWFGPITPLGGFCFIIGWLTLAVSTYRLTEVSK

SEQ ID NO: 44079 - protein, 684 aa, Arabidopsis thaliana
MGGGRAMATAAKVAGIGVGKGGFKGFGFPPATEQFRVKTAAAAASSKPVSASITSAVHPSVEEDGMIMQRPVWDDWEFAEEEPIPRVVFSKPPSLEEAKEATEDLKEAINLVYMSSPKSSAAMEGSNDGGSVSKMLSGFQSSENRAVESAVPQVALQAFAFLSENTAAQTVVASIASDPKVWDAVMENKDLMKFLQTNKTAVSSQVESDNDDQSERSSTTECEVVETKPMELLEILQDMKLKAVRLMENVSSYFGDLFGLGSVTEDGKDKKQTLFNDPRSLFGLAVVVIFMMLVIKRSTLQICFLFPSRSQMPMAKHIVGLTSLFMSLLLSRLSRLRLGKPASVRSSVLILSNGFSSSSLQTPPCSIICANPCGAGLGKLVILNANESDYTDLEKKVPMELVDSDPMVTIGASHGWVATLKEDGILRLQDDLNPYASDTNPKRISLPPLVTLPRCQTQIVTNVSMSLPSPEDEDCVVAVKFLGPQLSFCRPAKSNSEWTNIKIANPSFFSSRVMFSKKDEMFRIPGSGGHLIGSWDLRTEDHNPKIQRLRFRNLPELPRAKRELLDSCYRSEHLVESQSTGELFLVKRYKKATTRDTVKMKTQGVMVFKLDEKGNAVYTQDIGDLCIFLSKSEPFCSSSSRFPNYVDIYDVDEVAFACLEYDDPITGVTSTNRAPYHIPPQNID

SEQ ID NO: 44080 - protein, 324 aa, Oryza sativa Japonica Group
MTMPFAVSDPSASVEEMVAAAAADDECVCVWLEEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVKLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 44081 - protein, 330 aa, Yersinia pseudotuberculosis IP 32953
MTLQHKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 44082 - protein, 494 aa, Oryza sativa Japonica Group
MAWMVGLHESLTKLMPFYVSASTFGAVLDMTWLSFLDVAWVGYYKPLVSNVQFVPISTLTLLTELLLNVSPSNKEVSKIQVLYIVLFLFADEKSTSLLNVCGNLLKQSPLTVFVFISTLVGWALKQVINVIQMKSAADACVVFDLKRGNNGHHSVYLSCEDANLLGDERHIENLTGSASHQKKDALFFFFSSPIPTRRRSRAEARDGGGAGERSAGGAGAEQRPHDAVADYQNEAEVGDALAEAFQTGLVKREDLFITTKLWNSDHGHVVEACKDSLKKLRLDYLDLYLIHFPVATRHTGVGTTASALGDDGVLDIDTTISLETTWHAMEDLVSMGLVRSIGISNYDIFLTRDCLAYAKIKPAVNQIETHPYFQRDCLVKFCQKHGILVTAHTPLGGSTANTEWFGSVSCLDDPVIKVSLAEKYGKTPAQLVLRWGLQRNTVVIPKTSKEERLQENFAVFDFAISDEDMEKMRSIDRKYRTNQPAKFWGIDLFA

SEQ ID NO: 44083 - protein, 478 aa, Mesorhizobium sp. BNC1
MATYKAPLMLIGGEWTKGSGEPKEVINPATEEVIAMLPSATEADLDRALQSAQRGFREWQELSAEQRCDIIMRGCRILRERAAEIAPLITIEQGKPVEEARLEIIRAASIIEWDANEGRRAYGTIVPSDPGFNRYGIKLAIGPVAAFTPWNFPISSPGRKLGGALGAGCSVIIKSSEETPAATCALVQCLLDGGLPPEVINIVSGKSSMISAYLIASPVIRAITFTGSTPVGKHLAKLAAEAMKPVVMELGGHSPVIVFDDVDADKIARQAVAAKFRNAGQICTAPTRFIIQEKAHDAFVESFVKAASAIKVGNGLEADTQMGPLANSRRLRALEELVADARAKGATVATGGKRIGNRGYLFEPTVLTDVPDDADVVNVEPFGPIAPVVRFREFEEAIEIANRLPYGLCSYAFTNSQAYSHELAHRVESGIMSLNHFGTSQADTPFGGVKESGYGREGGYETLDAFMITKFVSQQITA

SEQ ID NO: 44084 - protein, 336 aa, Aspergillus nidulans FGSC A4
MPSQDVPLPEPFASVPRETLTFGPSPIQYLPNITAALGGKVNIYAKREDVNSGLAFGGNKTRKLEYLASDALAQKADTLVSIGGFQSNHTRQVAAVARKLGLEVALVQEKWVDWDDKNGVYDKAGNIQLSRLMGADTRLDMSGFGIEHKLTLKNLEEEIRARGGKPYYIPAGASDHPLGGLGFARWAFEVEMQEKELGVFFDTVIVCAVTGSTMAGMIAGFKLAQKVNGSRKRKIIGIDASATVEQTFEQILRIAKFTGVKIGLDEEDITAEDVILDDRYHAGVYGIPDEATIEAIKFGARTEAFITDPVYEGKSLNGMMDMGLLSCCRIVFRVKS

SEQ ID NO: 44085 - protein, 378 aa, Prosthecochloris aestuarii DSM 271
MRITGLAKKMKAEGKDIVSLSAGEPDFPTPLFVSQAGIEAIDSGFTRYTANSGIAELKSAVIAKLKRDNQLDYTPDEVIVSNGGKQTLINAILALCQEGDEVIIPAPYWVSFPEMVRLAGASPVTVPTSIENGYKMTPEDLENAITDKTKLFILNSPSNPSGAVYNEQEVTALMQVLEGRGIFVISDEMYDKIVYGDVKPYSPARIEAMRDWVLVSNGVSKTYAMTGWRIGYLAGPKWIIKACDKIQSQTTSNPNSIAQKAAAAALNGDQQVVEDRRLEFEKRRDYMYKALNEIPGITASLPEGAFYIFPSVKGVLGKTFNGRYLANSSDVAEYLLLDHYVATVPGDAFGAPENLRLSYAASISELEEAVRRIRKAFE

SEQ ID NO: 44086 - protein, 270 aa, Mycobacterium tuberculosis CDC1551
MHLDSLVAPLVEQASAILDAATALFLVGHRADSAVRKKGNDFATEVDLAIERQVVAALVAATGIEVHGEEFGGPAVDSRWVWVLDPIDGTINYAAGSPLAAILLGLLHDGVPVAGLTWMPFTDQRYTAVAGGPLIKNGVPQPPLADAELANVLVGVGTFSADSRGQFPGRYRLAVLEKLSRVSSRLRMHGSTGIDLVFVADGILGGAISFGGHVWDHAAGVALVRAAGGVVTDLAGQPWTPASRSALAGPPRVHAQILEILGSIGEPEDY

SEQ ID NO: 44087 - protein, 424 aa, Idiomarina baltica OS145
MISNQLKIAVVGLGYVGLPLAVEFGKKYDTLGFDINSKRVAELQGGTDHTKEVEPEELKKAEQLKYSADVVDLDEANVYIVTVPTPINKFKQPDLTPLIKASETIGQTLKKGDTVIYESTVYPGATEEDCVPVLERVSGLTFNQDFFVGYSPERINPGDKEHRVTTILKVTSGSNPETAEFVDALYRSVITAGTHKAENIKVAEAAKVIENTQRDVNIALINELAMIFSRMGIDTEAVLKAAGTKWNFLPFRPGLVGGHCIGVDPYYLTHKAESIGYHPEMILAGRRINDNMSRYVASEFVKALLQKGITVKGANVLLMGLTFKENCPDIRNTKVVDIIDELKQYGVNVDVYDPWVNKQEALHEYGVEVIEQPNQASYEGVIVAVAHNEFKTLGIDGIRALAMPTHVIYDLKYIIDANSVDIRL

SEQ ID NO: 44088 - protein, 345 aa, Idiomarina baltica OS145
MSRYEEVKTQLKSEPKIWLVTGVAGFIGSNLLETLLKLNQKVVGLDNFSTGFQHNLDEVQSLVTEEQWANFEFVEGDICDLETCRSVMTTDKGQKINYVLHQAALGSVPRSINDPITSNKSNIDGFLNMLVAAKDAEVDSFTYAASSSTYGDHPALPKVEENIGNPLSPYAVTKYVNELYASVFAKVYGFKTIGLRYFNVFGPRQNPDGAYAAVIPKWTAAMIKNEEVSINGDGETSRDFSYVENAIQLNVLAATSDDSVKDEIYNMALGDRTTLNQLFRSIKLSLEKYGIAYSREPLFENFRRGDVKHSQAEIQKSKQMLSYEPQVRVDRGIEKTSLWYIAKSN

SEQ ID NO: 44089 - protein, 168 aa, Idiomarina baltica OS145
MKIVVRIIRKIYFWIFYPIQSPQLKLRWKLRLLSKAQRLSSKRLAWIVCNRIQATTGCHLSPQLKIPSTVAFPHPTGIVIGGGVCLGERVKIFQNVTLGGARIGDAKESKYPEIGEGTVIFAGAVIVGKIKVGSNCIVGANSVVTRDLPNNCVAVGAPARIIEGGAEK

SEQ ID NO: 44090 - protein, 137 aa, Brassica napus
  misc_feature (96)..(96): Xaa can be any naturally occurring amino acid
  misc_feature (118)..(118): Xaa can be any naturally occurring amino acid
  misc_feature (125)..(125): Xaa can be any naturally occurring amino acid
RPTRPRRTDVLSAWSGIRPLAMDPTAKSTESISRDHVVFEENPGLVTITGGKWTTYRSMAEDAVDAAIKSGKLSPTNECVTQKLQILGSHGWEPSXFTALAQQYVRMKKHMVGRCSWXHDTAAAXHLSHAYGSMADR

SEQ ID NO: 44091 - protein, 237 aa, Zea mays
MATAGGGAGHLKLLGAWPSPFVNRVRMALHLKGLEYENVEEDLTNKSDLLLASNPVHKLVPVLLHGDKPISESLVIVEYLDDAFPGAGQAVLPADPYERAVARFWAKYVDGKLHGMMVKALMGATEEERATATVDALAAMDTLEGAFAECSGGKKFFAGDAPGYLDVALGGFIGWLRAWDKVGGVKLLDAGRVPRLATWAERFAALDVAKEVIPDPDHIAEFAKVLQARSAAAATSN

SEQ ID NO: 44092 - protein, 418 aa, Novosphingobium aromaticivorans DSM 12444
MSDPIPGAKEHIDAARKLAATIDDIPADTALLPINRVGVIGAGTMGGGITMNFLTAGIPVTIVEMTQEALDRGVATMARNYENTVKRGKMDAADAQAAMARLTPTLDFGALAEADLVIEAVYESMDVKKDVFGRLDKVAKPGAILASNTSYLDIDEIASVTSRPEAVMGMHFFSPANVMKLLEVVRGKATGKAQLATVMALSVKIGKVPVVSGVCHGFIGNRMLSPRQAQAQALIMEGANYWDVDEALLEFGFPMGPWQMADLAGVDIGWHRDPSRIETLRDALCAVGRWGQKTKKGFYDYDDNRQRTPSDEVKAIIADFAKKAGKPQREIGKDEIRERLLYPMISEGALILEEGISQRASDIDTVWLNGYGWPAWTGGPMFWADHIGLDTVVAGLKKHGLPVAPLLERKAAAGETFN

SEQ ID NO: 44093 - protein, 262 aa, Corynebacterium efficiens YS-314
MSPMARKPLIAGNWKMNLDHQQAIGTVQKLAFALHKDYYEKVDVAVIVPFTDLRSVQTLVEGDKLQITYGAQDVSQHESGAYTGEVSASMLAKLNCSWVVVGHSERREYHNETDELVAAKAKAALSKGISPIVCVGEPLEIREAGTHVDYVVEQTRASLAGLSADELANTVIAYEPVWAIGTGKVASAADAQEVCKAIRGLVTELAGEEVAEGMRILYGGSVKAETIAEIVSQPDVDGGLVGGASLDGEAFAKLAANAANAV

SEQ ID NO: 44094 - protein, 405 aa, Corynebacterium efficiens YS-314
MAVKTLKDLLDEGVDGRHVIVRSDFNVPLNDDREITDKGRIIASLPTLKALTEAGAKVIVMSHLGRPKGEVNEKYSLAPVAEALSDELGQYVALAADVVGEDAHERANGLTEGDILLLENVRFDPRETSKDEAERGAFADELAALAADNGAFVSDGFGVVHRAQTSVYDIAKRLPHYAGRLVENEISVLEKIAENPEAPYTVVLGGSKVSDKLGVIEALASKADSIIIGGGMCYTFLKAQGHDVQKSMLQDEMIDTCKDLLERFGDKIVLPVDLTWASEFAKDAEKKVTDLDSAPEGWLSLDIGPKSVEKFADVLGASKTIFWNGPMGVFEFEAFSDGTRGVAQAIIDATANNGAFSVVGGGDSAASVRVLGLDEEGFSHISTGGGASLEFLEGKELPGVAILKD

SEQ ID NO: 44095 - protein, 361 aa, Solanum tuberosum
MKALILVGGFGTRLRPLTLSVPKPLVEFANKPMILHQIEALKAVGVTEVVLAINYQPEVMLNFLKEFEASLGIKITCSQETEPLGTAGPLALARDKLIDDSGEPFFVLNSDVISEYPFKEMIQFHKSHGGEASLMVTKVDEPSKYGVVVMEESTGQVERFVEKPKLFVGNKINAGFYLLNPSVLDRIQLRPTSIEKEVFPKIAAEKKLYAMVLPGFWMDIGQPRDYITGLRLYLDSLKKHSSPKLASGPHIVGNVIVDESAKIGEGCLIGPDVAIGSGCVIESGVRLSRCTVMRGVRIKKHACISGSIIGWHSTVGQWARVENMTILGEDVHVCDEIYSNGGVVLPHKEIKSSILKPEIVM

SEQ ID NO: 44096 - protein, 334 aa, Corynebacterium efficiens YS-314
MTIRVGINGFGRIGRNFYRAVLERSDDLEIVAVNDLTDNKTLSTLLKFDSILGRLSEEVEYDDESITVGGNRIAVYAERDPKNLDWAAHNVDIVIESTGFFTDAQAAKAHIDAGAKKVIISAPASNEDATFVYGVNHQDYDPENHHVISGASCTTNCLAPIAKVLNDKFGIENGLMTTIHAYTGDQRLHDAPHKDLRRARAAAVNIVPTSTGAAKAVALVLPELKGKLDGYALRVPVITGSATDLTFTTNSDVTVESINAAIKEAATGELAETLAYTEEPIVSTDIVTDSHGSIFDAGLTKVSGNTVKVVSWYDNEWGYTCQLLRLTELVASKI

SEQ ID NO: 44097 - protein, 275 aa, Shewanella oneidensis MR-1
MLNTTMFNYQGKNVVVVGGTSGINLAIAIAFAHAGANVAVASRSQDKVDAAVLQLKQAHPEGIHLGVSFDVRDLVAVEQGFEAIASEFGFIDVLVSGAAGNFPATAAKLTANGFKAVMDIDLLGSFQVLKTAYPLLRRPQGNIIQISAPQASIAMPMQAHVCAAKAGVDMLTRTLAIEWGCEGIRINSIIPGPITGTEGFNRLAPSVVLQQQVAQSVPLKRNGEGQDIANAALFLGSELASYITGVVLPVDGGWSLGGASIAMTALGELAAKGSN

SEQ ID NO: 44098 - protein, 576 aa, uncultured sulfate-reducing bacterium
MGLLKKKDKKKKGMSTRFSGGGGGNQLSALRPRYVEMMPPCVGHCPSGNKIRGWLTVIALREKLGLTLDQACEKAWRIEMETTPFPAVMGRVCPHPCETECNREAKDGAVGINSVERFIGDYGLEHGLKAERIEGEGDKDEKIAVIGAGPSGMSCAYQLARRGYPVTVYESLPKVGGMLRYGIPVYRLPRDIIDGEVQTILDLGVELHLDTKIGKDVTFAELRENFKAIYVAIGAHQGKKLGIGGEDGPGIWTGTEFLNHANSGKKVEIGGNVVVIGGGDTAIDAARVSKRVTIDSATVSKRMGADVTILYRRTRKEMPAIEREIDEALEEGVNIEYLAAPIEILRNDDGTVRAMIVQRMELGEPDASGRRRPVPIEGDTYELPVETVITAVSQKPDLGALGSEELGDGWLNADDQGRTETKGIWTGGDNINLGIATTSIGQGRKAAENIHAWLQGLEVKEPPTPEMIMSDKLKIDWYETKPRGVRRLAEPEERLAKPFDEVDLGLTAEAALEETTRCMSCGRCFGCENCWMYCQNTCFVKEQKPKPGAFYSIILEKCDGCKKCWEECPCGFIVGV

SEQ ID NO: 44099 - protein, 383 aa, Novosphingobium aromaticivorans DSM 12444
MLSDRHVKGRPHEMKTRAAVAFAPKQPLEIVELDLEGPKAGEVLVEIMATGVCHTDAYTLDGFDSEGIFPSVLGHEGAGIVREVGPGVTSVKPGDHVIPLYTPECRQCKSCLSGKTNLCTAIRATQGQGLMPDGTSRFSYKGQTVFHYMGCSTFSNFTVLPEIAVAKIREDAPFKTSCYIGCGVTTGVGAVINTAKVQVGDNVVVFGLGGIGLNVIQGARLAGAGKIIGVDINPDREEWGRKFGMTDFLNSKGMSREDVVAKVVAMTDGGADYTFDATGNTEVMRTALEACHRGWGTSIIIGVAEAGKEISTRPFQLVTGRNWRGTAFGGAKGRTDVPKIVDMYMTGKIEIDPMITHVMGLEEINTAFDLMHAGKSIRSVVVF

SEQ ID NO: 44100 - protein, 412 aa, Schizosaccharomyces pombe 972h-
MIERLKIAKNRLEAMNSFNFPAQDRHERAPLLGSEYDHSMARQLSLLNVVGMTKSVLMSSYFNLMLVFVPIGLIAGWFEWNAKSVFILNMLAIIPLASLLSFATEQLSIISGPTLGALLNASFGNAIELIVGVLALKRGELRIVQSSLLGSILSNLLLVFGMCLVTTGIRREITTFNITVAQTMIAMLALSTATILIPATFHYSLPDNANSENALLHVSRGTAVIVLIVYVLLLVFQLKTHKHVCHDPSEVEEETEPRILGLRSSIAMLAIVTVFVSLCADYLVGSIDQLVEEVNISKTFVGLVILPVVGNAAEHVTAIVVSYRGQMDLALGVAIGSSIQIALFLAPFLVIVGWIISQPLTLYFESLETVILFVSVFLVNYLIQDGATHWLEGVQLLALYAIVVLAFFYYPQ

SEQ ID NO: 44101 - protein, 159 aa, Corynebacterium efficiens YS-314
MAKEGLPEITLPDATGLRVAVVTARWNAEICDRLHDHAVTAGRAAGAEVSEYRVVGALELPVVVQELARTHDAVVALGCVIRGGTPHFDYVCDSVTEGLTRIALDTSTPIGNGVLTTNTEEQAIERSGAEGSVEDKGAEAMVAALDTALVLSRIRADRG

SEQ ID NO: 44102 - protein, 460 aa, Rhodococcus sp. RHA1
MSKHHHHHRDVISPAYTGRLSIDPFPALRLPDEETDPEAAYRFIHDELMLDGSSRLNLATFVTTWMDPEADKLMAETFDKNMIDKDEYPATAAIESRCVSMVADLFHAPDLSTTDPASATGVSTIGSSEAVMLGGLALKWLWRAKREAAGKDTARPNLVLGSNVQVVWEKFCRYFDVEPKYLPMEKGRYVITPEQVRDAVDENTIGAVVIVGTTYTGELEPVAAIADALDELAASGGPDVPIHVDAASGGFVVPFLQPELLWDFRVPRVASINVSGHKYGLTYPGIGFVVWRDKEHLPEGLVFRVNYLGGDMPTFTLNFSRPGNQVVGQYYNFLRLGRAGYRSIMQTLRDTAVRVGKRIAEIEGFTLITDGTDIPVVAFELVGDPGFTVFDVSHELRARGWQVPAYTMPADAEDVAVLRIVVREGFSADLGSLVAEAIEEVCAELREKGGGRSTEQHFAH

SEQ ID NO: 44103 - protein, 237 aa, Aspergillus oryzae
MVVKHIQRKLDEKSEKHRAELDQLRKIASQLQLSPNVMVMPSTSQFVGMNTILQDPKTEQVDFVFYFDRLASLLIEKALDCTSYVPAGVETPQKTTYQGLNPEGIISAVAILRGGSCLETALKRTIPDCITGRVLIQTNAQNEVPELHYLKLPENIQKHTTVMLLDPQMSTGGAALMAVRVLIDHGVEEHKIVFVTCAAGKIGLKRLSTVYPKVRVIVGRIEEEQEPRWMERRYFGC

SEQ ID NO: 44104 - protein, 166 aa, Aspergillus oryzae
MESISPVFSSGTEQRYSPPWEDLSIIGIAGSSGSGKTSVAMEIVKSLNLPWVVILVMVTIYFCRLTLEFSTISTHNNEFDFDCPDAYDFDALVQTLKDLKQGKKADIPVYSFADHQRQPQTTTLYSPHVIILEGILALHDPRVLELLDVKIFVEADMDICLGRRSE

SEQ ID NO: 44105 - protein, 221 aa, Brassica napus
  misc_feature (206)..(206): Xaa can be any naturally occurring amino acid
MVLLPAFLDGLARSVSMKKGKYIPEDEDGGGEIAKLLMKDAKKNSTLLGSSGFVKSETSKRFTSICSNRGEKGINQDRAIVWEEFGCQEDITFCGMFDGHGPWGHVITKRVKKLFPSSLLCQWQQTLASLSLSPECFSPFDIWKQSCLKTFSLIDLDLKIHPSIDSYCSGCTALTAVLQGDHLVVANAGDSRAVIATTSDDGSGLXPVQLSVDFKPNIPEE

SEQ ID NO: 44106 - protein, 111 aa, Zea mays
NIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQ

SEQ ID NO: 44107 - protein, 336 aa, Burkholderia xenovorans LB400
MTIRVAINGYGRIGRNTLRAFYENGKKHDIEIVAINDLGDARTNAHLTQYDTAHGKFPGEVSVDGDYLVVNGDKIRVLANRNPAELPWGELNVDVVMECTGFFTTKEKASAHIKGGAKKVIISAPGGKDVDATIVYGVNHHVLKASDTVISNASCTTNCLAPLVKPLNDKIGLVNGLMTTIHAYTNDQVLTDVYHEDLRRARSATHSQIPTKTGAASAVGLVLPELNGKLDGYAIRVPTINVSIVDLSFIAARDTTVEEVNAIMKEASEGSLKGILGYNQAPLVSIDFNHNPASSTFDATLTKVSGRLVKVSSWYDNEWGFSNRMLDTAVALAHAK

SEQ ID NO: 44108 - protein, 427 aa, Saccharomyces cerevisiae
MYSRKSLSLISKCGQLSRLNAQAALQARRHLSIHEYRSAQLLREYGIGTPEGFPAFTPEEAFEAAKKLNTNKLVIKAQALTGGRGKGHFDTGYKSGVHMIESPQQAEDVAKEMLNHNLITKQTGIAGKPVSAVYIVKRVDTKHEAYLSILMDRQTKKPMIIASSQGGMNIEEVAERTPDAIKKFSIETSKGLSPQMAKDVAKSLGFSPDAQDEAAKAVSNLYKIFMERDATQVEINPLSEIEHDPTHKIMCTDAKFGFDDNASFRQEKIYSWRDLSQEDPDEVKAKKYDLNFVKLKGNIGCLVNGAGLAMATMDVIKLNGGDPANFLDCGGGATPETIKQGFELILSNKNVDAIFVNIFGGIVRCDYVALGLVEAARELEVRVPIVARLQGTKVEEGRDIINKSGVKIYSFDELDPAAKKVVELTQN

SEQ ID NO: 44109 - protein, 474 aa, Yersinia pseudotuberculosis IP 32953
MGKMVDQSKIVAEPLQEPEEHLQRSLSNRHIQLIAIGGAIGTGLFMGSGKTISLAGPSIIFVYMIIGFMLFFVMRAMGELLLSNLNYKSFSDFSADLLGPWAGFFTGWTYWFCWVITGIADVVAITAYAQFWFPDFSQWVASLLVVLLLLSLNLATVKMFGEMEFWFAMIKIVAIVALIFAGLTMVLVSYQSPSGTTASFTHLWSDGGMFPKGISGFFAGFQIAVFAFVGIELVGTTAAETKDPEVVLPRAINSIPIRIIMFYVFSLIMIMSVTPWSSVVADKSPFVELFVLVGLPAAASVINFVVLTSAASSANSGVFSTSRMLFGLAKEGDAPKQFGKLSRRSVPATGLTFSCICLLGGVVLIYLIPNVMTVFTLVTTVSAILFMFVWTIILCSYLVYRKRRPALHKKSIYKMPAGIFMSWVCMAFFAFVLVLLTLESDTRQALIVTPLWFVILTASYIFLKKRRARLYNSK

SEQ ID NO: 44110 - protein, 718 aa, Prosthecochloris aestuarii DSM 271
MVSANARSAEQFWLVRNSSNSNAKVHMDNQQIILYAVPLSGVLALLYALFKASWVSKQDAGTEQMVVIAGHIADGAVAFLKREYKILAIFVLSVAVLLGFVNSGRPDSSPLISLSFIIGAICSGLAGYFGMKVATKANVRTTNAARTGLSSALNVAFSGGLVMGLSVVGLGVLGLSSLFIIYSNQFSDIGQVINVISGFSLGASSIALFARVGGGIYTKAADVGADLAGKVYEGIPEDDPRNPATIADNVGDNVGDVAGMGADLFESYVGAIIGTMVLGAAFLPVFNEMGINPIAGVILPLLLAAVGIVVSIFGSFFVKVKEGGNPQTGLNTGEFGATFIMAVLSYFIISYTLPASWIVGDTTYTALNVFFAVLTGLATGVLIGLITEYYCSTHNKPVVNIAYQSVTGAATNIIAGLGTGMMSTGLPIIVLSAAIILSFNFAGLYGIAIAAFGMLSVTGIQLAVDAYGPISDNAGGIAEMAGLPKEVRERTDKLDAVGNTTAAIGKGFAIGSAALTALALFAAFRQQAGITSIDISEPVIMAGLLLGAMLPFVFSALAMDAVGRAARDMITEVGRQFNEIPGLREGTAPAEFAHCVDISTKAALREMILPGLLGILVPVVVGFTSKDMLGGLLAGVTSSGVLMAIFQSNAGGAWDNAKKRIEGGIEFDGVLYGKGTEAHKAAVVGDTVGDPFKDTSGPSLNILMKLIAVVALVIAPLI

SEQ ID NO: 44111 - protein, 1483 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLVERRRLFCEISMKLYPRTSSGLFSLQSLLKSGFSPTLNSIDRFLRYLYRLQKFNCILQFYSQLDSKQININHRIYSIVSWAFLNLNRYEDAEKFINIHISKASIFPRTHMLDSLIHGFSITRDDPSKGLLILRDCLRNHGAFPSSLTFCSLIYRFVEKGEMDNAIEVLEMMTNKNVNYPFDNFVCSAVISGFCKIGKPELALGFFESAVDSGVLVPNLVTYTTLVSALCQLGKVDEVRDLVRRLEDEGFEFDCVFYSNWIHGYFKGGALVDALMQDREMVEKGMNRDVVSYSILIDGLSKEGNVEEALGLLGKMIKEGVEPNLITYTAIIRGLCKMGKLEEAFVLFNRILSVGIEVDEFLYVTLIDGICRKGNLNRAFSMLGDMEQRGIQPSILTYNTVINGLCMAGRVSEADEVSKGVVGDVITYSTLLDSYIKVQNIDAVLEIRRRFLEAKIPMDLVMCNILLKAFLLMGAYGEADALYRAMPEMDLTPDTATYATMIKGYCKTGQIEEALEMFNELRKSSVSAAVCYNRIIDALCKKGMLDTATEVLIELWEKGLYLDIHTSRTLLHSIHANGGDKGILGLVYGLEQLNSDVCLGMLNDAILLLCKRGSFEAAIEVYMIMRRKGLTVTFPSTILKTLVDNLRSLDAYLLVVNAGETTLSSMDVIDYTIIINGLCKEGFLVKALNLCSFAKSRGVTLNTITYNSLINGLCQQGCLVEALRLFDSLENIGLVPSEVTYGILIDNLCKEGLFLDAEKLLDSMVSKGLVPNIIIYNSIVDGYCKLGQTEDAMRVVSRKMMGRVTPDAFTVSSMIKGYCKKGDMEEALSVFTEFKDKNISADFFGFLFLIKGFCTKGRMEEARGLLREMLVSESVVKLINRVDAELAESESIRGFLVELCEQGRVPQAIKILDEISSTIYPSGKNLGSYQRLQFLNDVNEEEIKKKDYVHDFHSLHSTVSSLCTSGKLEQANEFVMSVLSCMPR

SEQ ID NO: 44112 - protein, 284 aa, Brassica napus
  misc_feature (198)..(198): Xaa can be any naturally occurring amino acid
MSTSLSTSLCCSSTQQVNGFALGPQRSLLYQPSSFSFSRRRSHGVVKATARVDKFSKSDIIVSPSILSANFAKLGEQVKAVECAGCDWIHVDVMDGRFVPNITIGPLVVDALRPVTDLPLDVHLMIVEPDLRVPDFIKAGADIVSVHCEQSSTIHLHRTVNQIKSLGAKAGVVLNPGTPLSAIEYVLEEVDLVLIMSXVDPGFGGQSFIESQVKKISDLRRMCVEKGVNPWIEVDGGVTPKNAYKVIEAGANALVAGSAVFGAKDYEEAIKGIKNSKRPEAVAV

SEQ ID NO: 44113 - protein, 128 aa, Oryza sativa Indica Group
MAASTAAAVVNAPAATGGLLLPRGRSSWSWSCCNNNNSSMGRRWRAAAVGEVAAEGNTYLIAGAVAVALVGTAFPILFSRKDTCPECDGAGFVRKGGATLRANAARKDLPQIVCPNCNGLGKLGQIDK

SEQ ID NO: 44114 - protein, 350 aa, Idiomarina baltica OS145
MKVLVTGTAGFIGHFTALRLIDMGHEVVGLDSINDYYDINLKYGRLREAGFDVAEIKRQRLIRSKKHPKYQFCQAKLEEGDYLKSLFESENFDAVCNLAAQAGVRHSLEKPQAYVESNIVGFVNILEACRDSGVKNLSYASSSSVYGLNESMPFCTSDSVNHPVSLYAASKKSNELLAHTYAHLFGISCTGLRFFTVYGPWGRPDMAPYIFTKAAFNEETIKVFNHGKMKRDFTYIDDIVDGVVRVIENPCKADKSWDPQSPTASTSSAPYKIYNIGNNEPVELLDFINAVESAVGKKIRKEYTPMQPGDVVATYADVSDMITCLGYKPSTSVKDGMVKTVEWYRSFYNV

SEQ ID NO: 44115 - protein, 388 aa, Idiomarina baltica OS145
MRIAVVGIGYVGLANAALLAQHNDVIAFDLIKSKVDKINSRESPIADRELSEILAQGKLKLTATTDAMKAYKSADYVIVATPTNYDPKSNFFDTSSVESVLSDVLEINPSAIVVIKSTVPVGFTKLLRTRFPDLNIFFSPEFLREGSALHDNLYPSRIIVGGKGEQASKFAELLVQGASKKDVNVLLTDSTEAEAIKLFANTYLAMRVAYFNELDTFSQTHGLDARQIIDGVCLDPRIGDHYNNPSFGYGGYCLPKDTKQLLANYNDVPQTLISAIVEANRTRKDFISECIIRRAPKVVGVYRLVMKQGSDNFRASAVQGVMKRVKAKGIEVIIYEPSLSEVKFFNSRVIRDLNAFKAEADLIISNRLCDNLEDVAHKVFTRDLFGND

SEQ ID NO: 44116 - protein, 401 aa, Idiomarina baltica OS145
MSRSICILGLGYIGLPTAALLANQGYKVLGIDVSEDVVNTVNNGEIHIVEPELDAYVAKAVQNKMLTAALEPQEADVFVIAVPTPFHEGHVPNIDYVESATRAIAPVVKSGDMIILESTSPVGTTERVEAVLKESGVNTADLHIAHCPERVLPGHIMRELTENDRIVGGITAEAGEKVAAFYRTFVTGDVLVTDARTAEMAKLTENSFRDVNIAFANELSILCDKFKIDVWELIRLANRHPRVNILQPGTGVGGHCIAVDPWFIVHAGGEDARIIRAAREINDYKTEWVTQRVVEEVEKFKATHDRLPTVACMGLAFKPNIDDLRESPALEVFQALIAAGVEPMAVEPNLKSHKSITLTDYNQAATEADLVVYLVAHNEFKNLSVTGEVLDFCGVTVANNK

SEQ ID NO: 44117 - protein, 698 aa, Salinibacter ruber DSM 13855
MPGCARPATKRSHFSGRPARWRAFRICFTRRFFRVRSPSSRVRRRDRCTRRNGLEKSVFCLFMRLRLFVTNKCRSRPPLDALLPIGSRSESFFSRPGPRDAVRRTASRGRRRVLDWGPRRLVWEQHHTHFVVRKVSCCMSDSGTLGTESPVESASFQEQAAHYQALVETMKDRAAEVRMGGGAEKIEREHERGKLTARERIEYLVDDPAAFGELGLFAGYEMYEDEGGCPAGGTVMGLGPVSGQECMIVANDATVKAGAWFPITAKKNLRAQKIALENHVPIIYLVDSAGVYLPMQDEIFPDEDDFGRIFRNNAKLSSKGIPQIAAIMGSCVAGGAYLPIMSDEAIIVEDTGSVFLAGPYLVKAAIGEDVEKEELGGATTHSEISGVVDYKVEDDEAALDKIRSIVDHSGPVERFGYARKEPAEPAYPADELYGLFPAEGNGQYDMREILARIVDAESWTEYKEGYGRTLLTGYARIDGWNVGVVANQRAVVRNRTDLDSKGEIQVGGVVYADAADKAARFIMNCNQKEIPIVFFQDVTGFMVGKRAEQGGIIKDGAKMVNAVSNSTVPKLTVVVGNSYGAGNYAMCGRAYDPRLVLAWPTAKIAVMGGQQASKVLKQIKVRQLEKQGKELSEEDEQALLSKIQDRYEEQTTPYYAAARLWVDALIDPHNTREWLARGLDMVDHNPTLERFNPGVMQT

SEQ ID NO: 44118 - protein, 434 aa, Corynebacterium efficiens YS-314
MMTVTENAVTENAAQNIQLDTVEEAIAEIAAGRAVVVVDDENRENEGDIIFAAELATPELVAFMVRYSSGYICTPMTSEDADRLDLPPMTAHNQDARGTAYTVTVDANTGSTGISATDRAHTIRLLADPNSDRTDFTRPGHVVPLRAREGGVLVRAGHTEAAVDLARAAGLRPAGVICEVVSEEDPTGMARLPELRRFCDTHGLKLISIEQLIAWRRQNEILVERVVETKLPTEIGEFTAVGYRSKVDGTELMAIVEGDPSSDGGENVLVRVHSECLTGDVFGSRRCDCGQQLNESLRMIHEAGRGVVVYMRGHEGRGIGLLAKLRAYQLQDEGADTVDANLSLGLPADAREFGTGAQILYDLGVRSINLMSNNPTKRMGLEGHGISIAGRTPIPVQVHEDNIRYLRTKRDRMGHILPAIDEWDAAHGNTDKTT

SEQ ID NO: 44119 - protein, 118 aa, Synechococcus sp. RS9916
MSETNTRVLRPWGWYEDLLEGPEYKLKRLWLKPGQRLSLQRHQHRSENWTVAEGEGTLLCDDTWSEASAGTTLHIPCGAIHRAKAGDQGLLLIEVQHGAFLREEDIERLEDDFGRVLH

SEQ ID NO: 44120 - protein, 221 aa, Corynebacterium efficiens YS-314
MAQQRKPIIAPSILAADYARLGEEIAAVPDADWIHVDIMDGHFVPNLSFGYDVTRAVHRVTDKPLDVHLMIENPEKWVDHYIDAGAACVIFHVEATDKHVELAQHIRSKGVRAGFSLRPGTPIEDYLDDLEHFDEVIVMSVEPGFGGQSFMPDQLDKVRTLRRVIDERGLDIIIEIDGGISATTIEQAAEAGVDAYVAGSAVFGADEPNAAVQELRALASK

SEQ ID NO: 44121 - protein, 396 aa, Shewanella oneidensis MR-1
MFNSLIAMPADPILGLLTQYREDTHPQKVDLGVGVYKDPAGNTPILNCVKKAEKFRLETETTKVYIGPTGSPQFNTLMTELAFGSDHSAIIANRIRTVSTPGGTGALRVAGDFIKRCNPNAVLWVSDPTWANHTGLFEAAGITVKTYPYYDYDSKSLKFDEMLAALSQVSPDDVVLLHACCHNPSGMDLTTDQWDKVVTLTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSKELTQEWLDELKVMRDRINGNRAILVEKLKANGVARDFSFIARQKGMFSFLGVNPEQVARLQKEFSIYMVGSSRISIAGISEDNVDYLAQSIAKVL

SEQ ID NO: 44122 - protein, 345 aa, Rhodococcus sp. RHA1
MTERTAEPHSTEGAYVESGAEFTRDTHYIPTRITADGRDGYPVEPGRYRLVAARACPWANRAIIVRRLLGLEDALSMGLCGPTHDKRSWTFDLDPDGLDPVLKIPRLQDAYFARFPDYPRGITVPAIVDVPTGQVVTNDYPQITLDLSSEWKRYHREGAPDLYPEPLRDEIDEVADLVFRDVNNGVYRCGFAGSQEAYESAYDRLFARLDWLEDRLTDHRFLVGDTITEADVRLFTTLARFDAVYHGHFKCNRNKLDEMPVLWSYARDLFQTPGFGDTIDFTQIKQHYYIVHTDINPTRIVPKGPDLSGWLEPHGREQLGGRPFGDGTPPPPPKPGEEVPAGHGA

SEQ ID NO: 44123 - protein, 225 aa, Salinibacter ruber DSM 13855
MSDGLRPLAAEAPTTLYLVRHGETEYNRRGIMQGGGIDSTLNATGREQARALARRFASADIDALYASTLRRATQTADILATGHDPLSRTHLRALNEMDWGVYEGEAPSPERDASVDALKSAWREGAYERGPKGGESIREVQGRARQALRHILAREAGGTALVVTHGRYLRVLLATLLDAYGLEHMSELDHSNTCVNQVVYERGQARAERLNCTAHLSGDCASAPA

SEQ ID NO: 44124 - protein, 157 aa, Bacteroides thetaiotaomicron VPI-5482
MKTTLLVVGRTVEQHYITAINDYIQRTKRFITFDMEVIPELKNTKSLSMDQQKEKEGELILKALQPGDVIVLLDEHGKEMRSLEFADYMKRKMNTVNKRLVFVIGGPYGFSEKVYQVANEKISMSKMTFSHQMIRLIFVEQIYRAMTILNGGPYHHE

SEQ ID NO: 44125 - protein, 822 aa, Schizosaccharomyces pombe 972h-
MARGKRSTQRDADLELESLQSEIESESPQPVTKSKAKKNKKKLNKASAFNSDNDSNYDLKPEDDEVDEEVVPVKKKPSKKSKKAKANAFEAFADEQSVEEEEEEDSEKPVRKNKKSSKKASPKNAFDALADDMDDLSLDEEESESSEKSKKKKKKSKSKDDGSEALDDGDIESSEKDKKKKKKSKENDDAPKKDRKTRKKEEKARKLASMLESENKDNDANAAPLNKTDAFKDGLPSGRLIFAYASGQKVAPDGSNPADGITVTGNLLSPPNSRDLQVEKLSVSAWGKLLIKDSELNLINGRRYGLIAPNGSGKSTLLHAIACGLIPTPSSLDFYLLDREYIPNELTCVEAVLDINEQERKHLEAMMEDLLDDPDKNAVELDTIQTRLTDLETENSDHRVYKILRGLQFTDEMIAKRTNELSGGWRMRIALARILFIKPTLMMLDEPTNHLDLEAVAWLEEYLTHEMEGHTLLITCHTQDTLNEVCTDIIHLYHQKLDYYSGNYDTFLKVRAERDVQLAKKARQQEKDMAKLQNKLNMTGSEQQKKAKAKVKAMNKKLEKDKQSGKVLDEEIIQEKQLVIRFEDCGGGIPSPAIKFQDVSFNYPGGPTIFSKLNFGLDLKSRVALVGPNGAGKTTLIKLILEKVQPSTGSVVRHHGLRLALFNQHMGDQLDMRLSAVEWLRTKFGNKPEGEMRRIVGRYGLTGKSQVIPMGQLSDGQRRRVLFAFLGMTQPHILLLDEPTNALDIDTIDALADALNNFDGGVVFITHDFRLIDQVAEEIWIVQNGTVKEFDGEIRDYKMMLKQQIAKEREEERRIELEKQKK

SEQ ID NO: 44126 - protein, 838 aa, Saccharopolyspora erythraea
MPRPTATSRRLEKLVKFGFLAHPVNTGQRNYVRAAALLSSMADERTGRAPSGAARHTVPMPMFGTVVSATGHRCEGDLRYLPHTAEDLLRRATDAVDHVVAQVEDLRRAGAQLVGLGGATSIVGNRGLTTQRRVDVPLTSGNSLTTYSAHELLRTVIARLGRRPSDVEVGIVGFPGAIGLAMARLLLDDGCRLHLVHRKGRMRPEQLLDELPAAAHDRVTIGDDVAECLRRTRLIVAASSAGGLIDCDDLRPGSVVVDVALPRDVRRPVRERRDVLVLDGGLVSASDAVVLDGMELATSEQINGCLAETVVLALEERAESFSLGRELDPGRVREIGELARRHGFLPSAPSSWGRLVRLDRIDELPGWSAERPDPAESTRRRFRDNVNPPLAGFYAVHGMDRVFTRGSGSTLTTADGVEYLDFIGGYGSLNVGHNHPAVTAAVGQFLTAGEPTFVQYASIPHRTAELAERLCEIAPGGMRRAFFGNSGAEAVEAALKLARAATGRTRFVHAENSYHGKTFGALSVTGRDHYRDPFRPMVPDCVGVPFGDENALREAIAGAAAFIVEPVQGEGGVVLPPPGYLTAAQRICREAGAVFIVDEIQTGLGRTGAMFACEHEGVEPDVLCLAKSLSGGLVPIAATLSTAEVWDAAYGSSSGSLLHTSTFGGGNLASVAALATLDLIESEKLAARAEVMGRRLRDALTEACAPFEFVGEVRGIGLMNAIAFDARYDGAVRTAVEDMASRLPGDFRAIAELLPDPVREVLRQAGSSVETALGDLLCLRFVAAMGRDHRILTFVTANRNQVVRLQPPLVVTEAEIDRFAESARAVCETATGIHNNWE

SEQ ID NO: 44127 - protein, 301 aa, Triticum aestivum
  misc_feature (111)..(111): Xaa can be any naturally occurring amino acid
  misc_feature (124)..(124): Xaa can be any naturally occurring amino acid
MVEIPVVDLRLAGAQPEESARLRDACERLGCFRVSGHGVPGALQAEMKAAVRALFDLPDEAKRRNADIIAGSGYVAPSPANPLYEAFGLLDAADPADVEAFCARLDRRPRXRRTVKSYAEAMHXSLIVDVPRQRWAAKPGGWRATRSRNWPCQFRINRYNYTQDTVGSSGVQIHTDSGFLTVLQEDDCVGGLEVLDPATGEFVRVDPVPGSFLVNIGDVGTAWSNGRLHTVKHRVQCVAAVPRISIAMFLLAPKDDRVCAPEAFVDAQHPRRFKAFNYDDYRKLRLSTGERAGEALARMAA

SEQ ID NO: 44128 - protein, 493 aa, Picrophilus torridus DSM 9790
MKIYIDGEWRDSSSGETIKKYNPSTGEVLDTFPAATRNDVDAAIDSAEDAFKRWSDMTSMERSKILYKALELISKDKDQLTDLLIKENGKVKREAMDETEGVIDQLQYYTEFERKLTGDIVEGTSNKRKIFQYKVPYGIVIAITPWNFPAAMVIRKLAPALLTGNTVILKPSSDTPLTAEWLVKKFVDAGIPKGVLNLITGKGSEIGDYIVEHKKVSLITMTGSTSTGQRIMEKASKNMAKLILELGGKAPFMVWKDANIERALKSLVWAKYLNVGQSCIAAERLYIHEDIYDEFMKKFIEVSKRIKLGDPESSDMGPLINKSAVETTEKYVDIARSSGYKILLGGKKPELSGKYKNGYFYEPTIIENVPQDSPLFQEEIFGPVIGAESVSSVDELYEKANDSKYGLASYLFTEDPELIFEASEKIRFGELYVNMPGPEASQGYHTGFRLTGQAGEGSKYGISEYLKLKNVYVDYSRGNLSISTVNDDLFKNL

SEQ ID NO: 44129 - protein, 532 aa, Oryza sativa Japonica Group
MVLYADPPPPIKPPEIKIKELANKSTYESSMMEQKTRLHAIERHRSCEVSQAILSEVENRHQHQTLEPIKSPISGCSPSVESTTDTNTVHRHTVADAAWEALKKSIVHFRGQPIGTVAAIDKSQGALNYDQVFMRDFVPSALAFLMKGEPTIVKNFLLETARLQLREKMVDLFKLGQGVMPASFKVHHCNSKHKTESLLADFGETAIGRVAPVDSGLWWIILLHAYTIWTRDNSLAESPECQRAMRLILKLCLSEGFDTSPALLCADGCSMIDRRMGIYGYPIDIQALFFMALRCAVTLLKEDHNDDFVYQISRRIKALSYHLHSYYWLDFQRLNEIYRYKTEEYSETALNKFNVIPESIPDWIFDFMPSRGGYFIGNAEAILDLVEERWEELIGEMPMKVCYPAMENQEWQIVTGCDPKNTRWSYHNGGSWPVLLWLLVAVSVKLGRPHIARRAVEVMEKRLVKDEFPEYYDGKAGRYVGKQARKFQTWSVAGYLVAKMLLDDPSNLRAVSLADDCHIRSAPVLKRSNSFP

SEQ ID NO: 44130 - protein, 779 aa, Burkholderia xenovorans LB400
MPSNVYSNLPFEARLMSTPVNSKLREAALDYHEFPTPGKIAIAPTKQMINQRDLALAYSPGVAFACEEIVENPLNAARFTARSNLVGVVTNGTAVLGLGNIGPLASKPVMEGKAVLFKKFAGIDVFDIELNESDPHKLVDVIAALEPTFGGINLEDIKAPDCFIVERECRKRMKIPVFHDDQHGTAIVVAAAITNGLKVVGKDIREVKLVSSGAGAAALACLDLLVDIGLPLENITVTDLAGVVYKGRVELMDPDKERFARETDARTLAEAIGGADVFLGLSAGGVLKQDMVKQMADKPLILALANPTPEILPELALEVRPDAVLCTGRTDYPNQVNNVLVFPFLFRGALDAGATTVTREMEIAAVNAIAELARQEQSDIVATAYGIQDLSFGPEYLIPKPFDPRLIVKVAPAVAQAAMDSGVAERPIEDMDAYEQHLQQFVYHSGTTMKPIFQLARSVEPEKKRIVFAEGEEERVLRAMQIIVDEKLAKPILIGRPAVIEQRIARYGLRLVAGQDYTVVNTDHDERYRDFWQEYHRMMSRKGISAQMAKLEMRRRTTLIGAMLVEKGEADGMICGTVSTTHRHLHFIDQVIGRKAGAKVYAAMNALVLPNRQIFLVDTHVNVDPTPEQLAEITIMAAEEVRRFGIEPKVALLSHSNFGTSNAPTAQKMRDTLAILRERAPDLQVDGEMHGDIALDANLRREVMPDSTLEGDANLLVLPNIDAANISYNLLKTAAGNNIAIGPILLGAARPVHVLTASATVRRIVNMTALLVADVIAAR

SEQ ID NO: 44131 - protein, 439 aa, Saccharomyces cerevisiae
MVTKHQIEEDHLDGATTDPEVKRVKLENNVEEIQPEQAETNKQEGTDKENKGKFEKETERIGGSEVVTDVEKGIVKFEFDGVEYTFKERPSVVEENEGKIEFRVVNNDNTKENMMVLTGLKNIFQKQLPKMPKEYIARLVYDRSHLSMAVIRKPLTVVGGITYRPFDKREFAEIVFCAISSTEQVRGYGAHLMNHLKDYVRNTSNIKYFLTYADNYAIGYFKKQGFTKEITLDKSIWMGYIKDYEGGTLMQCSMLPRIRYLDAGKILLLQEAALRRKIRTISKSHIVRPGLEQFKDLNNIKPIDPMTIPGLKEAGWTPEMDALAQRPKRGPHDAAIQNILTELQNHAAAWPFLQPVNKEEVPDYYDFIKEPMDLSTMEIKLESNKYQKMEDFIYDARLVFNNCRMYNGENTSYYKYANRLEKFFNNKVKEIPEYSHLID

SEQ ID NO: 44132 - protein, 871 aa, Arabidopsis thaliana
MVVNPTCVVVTRTLTLVYPSTFTSRHKALNQMTSSSNSGLRRFLFTPPQRLSQGICYWGAELSNNVSWTYKTKMVVRSKAGAVPLMKHGDRFLSSLSSPALAGDPSAINRHIKKFVAASPKSVALNVLSHLLSDQTSHPHLSFFALSLYSEITEASWFDWNPKLIAELIALLNKQERFDESETLLSTAVSRLKSNERDFTLFLCNLVESNSKQGSIQGFSEASFRLREIIQRSSSVYVKTQAYKSMVSGLCNMDQPHDAERVIEEMRMEKIKPGLFEYKSVLYGYGRLGLFDDMNRVVHRMGTEGHKIDTVCSNMVLSSYGAHDALPQMGSWLQKLKGFNVPFSIRTYNSVLNSCPTIISMLKDLDSCPVSLSELRTFLNEDEALLVHELTQSSVLDEAIEWNAVEGKLDLHGMHLSSSYLILLQWMDETRLRFSEEKCVIPAEIVVVSGSGKHSNVRGESPVKALVKKIMVRTGSPMRIDRKNVGSFIAKGKTFRSVCSSWRSAAGPKRLLWAHNLPFFPSDDKPFLSNVILRVAHQSILLIKPNEPQCEADLFGWIVKVWDNIYVSRKMTLLKPLSSSRNYFPQHLPRIFDMSKFTVRELCREVKLYHPDYYCVPGHTALELELGKTVVKYLNDDKFVLLTILEYGKLAVFRSWDREWTVINDYIPSRCQDLIMFDGRFFAIDYNGRTVVVDYSSFKLTLAANPLIGGGDKKFLIESCGEMFLVDIEFCLNEKPEFTGGFYSYFNETTVSYKFKFFKLVEREKRWVEVEDLGDKMFFLGDDSTFSASTADIIPRCVGTGSFVFFYTHEESLVVMDDRNLGVFDFRSGKTELVNKLPEYAKLFWPPPPWITTSHESVENYTGETSSQSQS

SEQ ID NO: 44133 - protein, 388 aa, Shewanella sp. ANA-3
MKIAIAGTGYVGLSNSVLLAQNHKVTAVDVVDYKVELINNRKSPIVDAEIEYFLANYELDLTATLDRQLAYQDADFVIIATPTDYDPKTNYFNTSSVESVIQDVLMINPNAVMVIKSTVPVGFTAKVKQKYNCDNILFSPEFLREGKALYDNLHPSRIIVGERSERAEVFANLLVQGAIKQDIQVLFTDSIEAEAVKLFSNTYLAMRVAYFNELDTYAEAHGLNTRQIIEGVCLDPRIGNHYNNPSFGYGGYCLPKDTKQLRANYADVPNSIIGAIVESNTTRKDFIADSILSRNPKVVGIYRLIMKAGSDNFRASSIQGIMKRIKAKGIEVVIYEPVLNESEFFHSRVITDLAEFKAKADVIVSNRMANELADVADKLYTRDLFGSD

SEQ ID NO: 44134 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 44135 - protein, 555 aa, Picrophilus torridus DSM 9790
MSRTKLIATIGPASESMEIIKKMANLGLSCIRINTAHIENGYITKVAKMVDDVNKSEGTYIGLMVDLKGPELRTGKFKDGSFKIDYNKKYKISYNKNDNPDILINYNISDFIDDKTLIAMSDGKLRFSVDSVNGDIINVTSLDSGSLRDNSRVNVPGKLLRLGSLTDRDRMFIEEGIKNNVNFYALSFVQSRENINELQDYLFERNCDAQLISKIETKSGYDNIDEIARASDFIMVARGDLGVEMPLKEVTIAQKKIIDESRKYATPTIVATQMLESMVNNDSPTRAEVSDITNAIIDGTDALMLSEETAIGRYPVEAIGYLSSISDYVDSMEIKYKEPESFAFDKVAFAISKGLKMISDYTNVDSIVAFTRSGFTARLVSSMRPGKMIYSVVSSDFLARSLNLLKSVVPVKIDESMKSKEIYDILVDINRSNKIRPGKKVLVVSGSPYFVFGGTNEIRLVTMGKFIGRGYPVGNSFSGYYEPDGSGDIIILDKYIKNFDYKKYKCVIIKGNVSDTIKNLFYENKILLLYNTEFDAELNEKTFLNIDGDTGIITA

SEQ ID NO: 44136 - protein, 533 aa, Aspergillus nidulans FGSC A4
MANVTLPSGSMSYPELLQVAKQDSSLSWPEQLWWAHYTFWNNDVLATGVMTFLAHELIYFGRCIPWIVADALPSVFRRFKIQDHKTPSFSDQWTCVKYILAIHFIVELPLIVLFHPMMEVCHVQYTLPFPKLSLFAAQVALFFIVEDTYHYWLHRAMHWGPLYRSIHRIHHQYAAPFGLTAEYASPAETFLLGLGTICPPLILGSITGDVHLITVLGWMALRQLQAIDAHSGYDFPWSLRRIVPFWGGADWHDDHHRYFWGNYSSSFTHWDIYVAVTRTRGKEVQVLGTEVCEVAVPVPDPRAKLGANQGHIIVGNGASPTGRIYPASAASSFLRKAALLCSGPLVPLFAWMQHTKRLFSPLHLPRPTAILRLFCVCYPLSPICWHIMAHSMRVLVYARVSDIPGNPQARHIALGDLLTGNLLGRRFYATPRPPVYDHVHIPADFDSSQPLERWFIFDLNVGETLSRSEVTRLPHLVYLASRQGDEWIFIRRDTSIENAKSKAASFTWGGRSEQKLVSELQNQSGGHSVGPDT

SEQ ID NO: 44137 - protein, 492 aa, Saccharomyces cerevisiae
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 44138 - protein, 467 aa, Pseudomonas fluorescens Pf-5
MTTTTERKGIHLTRSLKSRHIFMLSLGGVIGTGLFMGSGVTINQGGPWGAILSYLGAGFLMYLVMVCLGELSVQMPVSGSFQAHATKYIGPATGFMIGWVYWMSWATTVGLEFTAAGMLMQRWFPGVPIWYWSALFVALLFGINALATRAFGEAEYWFAGVKVLAILSFIVVGALVIFGVIDLPSGAPAPMFDNLKGDSLFPNGLPAVFAVMMTVVYAFQGCEIMGVAAGETDQPEKSIPRAVRNVVFRVLIFYVLAVMVLAAIIPWQQAGLVESPFVQVFDMVGIPYAADLMNFVILTAILSVGNSGLYASTRILWAMSKSGMAPKALSPLSKQGVPLRALFITLCFALISLMTSFIAADTLFMVLMAVSGMAGTVTWIVIALAQYRFRRQFLREGGQLEQLKYRAPWFPLVPLLCIVLCSSLFVFLALDETQRPSLYWGSGFIALCYGAYYLMQRKRQLQPAAAV

SEQ ID NO: 44139 - protein, 219 aa, Zea mays
GNPDGATPPHIVEKLVQVAQREDTHGYSTSKGIPRLRRAISRWYKDRYAVDIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVIHDLAYADIVYDGWKAPSIMQVPGAKDIAVEFFTLSKSYNMAGWRIGFMVGNPEL

SEQ ID NO: 44140 - protein, 443 aa, Sulfolobus tokodaii str. 7
MLKKFNLIFSKDTGVITLSELDKKAIEISSKYKGKIQILPKVPIKSIDDFAVLYTPGIAAVSKEIAKNKELSFHYTYRWNAIAIVTDGTRVLGLGDIGPEAAMPVMEGKALIFKYLGGVDAIPLPIGTKDPDKIIETVKILEPAFGGINLEDIESPKCFYILDKLRQTVEIPVWHDDQQGTAGATLAGLITSLEITGKDPKNIRVILYGAGAANIATARLLYKYGVPYENMIVIDSKGPLYKGRNDEDSMKLENPWKYELLEKTNKIGARTIEDAFKGADVLIAASKPGPGVIKSDWIKLMNKDPIVFALANPVPEIWPDEAKNAGARIVATGRSDLPNQVNNSLIFPAVFRGALDVRAKTITDEMVIEAARELASFAREKGINENYIIPKMTEWEVYPRVAAAVGMKAIQQGIARVSLSYDEIYSSAREIINSARKLLSSLT

SEQ ID NO: 44141 - protein, 222 aa, Zea mays
MINAFQYSTRRAFANTVLKRSVSDRKAVLPLKVTDPAPKWKAMGVLNEEFKTYELSDYSGKFLVMVFYPLNFTFVCPTELIAFSEKKDEFLKRNTHLVGVSCDSHFSHLAWNNQPRKEGGLGGLNFPLISDIKKQISRDYNVLLPEQGISLRGLFIIDDKGILRVTMVNDLPIGRNVEEVLRLVDAIQFTDKHGEVCPANWNKGSSTIKPNVSGSKEYFKNQ

SEQ ID NO: 44142 - protein, 346 aa, Prosthecochloris aestuarii DSM 271
MRWRFHAEKKCVMKGFKTVLVMVMCSMFSFIIISCATAGDDNDSSMKQANNGLKESEMGYRVLTSEEERVIVGKGTEMPFSGKYVDFHEEGTYVCRRCDAPLFRSSDKFESGTGWPSFDDEIPGAVTRKTDADGRRTEILCANCGAHLGHVFLNEGLTGKNVRHCVNSISLDFKGADDRAIKPAQVSEKAIFAGGCFWGMEYHFGKVNGVLGTTVGYTGGSKEDPTYREVCSGKTGHAEAMEVEFDPAVVTYEELARLFFEIHDPTQVNRQGPDIGTQYRSAVYYVDDTQKAIAEKLIGQLKENGYAVVTELEKANAFYPAEEYHQDYYEKTGHQPYCHIYQKRFK

SEQ ID NO: 44143 - protein, 691 aa, Synechococcus sp. RS9916
MHNPVGIFALLVAITVMVPPLFRKLGLPDLVGLLLAGVLVGPHVLGWLQPEGETISLLSDIGAIYLLFTVGLEIDLEEFKRVKNRSMLFGTATFVLGAATGIAIGLLFSFPLVPCLLMGALMASHTPLGYPIVRSYGAQRDESVILSVGSTILTDIAALMLLAVGLGMGKGNLTPVGFTGLLISISLFAVAAVVGIRSIGRRLWMRSVTDENRVFLAVILSLFIASLGAELAGVEPIVGAFLAGLAVNSVLPEGKAKELVIFVGGALFIPIFFIDLGLLLDLNSIGASLSNFKFTGLMLVGALGCKGGAALLAGRWFHYGKHQVLMIWSLTMPKVAATLATAFIGYQAELLPSIVLNSVLVLMVVTATLGPMLTARSVTRLVEPKEVDPGPAQSLEQTVITGQGPGEVVRRPLRIVVPVANPATERGLLSLASRLISGSGGNEGQVLPLALVSPSVEDARGGLNQAIAAARSRLHQAERIGRDLQVSTHTLLRLDEDIAGGMSRSALEQGADLLLMGAGRPDKLRNWLFGNLVDSVCRSAHCPVVVTNLGERPTEELSRILVPIKDFSASAREQFELALRLMASAANATTTRITLLHIHDPRYSRHDRGWMKQELSQWQPLGVPGSRIKIELLQGPGIDSKIQRSAVNHDLVILRSQRRRVGGLPIPASDRTSSLVIQLPCPSIVISEPLL

SEQ ID NO: 44144 - protein, 428 aa, Rhizobium sp. MTP-10005
MSTNYMSAASVRTKNPAGVIATCGLMIMFDGYDLVVYGAVAPALLKEGAWALNPAMVGRAAALTLVGMLLGALFAGTMADRIGRRKVVLISLAGFSAMMIASAMTPNFLAFEITRFFAGLGLGALLPTVTALVLEFSPPKRRAQANSLSFLGYLIGGIISGLMGILLLESYGWRPLMLIGGLPLILLPIFMRFLPESPEWLASKGRQAEADGICDTYGLQRITPHAKIQKGGVGALFSEGRLLSTLNAWGIHFCSLLLTFGMVNWLPTIMNKMGYDISSALSFSIMLNVGAAIGILIGGRFADKGNVKVVVAVLFAIGAASIWALTVNKGPLLYLFVALAGAGTIGTQILANVLVGRLYPVHIRGTGLGFSLAVGRLGGIAGPMIGGLVLQRGLAPEWNFYIFGSIALVGLALTVLTLLYRTSGDGRV

SEQ ID NO: 44145 - protein, 510 aa, Oryza sativa
  misc_feature (204)..(204): Xaa can be any naturally occurring amino acid
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLINIPMSNCINSKINKIYVLTQFNSQSLNRHIARTYNIGEGVGFGDGFVEVLAATQTTGESGKRWFQGTADAVRQFLWLFEDARLKRIENILILSXGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 44146 - protein, 428 aa, uncultured sulfate-reducing bacterium
MVSDLYFNWHRFSPMTCYGSFMLDDSVVSHGGHRTMTIYFDHNATTPLHREVLQEVIAAMETRWHNASSTHAPGLRARSDVEIAREEIAALLGASLEEVILTGGGTEAGNLAVIGASMARRERGTHIVVSRVEHHAVLHAAAALERRGFDVTYADVDADGRVDPDAIVASLRPTTVLVSVMHANNETGAIQPIGELGRRLRKRDILFHTDAVQTVGKLHIDVNDLGVDLLSLSAHKFHGPKGAGALYVRDGVEVEPLMHGGAQEEGIRPGTYNVPAIVGLGVAARLARRSIDENAGYIVSLVERLERGLLRIAPEAKILVDKRHRLHNTLTVCFPGENRESLVTNLDLHGVAVSTGAACTAGASEPSHVLAAMGIGEATARGAVRFSLGCTNAAQEVDAALSALREVLGRKRGIIERLRDGFGILDSS

SEQ ID NO: 44147 - protein, 249 aa, Mycobacterium tuberculosis CDC1551
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRG

SEQ ID NO: 44148 - protein, 400 aa, Corynebacterium efficiens YS-314
MSNETNANSTDSRQGVTNIGSVPAYLVLADGRTFKGFGFGAIGTTLGEAVFTTAMTGYQETMTDPSYHRQIVVATAPQIGNTGWNEEDNESHDGSIWVAGLVIRDLAVRVSNWRATTTLQEEMAKQGVVGIGGIDTRALVRHIRNEGAVPAGIFSGADAERPIEELVEIVKSQPSMVGANLAVEVSVDKPYVIEAEGEARHTVVAYDLGIKQNTPRRFAARGVRTVIVPAETPFEEIKQYNPSGVFISNGPGDPAAADIMVNIVREVLAADIPFFGICFGNQILGRAFGMETYKLKFGHRGINVPVKNHITGKIDITAQNHGFALKGEAGQEFETDFGTAVVTHTCLNDGVVEGVALKSGRAYSVQYHPEAAAGPNDASPLFDQFVALMDEDSENQKEEA

SEQ ID NO: 44149 - protein, 122 aa, Brassica napus
GDRENISSAGPDKTFQQQVGLPPPPHACLPLEFKKKWISHLRSPPMGSGQSPEALMEQVQAQLQQAYAEELIETLRGKCFDKCVTKPGSSLSSGESSCVSRCVDRYIEAMGIISRSLFSQQR

SEQ ID NO: 44150 - protein, 373 aa, Legionella pneumophila subsp. pneumophila str. Philadelphia 1
MNALTSWIKAWSQKFFPNQKKNENKEEEADLTQEKKVRPNADFYENYFSLVAAGTRLKLIEAMFGVNLFSLFENKAWVLEKDIIEKLQLMPIRARKWLHLLSSEHFLIQIKVNGQQAYQLPEEFIELIHSEEFPAMEMFFKTWLVSAEENLTDVLRFGKVKTSVSWPPKTQQEAEWLEDWMTRTSDQPTYCLLQSINFKKVNKFLDVGGGDGTMACTFVKKYPHLKAAVYNLPMSAQMARKNIESRKLNHRVHVIEGDFIEKDAFPVGFDLILFTRVLFDWDDQVCRKLLRMAYQALPKNGLVGICEFYKEDNNDICLASEYRYIFHDDFGVNVMKRASEYQNMLEKIGFTIVQPHKVKGMHFYYCSLILARK

SEQ ID NO: 44151 - protein, 453 aa, Sinorhizobium meliloti 1021
MGTTQSGILGGRLPLAEYEANFSDLHPSLDRHEALVAADRCYFCHDAPCMTACPTSIDIPLFIRQIATGNPIGSAKTIFDQNILGGMCARVCPTETLCEEACVRNTAEERPVEIGRLQRYATDIAMRENKQFYSRAARSGRRVAVVGAGPAGLACAHRLAVKGHDVVIYDAREKSGGLNEYGIAAYKAVDDFAQREVEYVLSVGGIEVSHGKALGRDFSLADLAEEFDAVFLGLGLAGVNALRIEGENAEGVEDAVDFIAALRQSKTKADIPVGRRVVVLGGGMTAIDAAVQAKLLGAEEVTICYRRGKEHMNASEFEQDLAASKGVTIRHWLQPKRIAVKDGRVAGIELDYTTLENGKLTTTGETGIIAADQIFKAIGQAFEASGLGALRMESGRIVVDSEGRTSLEKVWAGGDCVLGGEDLTVSAVAMGRDAAGSIDRAFAVAQPLASAVA

SEQ ID NO: 44152 - protein, 137 aa, Triticum aestivum
  misc_feature (76)..(76): Xaa can be any naturally occurring amino acid
LISHTTTHLASHTSLLATSSFACVLVPPTSIAKMSTVSCAYLDQRLAAANRCSEEAAMAGAKAAAVATIAAAVPTXLASVRMLPWARAHLNPTGQALIISTVAGMAYFIVADKTILSMARKHSFQDAPEHLKNTSFH

SEQ ID NO: 44153 - protein, 238 aa, Glycine max
QIIKAKYGQDACNVGDEGGFAPSVQDNREGFVLLVDAIEKAGYTGKIKIGMDVAASEFYTKDGKYDLNFMKQPNDGAHVHSTQSLGQLYKNYVKEFPIVSIKDPFDQDDWGSWASLLASVDIQLVDDLLVTNPKRIAEAIKKKACNGLLLKVNQIGTVTESIQAALDSKAAGWGVVVSHRSGETEDNFIADLSVGLASGQTKTGAPCRSERLAKYNQLLRIEEELGSVQYAGETFRSP

SEQ ID NO: 44154 - protein, 182 aa, Nostoc sp. PCC 7120
MGEELQVVIKNAVVVNAIIKKFYWQAITLILGIVVLCFPSPVLADWTHPLSFSNAELSRHNFAGESLQAAEFSNANLEMTNFVGADLRGAVLSASVMTQANLQGADLTNAMVDQVNLTGANLSDVVLKEALLLRAIFANVNIEGADFTDAILDKAQIKELCTKASGVNTKTGVETRDSLGCR

SEQ ID NO: 44155 - protein, 402 aa, Pseudomonas fluorescens Pf-5
MRFSRLTQRIAGDGAAAWDIHYRALAKRERGEEVWLLSVGDPDFDTPQPIVQAAIDSLQAGHTHYADVRGKRALREAIARRHQQRSGQVVDAEQVVVLAGAQCALYSVAQCLLDPGDEVIVAEPMYVTYEAVFGACNAQVVPLPVRAEDGFRVQPEAVAARITGKTRALVLNSPHNPTGASIPRSTWEALAALCIEHDLWLICDEVYSELLYEGEHVSPASLPGMAERTATLNSLSKSHAMTGWRLGWVVAPTALAAHLENLALCMLYGSPEFIQDAAVVALEQPLPQLREMAEAYRQRRDLVCDCLADCPGARPLKPDGGMFVMVDIRATGLSAQAFSERLLDEQGVSVLAGEAFGPSAAGHIRLGLVLQADDLREACRRIALCARQCLAERDAPVTVQPV

SEQ ID NO: 44156 - protein, 369 aa, Nicotiana tabacum
MAIENNEQQELSQSFLLDALYCEEEEEKWGDLLDDETIITPLSSELTTTTKPNSLLPLLLLEQDLFWEDEELLSLFSKEKETHCWFNSFQDDPLLCSARVDAVEWILKVNGYYGFSALTAILAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLKNNVHWEFLRRCESLLLSIMADCRFVRYMPSVLATAIMLHVIHQVEPCNSVEYQNQLLGVLKISKEKVNNCFELISEVCSKPISHKRKYENPSSSPSGVIDPIYSSESSNDSWDLESTSSYFPVFKKSRVQEQQMKLASSISRVFVEAVGSPH

SEQ ID NO: 44157 - protein, 148 aa, Sulfolobus tokodaii str. 7
MMSIQRTFVMIKPDGVRRNLIGEIISRFEKRGLKIIGLKMVKIDRPTAERLYEEHKGKSFFEELISYITSGPVVCMVIEGDEAVSVVRKMIGNTDPKEAPPGTIRGDYALSKAENVIHASDSEEKAKREMSIFFKEEELVTPLAQVHM

SEQ ID NO: 44158 - protein, 414 aa, Nostoc sp. PCC 7120
MFPASVFRLDNGLTFIHQEIPTTPVVVADVWVRAGAIREPEPWFGMAHFLEHMIFKGTATLPPGTFDHQIENRGGVSNAATSYDYANYSLTTAASYLTDTLPYLADLLLNAAIPDNEFSRERDVVLEEIRACYDDPDWVGFQCLSQSIYQDHPYGRSVLGTEEELMQQSPEAMRRFHRAHYQPENMTVVIAGGIAQQAAWELVNRSFENFSKPVECPLVKPVSKPVIKGIHRQELSLPRIEQARLLMAWVVPGVEQLRTAYGLDLLSVVLAEGRTSRLVRDLREELQLVQGICSNFSLQCESSLFTVTAWLEPENLEQVEDLILSHLDDIQTSGVSEQEIARTRRLLCNEYAFSTETPNQLTGLYGYYNTIAQAELAVTYPHQIQSFDTQELQQLAKQHLSLQNYAVTILKPYS

SEQ ID NO: 44159 - protein, 120 aa, Picea sitchensis
MAEGNVFACHSTEAWRSKLQEAIDTKRLVVVDFTATWCGPCRVIGPVFVELSKKFPEIFFLKVDVDQLRDVAQEWDVEAMPTFIFIKDGKAVDKVVGAKKDDLERKGAALATEAALAAQA

SEQ ID NO: 44160 - protein, 373 aa, Nicotiana tabacum
MAIEHNEQQELSQSFLLDALYCEEEEEKWGDLVDDETIITPLSSEVTTTTTTTTKPNSLLPLLLLEQDLFWEDEELLSLFSKEKETHCWFNSFQDDSLHCSARVDSVEWILKVNGYYGFSALTAVLAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLRNNIHWEFLRRCENLLLSIMADCRFVRYMPSVLATAIMLHVIHQVEPCNSVDYQNQLLGVLKINKEKVNNCFELISEVCSKPISHKRKYENPSHSPSGVIDPIYSSESSNDSWDLESTSSYFPVFKKSRVQEQQMKLASSISRVFVEAVGSPH

SEQ ID NO: 44161 - protein, 320 aa, Pseudomonas fluorescens Pf-5
MPDIDILSFGETMAMFVAEHGGDLAQVQHFHKRIAGADSNVAIGLARLGFKVAWLSRVGNDSLGRFVLDTLRAEGLDCRFVRCDPIHPTGFQLKSREDGGDDPRVEYFRRGSAASHLAISDLDPALLRARHLHATGIPPALSDSARELSGHLMHTQRSAGHSVSFDPNLRPALWPSEALMIREINRLAALAHWVLPGLAEGRLLTGRDDPADIAAFYLDQGAEAVVIKLGAHGAYYRTQLDAGFVEGVPVAQVVDTVGAGDGFAVGLISALLESRGILEAVQRANWIGSRAVQSRGDMEGLPLRHELPEHTPSLKTASAL

SEQ ID NO: 44162 - protein, 216 aa, Sulfolobus tokodaii str. 7
MPLFVLSKPITLHFLTQLRSKNTDQITFRKTLVRLGRIIGYEILNMLDYNIIEVETPLGVKAKGVYIYDLENIVIISILRAATPLVEGLLKALPTARLGVIAASRKETQVNLGYPKEMEVEIFYNKIPEINIKDNVIIADPMIATASTMLKALNIIKDKKPKRIFIVSIIISEYGLKRILESYPDVNIITVSIDPELDNRGYILPGLGDAGDRAFG

SEQ ID NO: 44163 - protein, 148 aa, Oryza sativa
  misc_feature (33)..(33): Xaa can be any naturally occurring amino acid
  misc_feature (140)..(140): Xaa can be any naturally occurring amino acid
GPICEAEVVRASSKGLYMGNGGGANVVASGYTXKGDGLGAEIVGTFILVYTVFSATDAKRNARDSHVPILAPLPIGFAVFLVHLATPIPITGTGINPARSLGAAIIYNKDHAWNDHWIFWVGPFVGAALAAIYHQVIIRXAIPFKSRS

SEQ ID NO: 44164 - protein, 203 aa, Shewanella sp. ANA-3
MSIKYVATSKLPTPWGVFAMHGFEDTETSKEHVALTFGTLSSDAPVLGRIHSECLTGDALFSLRCDCGFQLQTAMQNIAETGSGFILYLRQEGRGIGLLNKIRAYELQDKGANTVEANEQLGFPADMRKYDMIQPMLEQIGVKHVRLMTNNPRKVKAMKEIGIEVVERVPLQVGKNRYNEAYLKTKSTELGHMMSEYHFTDEE

SEQ ID NO: 44165 - protein, 153 aa, Zea mays
  misc_feature (109)..(109): Xaa can be any naturally occurring amino acid
MAADPSRRRPEYHPAVNDVLLTLTNARGTLADVQRRLDLEFRAAYPDHANPAKLVARVKRLEEEAAALKEMCRDLLTQKQELIDQIRVSLMAQRGMTQRLLAASGLPPXSDADETVHNSLNEVIQDWTAQDWEPVRGDNGEFTAGFGHPYPFP

SEQ ID NO: 44166 - protein, 122 aa, Arabidopsis thaliana
MNKGCGSGSDSCLSSMEEELHVLAVDDNLIDRKLVERILKISSCKVTTAENGLRALEYLGLGDPQQTDSLTNVMKVNLIITDYCMPGMTGFELLKKVKESSNLKEVPVVILSSENIPTRINK

SEQ ID NO: 44167 - protein, 189 aa, Coprinopsis cinerea okayama7#130
MYWSVVGAFVAFEYIAEWFISWFPFYWECKTLFLLYLALPQTEGSTYIYQNYLRPFLAKNEAALDDGIVALQRNAFGFIQQKLTDLLTLAANALNKQGNTQGHSGQPQQGANPLQTAASLWQTYGGSLLGALQQQQRSAATATGATQHPATTPNLTPRHSGASNASSPSAELKTPTPPFPVPHHFTPSQ

SEQ ID NO: 44168 - protein, 369 aa, Pseudomonas fluorescens Pf-5
MNSASLMCLLHRHDWPGWPGCCATGRSRAPGIPLGTSSLLHKDPAMSRIFADNAHSIGNTPLVQINRIAPRGVTILAKIEGRNPGYSVKCRIGANMIWDAESSGKLKPGMTIVEPTSGNTGIGLAFVAAARGYKLMLTMPASMSIERRKVLKALGAELVLTEPAKGMKGAIEKAAEIVASDPARYFMPQQFDNPANPAIHEKTTGPEIWNDTDGAVDVLVAGVGTGGTISGVSRYIKKTQGKPILSVAVEPATSPVITQKLAGEEIKPSPHKIQGIGAGFVPRNLDLAMVDRVELVTDEESKAMALRLMQEEGILCGISCGAAMAVAVRLAETPEMQGKTIVVILPDSGERYLSSMLFSDLFTEQENQQ

SEQ ID NO: 44169 - protein, 947 aa, Zea mays
MTASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKLATERGRKARPNLKVGICGEHGGEPSSVAFFAKAGLDYVSCSPFRVPIARLAAAQVLV

SEQ ID NO: 44170 - protein, 380 aa, Zea mays
  misc_feature (322)..(322): Xaa can be any naturally occurring amino acid
IMATTTSATTAAAAAATTAKPRGSSSALCQRVAGGGRRRSGVVRCDAAGVEAQAQAVAKAASVAALEQFKISADRYMKERSTIAVIGLSVHTAPVEMREKLAVAEELWPRAIQELTSLNHIEEAAVLSTCNRMEIYVVALSWNRGIREVVDWMSKKSGIPASELREHLFILRSSDATRHLFEVSAGLDSLVLGEGQILAQVKQVVRSGQNSGGLGKNIDRMFKDAITAGKRVRSETNISSGAVSVSSAAVELALMKLPKSEALSARMLLIGAGKMGKLVIKHLVAKGCKKVVVVNRSVERVDAIREEMKDIEIVYRPLSDMXYQAAAEADVVFTSTASETSLFAKEHAEELPPVSDTMGGVRLNDDISGPINATACAHEN

SEQ ID NO: 44171 - protein, 297 aa, Oryza sativa Japonica Group
MQQWYDDQYAVIDRVVDVAMRCKKIDQLRAVNGIPPYAPVSNRSLLSPVTLPIIRDANIKNDTRLRIFSGTANPSLSQEIASYLGLELGKINIKRRASAKNITAVIPYFGYARADRKSQGRESIAAKLVANMITEAGANRVLVCDLHSSQAMGYFDIPVDHVYGQVMNLIGDVRGKVAVMMDDMIDTADISLPNINILMKPIKLGTIAKGAELLHQEGAREVYACCTHAVFSPPAIERLSSGLFQEVIITNTIPLKEDKSFPQLTILSVANLLGETIWRVHDDCSVGHEPYSSLDID

SEQ ID NO: 44172 - protein, 329 aa, Bacteroides fragilis YCH46
MDKIIGLGNALVDVLATLKDDTLLDEMGLPKGSMQLIDDAKLQQINERFSQMKTHLATGGAAANTILGLACLGAGTGFIGKIGNDAYGNFFRANLQRNGIEDKLLVSDLPSGVASTFISPDGERTFGTYLGAASTLKAEDLTLDMFKGYAYLLIEGYLVQDHDMILHAIELAKEAGLQVCLDMASYNIVAGDLEFFTLLINKYVDIVFANEEEAKAFTGKEDPKEALELISKKCSIAIVKVGGNGSYIRKGTEEIKVEAIPVKKVIDTTGAGDYFASGFLYGLTCGYSLEKCAKIGSILSGNVIQIVGTTIPGERWDEIKLNINEVLSE

SEQ ID NO: 44173 - protein, 426 aa, Nostoc sp. PCC 7120
MTNNDVLLLKVAKSGDIKGLGALLAAGVGVDICDRDGTTALMFAANLGYTEIVRSLLDGGANVNLARKRYGLTALMLAASANQVDIVQLLISRGAAVNATNEDGSTALMAAALKGNVEVARVLLAAGADVNITDKDDDTALKLAVKRGQAAVVQLILPSGADANCEDEEGETLLMLAADSGHGDVVQVLLAAGVDVNEQNQDGGTALLAAVAAGNGAIAKILLDRGADVNHQDQDGESALHLATVEGYVDVVQVLLNQGANTQIKNKLGDTPLLVAALQGHDQIVETLLKYGANVHGDNLGETPLTLAASQGHTATVRILLDYGANANIPASDGKTALIKATERNHPGVIQLLLAKGANVNYQDSVGATALIWAASGGYNKVVQILLEGGADTNLKNRGGYTALMIAEFNGFRSIVQILKQAGAQE

SEQ ID NO: 44174 - protein, 619 aa, Aspergillus oryzae
MPLLDAHSGPSYGTLDQMERHDQYEGEQLLPTGYDSDDHGSEITSDDSVQEGVRKIEAINLTWTTKSLVVAYVSIFLMAFCTSLEGQTTMSLSAYATSAFSKHSLISTVLVVQNVVNAVIKPPMAKIADVFGRFEAFCVCILIYVLGYIQMAASTNVQTYASAQIFYSAGSTGLQILQQVFIADSSSLLNRAFLALLPEFPFLVTVWIGPSIADAVMRHSSWRWGYGMWSIILPASFLPLALTLLLNQRKAKRLNLIKQKHAPRGGLVAVIRRTWYDLDMFGLILLSAAVTLILVPLTLAASAKDGWKNDSILAMIVVGIVCLLALPLWESSKRFAPKPLLSLHLLRQRTALAGCALAFWYFMAFYFSVQPYLYSYLQVVQGYDVATAGRVTQTFAFTSTIAAFSVSLLIKYTRRYRIYVTIGSAIYMFGLLLMMLYRKEGSSSTLILGTQIVVGMGGGLLNVPVQLGVQASASHQEVAAATAMFLTSMEMGGAVGAAISGAVWTHNIPRKLRRYLPDENKGDAKEIFGRLDKALSFPMGSPVRVAINRSYQETMNKLLVLALIVTIPLIPLSLLMKNYRLDKVNSEPVDGPNGDHLVSDNGHGLSGNESESEGHSKQP

SEQ ID NO: 44175 - protein, 608 aa, Legionella pneumophila subsp. pneumophila str. Philadelphia 1
MFVRICAMFGFVSDLLTAAVSSLDELLQDTPAHQIILGTAALYFLYNQYHNPSISRWYRSRNNASMKQRIIDSAYALAKNLPGVNQIIEKELNKELSSTREKLRIQRSGMTLREEIPEEGLSPQDILSAFDVDVEKCHFDFLSVTNDSPEREFLVERGDGKDSGALYAIHPKELTELLKEVYGATALTNPLHDKWPRINAMQAEVIRWCQNLFHGSKECYGLLTHGGTTSIIEAMAAYVIRARAKGIDYPEIVVPETAHAAFKKAAELTGAILITVPVDKKTGAVNPKVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIITLRNAIQKELTTLLEEGNGLTSEDIYVYGNPQWSILGFRSNTCNAHFIADELEKRGWKLNLLQNPDGFHLCLTHVHTLVKGFETQFIKDLREAVIDVKNYPPGKKPSGNVKVYGAVGMMPIELQREICKQYQKARLNYTSASPGSLRIFTNVPVEEDEGLRNRKTEKYKV

SEQ ID NO: 44176 - protein, 140 aa, Zea mays
  misc_feature (58)..(58): Xaa can be any naturally occurring amino acid
CALGGDGSPWLLVFASSIRVIPDFPKPGIMFQDITTLLLDPKAFRDTIDLFVERYKDXKEARGFIFGPPIALAIGAKFVPLRKPKKLPGEVISEEYSLEYGTDKIEMHVGAVQANDRALVVDDLIATGGTLCAAVKLIER

SEQ ID NO: 44177 - protein, 317 aa, Triticum aestivum
MTVLALMAPDKCLWTEGKRSIVGVSQSLTCRNNNSLTVHEGLCLPDISQGKESIPICVINTIDGVLPTPFKYITKVIYPPSYAKAPSVGCDCTNGCSDSSECACAVKNGGEIPFNLNSAIVYTKPLIYECGPSCRCPPTCHNRVSQHGPKVPLEIFKTGKTGWGVRSLSFIPSGSFVCEYVGEVLQETEAERTENDEYLFDIGRDDDDDEEEEEGSESSKSEMTAEGLGYTIDAAKCGNVGRFINHSCSPNMHAQDVLWDHDDRRMPHVMLFAEKNIRPLQELTYDYNYNIGNVRKNGKVKEKKCFCGSSKCRLRLY

SEQ ID NO: 44178 - protein, 333 aa, Candidatus Kuenenia stuttgartiensis
MSVRIGINGFGRIGRNVFRVISKRNNIDVVAINDLADSKSLAMLLKYDSIHGRFDGSIQIKENALMVNDKEVRLLMEKDPAKLPWKSIGVDIVIESTGIFTSRSDCSKHLDAGAKKVLLSAPAKDKIDATIVVGVNNKDLRPEHKIVSNASCTTNCLAPLAKVLHDNFGIEKGLMTTIHAYTNDQRILDFMHKDIRRARAAAINIIPTTTGAAKAIGEVIPSLKGKLDGLAMRVPVPDGSVTDLVVMLAKEVDRDAINAAMKTAAEGDLKGILEYCGDPIVSSDIIGNPHSSIFDSALTYVIDKRMAKVISWYDNEWGFSNRMVDLIELMSRL

SEQ ID NO: 44179 - protein, 135 aa, Anabaena variabilis ATCC 29413
MTQSENNGQLDANDSSSHSGLRYWGNVEVIEEGESYRISRIEIKPRHGIKPQIHYHRNEHWVVVSGVAKVTCGDDEVLLGRNQSTYVPAATLHKVDNPGSIPLVILEIQNGEYLGEDDTERPYDLNLVKPGVEIK

SEQ ID NO: 44180 - protein, 156 aa, Brassica napus
KGWPSQFRINKYHFHPEAVGKLGVQLHTDSGFLTILQDDENVGGLEAMDHSSGTFFPISPLPNTLAINLGDMAPIWSNGRLCNVKHRVQCNEATKRFSIASFLLGPMDTDLEPPSEFVDAEHPRMYKAISHAGVRNIRMTAKLHDGEALKLITYEE

SEQ ID NO: 44181 - protein, 202 aa, Sulfolobus tokodaii str. 7
MNYEIEKEIKLVLAVNPSVNSLNDIEVIYSHSHAINEAKETLSKYNFTNFVPVESTSTAALYASKQKYSAAICSEYAANLYNLKIILRDINDSINITRFIVISKKLIEDGDKTMVMFTVPHKPGALYKVLEKFYNNNINLTMIYSRPLKSIPWQYYFYLEFEGNIKDNKVKATLEEIRNITSMLKIKGSFTKLQYQVSNYLS

SEQ ID NO: 44182 - protein, 339 aa, Picea sitchensis
MGDVEAGFAKLQGEDFEYYMQTYSIVLGRNSKKSSVDIDLSYLGGGMNISRQHARIYYDFDRKRFALEVIGKNGCLVEGVLYLPGNPPIKLDSQDLLQIGDKKFYFLLPVRKIVKPQHQHLNLNANANNASLALPTSAVPVPGGASGTLKKRGGRKEDDHYQQQEQQHPPTKKWRSQAKQDGGLDNASRDRKQSASSWSPHEMHNPYIMPKQGFPYHSDQKGDLRRRADHEAEMFQQMQEEKDVVSAVATVLSDLCGPGEWMPMAKLHSELLEHYSGIWHQSRIRKFLTSDDWADSDSKGRPWIGLLSLLRKYPEHFVINTRSKGRVTQEFVSLVSLLS

SEQ ID NO: 44183 - protein, 192 aa, Oryza sativa Indica Group
MAPAVEAVEKKTGSAPVKAPALNERILSSMSRRSIAAHPWHDLEIGPGAPTIFNCVIEIPRGSKVKYELDKKTGLIVVDRVLYSSVVYPHNYGFIPRTLCEDSDPLDVLVIMQEPVIPGCFLRAKAIGLMPMIDQGEADDKIIAVCADDPEYKHYNDIKELPPHRLAEIRRFFEDCILFYQLNIKFCILNEF

SEQ ID NO: 44184 - protein, 407 aa, Zea mays
AWPWRSRPTPGTGTPRRRRRPPRPRSRRSPPPRGPSRRSRQRSTSRPRSTGPSRRSRPRSTSRRRPRTPRAPNPRRRRTLPPRRPPSRRHPHTLPPLRPTNPLPLLRRTPLPPNLRHLSRPRRRTLQAPSHRLASLPRPSRPRRRTPLLPSLDAQSMEIISRWIPGWGIDAVTLPLAVDLNIATDSATKAARTLARDEDFKFRAAHWGDLHRRLHEELPPAVTVLWGHQFLSFEAPDDTRGVVATARVLRTGGTVEATGDLLIAADGSTSSVRRSFLPDLKLRYSGYCAWRGVFDFSGKESSDTMTSIRRAYPELGNCLYFDLAYKTHAVLYELPRSRLNWLWYINGPEPELAGNSVTMEATDAMVGRMRNEAERVWCPELARLVRETAAPFVNVIYDADPLRRLSW

SEQ ID NO: 44185 - protein, 314 aa, Brassica napus
MSIPCLTEETAKSVLRQVEFYFSDSNLPIDDFLKKTVRESDDGLVSLGLICSFSKMRAYLKLGDSKGDEVPEDTIKAVADTLRTSSALKVSEDGKKVGRSTELLKLEDLIEQLNARTVAASPFSYDVKREDVEAFFSQYGKVNSVRMPRHVAETRVFCGVALVEFPTEEDAQNVMKQSLVFAGLELEMKPKKEFDDEREKDEEKFAIYRPQKASANQKNGSDHRNGSESEANYPKGLIISFTLKRSAEEGATEKSSEEAADKKMDESESKTEDNPAEDKENTDQAQGQGTEGEDDEDESSDSPAKKEKKKKRAA

SEQ ID NO: 44186 - protein, 238 aa, Arabidopsis thaliana
MRPLSSSLRPSSSVSFSTGKPIKRAYDGLLLDAGGTLLQLSKPVHETYASLGQKYGLKTTPAEIKEGFKRVFSAPWPEKLRYQGDGRPFWKLVVSEATGCSDNDYFEDVYQYYANGEAWHLPEGAYETMSLLKDAGVKMAVVSNFDTRLRKLLKDLNVIDMFDAVIVSAEVGYEKPDERIFKSALEQISVDVNRAVHVGDDEGADKGGANAIGIACWLWGEDVQTFSDIQKRILVSEL

SEQ ID NO: 44187 - protein, 398 aa, Salinibacter ruber DSM 13855
MHKLTLDDVDVRGQRVLIRVDFNVPLDTSEDGSPCVGDDTRIRAALPTIRHVLDHGGKAILVSHLGRPGGQPDPDLSLACVADHLGTLIEERVRFSSNTVGDTVEEVINGMSEGSVILLENTRFDAGEKANDEAFATALANLADVYVNDAFGAAHRAHASTAGVAEFMDVAALGRLMEDEIEALTRVRDDPAHPMVAILGGSKVSDKLGTIRALSETADHLLIGGAMSYTFLKVLGHEVGASRVEADRLDTAEDLYEQAEGTITLPTDHVVAEAPEADATASVVEGDIPAELMGLDIGPATIDAYRDRILGAATVVWNGPMGVFEVDPFADGTTAIAEAMADATDDGAFSVVGGGDSVSALTRSGCDDRISHVSTGGGALLTFLEGAPLPGVEALTDA

SEQ ID NO: 44188 - protein, 270 aa, Arabidopsis thaliana
  misc_feature (110)..(110): Xaa can be any naturally occurring amino acid
MAKLFIKQAEQYAAARPSYPTKLFEYIASKTPCHDLAWDVGAGSGQASRSLAGIYKNVIATDTSSKQLEFAAKLPNVRYEITPPTMSSSEIEKLVAPESSVDLVTVAQAXLHWFDLTNFYSNVKHVLKKPNGVIAAWCYTNPEVNDAVDKVFQRFYDEKLGPHWDLARRLVEDGYRGIEFPFEKVDNDESTESQSFPVRFVTEKEMVFEEYMTYLRSSSAYQTAKEKGLELLTAEMEGEFAGSWKEDGKEKKVVRYPIYLLIGRVAEERV

SEQ ID NO: 44189 - protein, 175 aa, Salinibacter ruber DSM 13855
MADRKEQKRVNAEKRQENWVDRLVSVNRVSKVVKGGRRFSFNTVVVVGNEDGLVGTGLGKANEVSSAISKGADDAKKNVIRVPMRDGTIPHKVVGKQDAGKVLLKPASPGTGVIAGGGVRAVLECAGYRNVLTKSLGTSNPHNQVKATINALAETEDALEVARRRDIPLEKVFNG

SEQ ID NO: 44190 - protein, 133 aa, Brassica napus
  misc_feature (2)..(3): Xaa can be any naturally occurring amino acid
  misc_feature (9)..(9): Xaa can be any naturally occurring amino acid
  misc_feature (12)..(12): Xaa can be any naturally occurring amino acid
  misc_feature (16)..(16): Xaa can be any naturally occurring amino acid
  misc_feature (21)..(21): Xaa can be any naturally occurring amino acid
  misc_feature (31)..(31): Xaa can be any naturally occurring amino acid
  misc_feature (35)..(35): Xaa can be any naturally occurring amino acid
  misc_feature (50)..(50): Xaa can be any naturally occurring amino acid
  misc_feature (53)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (62)..(62): Xaa can be any naturally occurring amino acid
  misc_feature (64)..(66): Xaa can be any naturally occurring amino acid
  misc_feature (69)..(69): Xaa can be any naturally occurring amino acid
  misc_feature (71)..(71): Xaa can be any naturally occurring amino acid
  misc_feature (73)..(73): Xaa can be any naturally occurring amino acid
  misc_feature (85)..(87): Xaa can be any naturally occurring amino acid
  misc_feature (90)..(90): Xaa can be any naturally occurring amino acid
MXXSMLSSXAAXTSPXQATMXVPFTGLKSSXAFPXTRKANNDITSIVSNXGRXSCMXVXPPXGXXXFEXLXYXPDLTKVELGKEXXXYFXRNKWISLNSQGKYVATPPPEWGNGEFPLLGPFSHVFRYPHPPS

SEQ ID NO: 44191 - protein, 420 aa, Staphylococcus epidermidis ATCC 12228
MAEVKVPELAESITEGTIAEWLKNVGDNVDKGEAILELETDKVNVEVVSEEAGVLSEQLAEEGDTVEVGQAVAVVGEGQVNTSNDSSNESSQKDEAKEKETPKQSNPNSSESENTQDNSQQRINATPSARRHARKNGVDLSEVSGKGNDVLRKDDVENSQKSSSQTAKSESKSQNSGSKQSNNNPSKPVIREKMSRRKKTAAKKLLEVSNQTAMLTTFNEVDMTNVMDLRKRKKEQFIKDHDGTKLGFMSFFTKAAVAALKKYPEVNAEIDGDDMITKQFYDIGIAVSTDDGLLVPFVRDCDKKNFAEIEQEIANLAVKARDKKLGLDDMVNGSFTITNGGIFGSMMSTPIINGNQAAILGMHSIITRPIAVDKDTIENRPMMYIALSYDHRIIDGKEAVGFLKTIKELIENPEDLLLES

SEQ ID NO: 44192 - protein, 206 aa, Schizosaccharomyces pombe 972h-
MNDHLKVVVTILNLPTPISLAPYFTSSIILKYSMFRIASRQTRNLRALSSSKNWARSLVNTRSFRAAASVQNNNAQIGEMVDKISSLSLLETSELVKQLKEKLNIAEIAPMAAVAPAVASAAPSEEKAPEEKKEEKTTWNLKLESFDAGSKAKVIKEVKSLLGLSLVDAKKFVESAPKVLKENILKEDAEAIKSKLEKLSCKVVLE

SEQ ID NO: 44193 - protein, 180 aa, Sinorhizobium meliloti 1021
MMLGRKVPAVTFRTRVRDESVGGSNPFRWQDVTSDDYFAGKRVVLFSLPGAFTPTCSTYQLPDFEKLTSEFRTLGIDEIYCVSVNDAFVMNAWGKSQGLENVKLIPDGSGEFTRKMGMLVAKDNLGFGMRSWRYAAVINNGVVEQWFEEEGYSDNCDSDPYGVSSPQNILAALKSKKLAA

SEQ ID NO: 44194 - protein, 326 aa, Zea mays
  misc_feature (224)..(224): Xaa can be any naturally occurring amino acid
MEAWRSLLASFVLAVLAAQALVAVVESRTGPVEQASQGDDVKKPDCVPGIDPRSFPGTGGGHGITPVTPSHGGSSSPTPSHGGGGGYVPTPSHGGTLPFPSHGGSGSGSSPTSPSTGGGSHGGSPSTPGGGAYGGSPPSTPSGGGAYGGSPSTPSGGGAYGGGSPSPAHGAGGAYGSSPTPAYGDSPLHGGIGTSSPTTFVPMDPHSFGTCDYWRSHPMEIWSXAVGGRFPSTSSSMGHFFGAAAGSVGGADVMSIQDAVGNTRADGTGALLRESAAALLNSMTRAGFPYTTEQVRDAFAAAAAAGSDGAAAAQAAAFRKANEGKA

SEQ ID NO: 44195 - protein, 397 aa, Candidatus Kuenenia stuttgartiensis
MKKLFIKDLAVRKKKVMVRTDYNVPLDEDGNITDDTRIRATLPTINYLLDEEAKVIIASHLGRPVGANPKYSLKPVARRLQRFLTEKVKITLAEDCIGEEVKKQVEAMNYGDVLLLENLRFHPGEQKNDAGFAKELAGLCDLFVQDAFGNCHRNHASMVGIVRYVPAAAGFLIKKELDYFEKSVNDPIRPVIAILGGSKVSDKIKILENLAKKMDKIIIGGAMAFTFLKAQGIPVGKSLVEDSMIETANNLMDYTKKNGTKLYLPVDFVVAEKFDKTAETKVVPFQEIPERWIALDIGPATIKLFSAVLQDAKTILWNGPMGAFEIDAFSRGTYAMVDIVTSSHASTVVGGGDTDMAFHKAGKAHEVSFISTGGGAFLKLLEGGDLPGIASLTDKKI

SEQ ID NO: 44196 - protein, 232 aa, Candidatus Kuenenia stuttgartiensis
MRNKIKISASILAANPMRFEEEIKRIEAAGIDLIHIDVMDGHFVPNITIGPFIVAGIRRITNIPLDIHLMIEHPERYVEAFAGAAEGNGIITFHIETVKNPKEIISLIKSTGMKVGISLNPGTPVEMIENFLDQVDMALVMSVNPGFAGQKFIPIALPKIARLRDKAPDKMDIQVDGGITPDNISQVVKQGANVIVAASAIFKTSDPGNAIKSLKQIAEQTMEKDAVNLVNR

SEQ ID NO: 44197 - protein, 268 aa, Bacteroides fragilis YCH46
MELDLQQLTTEVCRIATEAGNFLRKERRSFSRERVVEKHAHDYVSYVDKESERLLVAQLSALLPEAGFIAEEGSAVYKNEPYCWVIDPLDGTTNYIHDNAPYCVSIALRSCTELLLGVVYEVCRDECFYAWKGGKAWMNGDELHVSKIENIEEAFVITELPYNHRQYKRTAEYLLKQLYGVVGGIRMNGSAASALCYVAAGRFDAWAEAFIGKWDYSAAALIVLEAGGKVTDFFGSEYFIEGHHIIATNGPLHPVFQRLLKEMPPLEM

SEQ ID NO: 44198 - protein, 326 aa, Streptomyces coelicolor A3(2)
MRTVSEQQQPIPVIIDCDTGIDDALALLLAVRHPRLDLRAVTCVAGNTDVAGVVRNTLTVLERAGAPDVPVARGAERPLIEGVRTARHVHGADGMGDLGLPAPTRAPADVDAVTLLRREILASPRPVTLIPTAPLTNIALLLRTHPEVTGNIERIVFMGGAVATGNATPVAEFNVWHDPEAAAILLTAGVPITMYGLDVFERVIVPGTDVRRLRASAEPGTRLAGELLAHRGPATDAADPGGGLGDAGAVCAVIDPAGLTTHRLPVEVSLAPGPSRGQTLVDRRLRVGESELHDGMREQPLVDVALDVDVTRYVELYLGTVERTGA

SEQ ID NO: 44199 - protein, 403 aa, Nostoc sp. PCC 7120
MSFDWITPADRIQQLPPYVFARLDELKAKAREQGIDLIDLGMGNPDGATPQPVVDAAIQALQDPKNHGYPPFEGTASFRRAITNWYNRRYGVVLDPDSEALPLLGSKEGLSHLAIAYVNPGDVVLVPSPAYPAHFRGPVIAGGTVHSLILKPENDWLIDLTAIPEEVARKAKILYFNYPSNPTGATAPREFFEEIVAFARKYEILLVHDLCYAELAFDGYQPTSLLEIPGAKDIGVEFHTLSKTYNMAGWRVGFVVGNRHVIQGLRTLKTNLDYGIFAALQTAAETALQLPDIYLHEVQQRYRTRRDFLIQGLGELGWDVPKTKATMYLWVKCPVGMGSTDFALNLLQQTGVVVTPGNAFGVAGEGYVRISLIADCDRLGEALDRIKQAGIRYRPEALVSAPE

SEQ ID NO: 44200 - protein, 1001 aa, Medicago truncatula
MDQYEIMEQIGRGAFGAAILVNHKVEKKRYVLKKIRLARQTERCRRSAHQEMALIARIKHPYIVEFKEAWVEKGCYVCIVTGYCEGGDIAALMKKSNGAYFPEEKLCKWVTQLLLAVEYLHSNFVLHRDLKCSNIFLTKDHDVRLGDFGLAKTLKADDLTSSVVGTPNYMCPELLTDIPYGFKSDIWSLGCCIYEMAAHRPAFKAFDLDGLISKINRSSIGTLPPCYSPSLKTLIKGMLRKNPEHRPTASDILKHPYLQPYVHQYCSSLCSPSASSPEKPIFAVHVPRKNMAESEESNSSSSDKGGLMSNKRNVSKAAPMGDEKITEVDLSMIDDNGSDLIMPGRERNSSSNVNAKTDKQEVRKQTHLEHNSNVGYKLARTVKNVKMGPKHEKVKETRSPMRESLMKAGGISTQKINTETLSKFPKSDFGVNGLKPNVEVPTLAPSKATLHSSKRIQGSHTSKYQLPMIESTPKTKPRHKVTPPCGPIKQVVAVPGVSARPKQKTPPSLLKPPSFLGRIKQAGHDMPNAANDTERLDPNKIGQEAKMGHHRLPNGHLPHVSKEPLKAFESSTKGMQATSNSVSSSVSIQGFELFDFANTFIDLSEPTPPEHGSFNHTEIVGSRANSGGPDENISGESSQFTPTFQNTITRNEKVSPRLTLDHSVMYDSFLINQTTTSDVVECDVPSAKVTQEIKNLQDICKEMASINSLKHSLSISGKKSVCEVSPVSLPNNRPHKVSQPKLMYISTGDDKFMVRERVSSVAEIAPLNISTKISSQKVLEEEKGMVLQNLATERPASGHLPPAFDDVIHVIRHSSYRVGSDLPVKESTEKGVTNVDVGTLINVVKDDLEMRNVGTPLSLKSSNCSEVTSLNSNTTDNLEIRNLSLKSSISEHPDVEVLDVRIPDSLVSEPGSAKYNKYSIPTAKEEMPGNESFDVKSSKQRADALEGLLELSADLLQQNRLEELAVVLKPFGKDKVSSRETAIWLAKSLKGLMVEESGGRS

SEQ ID NO: 44201 - protein, 283 aa, Pseudomonas fluorescens
LEFIINRMIGVHPKALLNYDGLPLEIKESVDKRIAGYNDPVGFYVEKLVEGISTLAAAFYPKKVIVRLSDFKSNEYANLIGGKLYEPEEENPMLGFRGASRYISEAFRDCFELECRALKRVRNEMGLTNVEIMVPFVRTLGEASQVVDLLAENGLSRGENGLRVIMMCELPSNAILAEEFLEFFDGFSIGSNDLTQLTLGLDRDSGIIAHLFDERNPAVKKLLANAIQACNKAGKYIGICGQGPSDHPDLAKWLMEQGIESVSLNPDSVLETWFFLAEGQASA

SEQ ID NO: 44202 - protein, 522 aa, Oryza sativa Japonica Group
MATVESSTAPGVAVAAAVVLVLVWRPYAVARAFGRQRIRGPAYRLFVGSDGEANAMRAATRGDVLDRRCHDIVPRVMPHYRAWMSRYGKVFVSWSGATPALCVGDYAMVKQILSDRTGLYGKPEPEPSILALIGNGLIFIGGDDWARHRRVVHPAFAMDKLKMMAKTMADCAREVIREWEARATADGERRVQVEVGGQLQELTADVISHTAFGSSYREGKEVFVAQRELQSIAFSAINSTRFPGSQYIPTKTNLRRRHLAKKVRGTLMAIIRERQAAAAKEDSGHGNDLLGLMLEANATDACGSGGEKSMTMDEIVDECKTFFFAGHDTTSHLLTWAMFLLGTHPEWQHRLREEVLRECGGGGDTEALPNGDALNKLKLMTMVLYETLRLYGPVSLMARTATADAELGGVRVPKGTMTMIPMAILHRDADVWGAGAGEFDPLRFRGGVNKAAAHAGALLAFSLGQRSCIGQDFAMMEAKTTLAMILRRFAFEVSPEYVHAPLDLLTLQPKCGLPMVLKLLDQ

SEQ ID NO: 44203 - protein, 324 aa, Triticum aestivum
LGTGGFGRVYKGVLPKSNLEIAVKRVSHDSKQGMKEFIAEVVSLGHLRHRNLVQLLGYCRRQGELLLVYDCMPNGSLDKYLHDKTKPVLDWSQRFQIIRGVASGLLYLHEDWDKIVIHRDIKASNVLLDADMNGRLGDFGLARLYDHGVDPQTTHVVGTMGYLAPELVRTGKATPVTDVFAFGVFVLEVTCGRRPLGCIAADDQNVLLDWVQEHERRRAGLDTVDPRLCGKYDADEARLAIKLGLMCAHPLPDARPGMRQVTQYLEGEATVPEVVPTFLSYTTLALMQNDGFDSFAMSFPSTVTTDASPTSGDVSAVSGLSGGR

SEQ ID NO: 44204 - protein, 327 aa, Salinibacter ruber DSM 13855
MTVVVTGGAGFIGARLCRRLLKVGHTVVAIDNFDPFYPRAMKEEGIEDFPRESFSLVETDICNTGTVLQALHARDVDAVIHLAAKAGVRPSIESPGAYEQANVAGTQSMLEVAQRLGVDTFLFGSSSSVYGNNEKVPFSEEDPVRHPISPYAATKRSGELLAHTFHHLYDMTVHCLRFFTVYGPRQRPDLAIHKFARQLLTDQPITMYGDGTSSRDYTYVDDIVDGVMRSLHRAKSLEAPEYEIINLGGSETTQLKDLISGIADAMGITPEIKQLPEQPGDVERTYADISKAEELLGYEPDTPIQVGLQKFVSWVEAYYADRPVLDV

SEQ ID NO: 44205 - protein, 143 aa, Zea mays
  misc_feature (91)..(91): Xaa can be any naturally occurring amino acid
  misc_feature (113)..(113): Xaa can be any naturally occurring amino acid
MEDGIGPVNRFPCNANFVRFFMFPIPVGMVPLRRFYVASVYAPISFPPLPLIVLKNRDGEQSTIAAVGSLKSMDPNRIILKKIVLTMYPQXSNLKSIVLYMFHDPNDVKWFKXQPIERWTKHGRRGRIMETVGTHVAHCQWCV

SEQ ID NO: 44206 - protein, 206 aa, Zea mays
MAASARTTSSLPYLVAVSSPAAHRHGASHPIRASVGEATMDVVSEAELREKGFLGMRKTKLVCTVGPACVEALPALARGGMGVARINLCHGGREWHRAAMRSVRRLNEEGGFCVTLMVDTEGSQLLVADHGGATSVKAEDGSEWIFTNKKADEAHQFTMHVNFDKFSEGILVGDELVIDGGMATFEVTEKIGNDLRCKCTDPGLLL

SEQ ID NO: 44207 - protein, 364 aa, Picrophilus torridus DSM 9790
MLLIPGPVEVTRPVMDAGSYLCNHRSDEFRAIVNNIENSLNSLTGSHRAVVTTGSGTLAVESMVFSLINKNDKVVALTQGPFGDRLAASVRRASKNAEIINIENKNIMEIIEEKDFDKLFMVHNETGYGVAVRNINDVARAVKNKGSRIIIDSVSGYLGYKIDFSNIYAMATGSQKNIAALPGTGIDFLSKEAVDDLYSNDVDAPFYLDLKTSLDFLEKNETPYTPSTGAFKSLEVALDEVKKEGMENRVKRIERASKFIRSILNENNIEVNGDDSNYSNTVVCFKPRTDPDDVIKRLASENIIITKGMGSMKNYLRIGTMGIINSHFISRFLNSYFKIEKINDYVDESEVKCDLPEFLEIIEA

SEQ ID NO: 44208 - protein, 126 aa, Aspergillus oryzae
MSGEPNAAWPLADESLTQNLLDLVQQASHYRQLKKGANEATKTLNRGTSEIVILAADTNPLAILLHIPLLCEDKNTPYVFVPSKLALGRATGVSRPVIAASITTNEASDLMGQIRTIKDKVERLMI

SEQ ID NO: 44209 - protein, 298 aa, Anabaena variabilis ATCC 29413
MQANVFTNVILPLALAIIMLGMGLSLQIEDFKRVTKYPKAVSIGSITQLILLPIIGFLVAKAVPMQPEIAVGLVILSLCPGGPSSNMITYLAKGDVALSVTLTVVSSMVTIFTIPIFANLALQHFLGQTAAIALPIGSTMLQIFLITIVPIGLGMYIKRIFPATALRLEKVTNRLAIAFLALIILILVIREWNRIPGFIVQVGVGVVILNILAMLSGWYMSKFFQLNIPQQICVAIEVGIQNGTLAIAITAGLLKNQDMAIPAAIYSLFMNLTAFVAIYYGRKLSAINSVSNNLVGKV

SEQ ID NO: 44210 - protein, 481 aa, Oryza sativa Japonica Group
MVKICCLGAGYVGGPTMAVIALKCPDVEVVVVDISAARIDAWNSDALPIYEPGLDDVVRRCRGRNLFFSSDVERHVGEADIVFVSVNTPTKARGLGAGKAADLTYWESAARMIAAVATSDKVVVEKSTVPVKTAEAIEKILDHNGRDGVGFQILSNPEFLAEGTAIRDLLAPDRVLIGGRETAAGRAAVQALKDVYTRWVPEERILTTNLWSAELSKLAANAFLAQRISSVNAMSALCEATGADVAEVAYAVGKDSRIGAKFLNASVGFGGSCFQKDILNLVYICECNGLPEVANYWKQVIKINDYQKSRFVNRVVSSMFNTVAGKKIAVLGFAFKKDTGDTRETPAIDVCKGLIGDKAKVSIYDPQVTEDQVQRDLAMSKFDWDHPVHLQPMSPTAIKQVSVAWDAYEAARAAHGVCILTEWDEFRSLDYARIYGGMQKPAFVFDGRNVVDAEKLREIGFIVYSIGKPLDAWLKDMPAVA

SEQ ID NO: 44211 - protein, 308 aa, Bacillus clausii KSM-K16
MEVYRHIHELIGSTPMLELTAFPLPRRVRLFAKLEYTNPGGSIKDRLGIKLLKEAIATGKITPKGTLIEPTAGNTGIALALAAIGTDVKVICVVPKAFSIEKQQLMRALGAVIVHTPSEHGMKGAIAKAKALEQELDDAYCPQQFSNKANPLAYYETLGPEIVHELDGKVDVFVAGAGTGGTFSGTAAYLKEVIPGIRTVVVEPEGSILNGGEPGPHRTEGIGMEFIPDFVNRSLFEAIYTISDNQAFKRTRELAEHQGVLVGSSSGAALEAALREAEMADEGAHIVTVFPDGAERYLSKGIYEEEPL

SEQ ID NO: 44212 - protein, 224 aa, Chlamydomonas reinhardtii
MAALQSRVGRCVGASARRQHSLVASRVAVPRPSVSVVPQVQQEAHHVQGVAQIPSSRASCIARATYHGSVMAEPGSKYAVVVARFNSLITKGLLEGAMETFEAHGVPKENVDVAWVPGSFEMPVIAKSMAKSGKYAGVVCIGAVIRGATTHYDAVVSAATSGVLNCSVDTGVPVVFGVLTTDDLEQALDRTGGKVGNKGGEAALTAVETATLLAKLKKEGKASW

SEQ ID NO: 44213 - protein, 331 aa, Synechococcus sp. RS9916
MTSFLTAARAEQEKIHQDNRRLRLFSGTANAALSQEISAYLGVPDGPRVCKRFADGELYVQIQESIRGCDVFLIQPTCAPVNDHLMELLIMVDACRRASARQITAVVPYYGYARADRKTAGRESITAKLTANLLAKSGVDRVLAMDLHSAQIQGYFDIPCDHIYGSPVLVDYLSAQELGEVVVVSPDVGGVARARAFAKQMNDAPLAIIDKRRTGHNKAESLTVIGDVEGKTAILIDDMIDTGGTICSGARLLRQQGAKRVIACATHAVFSPPACERLSSEGLFEQVVVTNSIPIPADRTFPQLKVLSVANMLGEAIWRIHEESSVSSMFR

SEQ ID NO: 44214 - protein, 499 aa, Photobacterium sp. SKA34
MVQPENNSIVIFGASGDLTHRKLIPAFYHLYANGLLPEDFAILGVSRTSYSDQEFRDKLKQSLTENEKIDEETLVNFCQHLYYQALNTSDKDEYAVLKERLDTFKETHNTQGNAVFYLATPPSLYGVIPECLAAHGLNDETEGWKNLIVEKPFGYDLESAISLDKQIHACFQEHQIYRIDHYLGKETVQNLLVFRFANGMFEPLWNRNFIDYVEITASESLGVEDRGGYYDGAGAVRDMFQNHLLQVLAMVGMESPAAINADSIRDEVVKVMQSFKPLSEDDLKNNLVLGQYTESDARGKHFLGYRQEPGVAEDSRTETYVGMKMFIQNWRWNGVPFYVRTGKRLPTRVTEVVIHFKKTPHPVFGENAPENKLIIRIQPDEGILMSFGLKKPGAGFESQEVSMDFHYDKLEETNMLTAYERLLLDCMKQDATLFARTDAVRACWKFVQPILEYKENPEHLFGYAAGTWGPKQADDLLASSNREWRFPCKNLANTDYCEL

SEQ ID NO: 44215 - protein, 482 aa, Photobacterium sp. SKA34
MKGDIGVIGLAVMGQNLILNMNDHGFNVVAYNRTVAKVEEFLEGPAKGTNIIGATSLEDLVAKLEAPRKVMLMVRAGDVVDAFIDQLIPLLDEGDIIIDGGNTNYPDTNRRVAHCREKGIYFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDLGIPLTLISESVFSRCLSALKDQRVEAATLFGKTITPVEGDKQEWVDALRQALLASKIISYAQGFMLMREASNENGWDLNYGNVALMWRGGCIIRSAFLSNIRDAYEANPDIAFLGSDEYFKNILQSSLAAWRKVAAKSLESGIPMPCTISALSFLDGFTTARLPANLLQAQRDYFGAHTYERTDRPRGEFFHTNWTGTGGNTASTTYDV

SEQ ID NO: 44216 - protein, 496 aa, Taiwanofungus camphoratus
MDTFSQYLYAFLCGTIVLSYIRRRYDPLNSIPTIGPSAPLLSYLGVYRYFRHAQDMLHEGYEKYKGSVFKVPRLDQWIVVVCGAKMNEELRRVPEDELSFLAASEELMQAKYTVAPLLADHLINVTVMRGQLTRNLATLIPGIVDEIQTTLQDLIRVEGDEWVHIDALQTMVKVVGRASNRIFVGLPLSRNPSYLEIVMNFYLDVVKGMTILSIVPKPLKPLVGPLFPWSRRATRRLSVLLKPVIEERQMMLREREGDWADKPNDMLMWLIEEAGAIDGSVELIVQGILHSNFASTHTSAISITHALYHLAAEPKYLQPLREEIESVIAEYGWSKLGIGKMWQLDSFMRESQRMNGASAISVIRKALKDVTFSDGTHIPPGTLVCAASTATHYDEENYVNANVFDPFRFSKMRGEESERVKHQYVSTSADYIAFGHGKHACPGRFFAAYELKAVLAHIILNYDVKFEGEATRPDNVWPGITIIPAPGAKVMFRKRQ

SEQ ID NO: 44217 - protein, 376 aa, Coprinopsis cinerea okayama7#130
MPENTQKKTVLVLGAGNFGSCLASHLGDVQHNVYMWAREENIVKHFNEHKRNPVYLQDHEFPRNITAIGPELPTKEFIATMDVLIFAIPTQANLEALRPRLDTANLPLLIFVNKGIEIGTHALTLEIIADTCGSEIAKASTFISGPSFAKEIVQRQPTSVSVASFTEEEADKAANLFHQPHFRCYTGGDPIGIELSGALKNVYAIAAGMSDGLGFENNTRAMIITRGLAEMTCIGTAYGASPLTFLGLSGVGDLFLTCSSSNSRNYTVGYRLGKGESLDVIMKTLGSVAEGVSTTKGAKKIIDELGVNAPIANSVYDVLYNGKDTRAAMSDLLKLPPSRELELPPIIGGPARQLNKKLGLGTPEAVTPPLQFQSSL

SEQ ID NO: 44218 - protein, 335 aa, Coprinopsis cinerea okayama7#130
MTSFQDRTTEFRTCVESIRSRSAPGARAEAKQRLLHQPNGKPAVKSEFSRIASSIGKDISNTSLKLNKLAQLAKRKTLFDDRPVEISELTFIVKQDIANINKQIAALQNHVKQGQASTSIEGKQIDEHNRNVIMLLQSKLASISMTFKDVLEVRTQNMKESKTRTEQFMYTASSAASTQPPSLLYGSKTNPDPMGDGSPAKFDPKGKGRAAQNGDVLALDLDSAEEGSANGGAFQQMQLIEQQDSYIQQRSSAIESIETTIAELGQIFTQLAHMVAEQRETVQRIDADTQDIADNVRMGHNELLKYWGRVSNDRWLMLKVFGVLIVFFLLFILVS

SEQ ID NO: 44219 - protein, 142 aa, Staphylococcus epidermidis ATCC 12228
MIKKNKEELNDMEYLVTQENGTEPPFQNEYWNHFEKGIYVDKLSGKPLFTSEDKFESNCGWPSFSKALNDDEIVELVDKSFGMIRTEVRSEKANSHLGHVFNDGPKEKGGLRYCINSAAIQFIPYDKLEELGYGDLIKHFKK

SEQ ID NO: 44220 - protein, 520 aa, Aspergillus oryzae
MATRKPQPQLNIHWTNIVSGRGISQQHTRPRTPPRSSSTNPQNFSPSSHQPASWSASPRRLYTSIINQGVDSWSRDQMEDEEDEEDEDIVYDDDEDEFGLPSITSMRKKPKQNVDPLPSRIVDPGGRIGGSASALSVGLGNNPANALNLIDHAPPPKSATPKEMDQYSSRISRINKFKRLLQTSTVPLTELRNLAWSGVPDEVRAMTWQLLLGYLPTNCERRISTLERKRKEYLDGVRQAFERGSTTGAGNPTASTTGRGRGLDEAIWHQISIDVPRTCPHIQLYGYEATQRSLERILYVWAIRHPASGYVQGINDLATPFWQVFLGVYVTDLNVEEGMDPGQLPKSVLDAVEADTFWCLTKLLDGIQDNYIYAQPGIHRQVRALRDLTMRIDATLAKHLENEGVEFMQFSFRWMNCLLMREMSVQNTIRMWDTYMAEEQGFSRFHLYVCAAFLVKWSDQLVKMDFQEVMMFLQALPTKDWTEQDIELLLSEAFIWQSLFQDSRAHLRSTGDPSPDNGLQ

SEQ ID NO: 44221 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAVCGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 44222 - protein, 445 aa, Aspergillus oryzae
MFIGGLNWETTDQSLKDYFSQFGEVQECTVMRDSATGRSRGFGFLTFRDPKTVNTVMVKEHYLDGKIIDPKRAIPRDEQEKTSKIFVGGVSQEANEQDFKQFFMQFGRVVDATLMIDKDTGRPRGFGFVTFDSEAAVEAALSRPLEILGKPIEVKKAQPRGNLRDEEDRRNRRGRDGFREGAQIGSDGSQQQGSQGPAGMPGGLTPQMMAQYWQRMQQYFALMQQQMAVAAQGQGMGAMGMGGMNPAMMQQMQMKQMQQMQMGNSQQQGSMSPPSQSQTPQMQNMMNSTMMQQMQQMQNQGQGGQMGNAINIGSSSPGNVSMSGNYSGPRGGPGYNAHEQIAFEQQKYEQQQARRAMENRAFSPYQQGGPTSWEGMYDEVPQPNIPTGPQAMNRAGSMGRGPTPQPQSAAPANAPTGPKNAGKPGANYRGGGRGGHRGFHPYARG

SEQ ID NO: 44223 - protein, 223 aa, Brassica napus
  misc_feature (210)..(210): Xaa can be any naturally occurring amino acid
RPTRPQTSSFNSLIMVFEASIAIFCFIPLCFFLFMNPRDNLLRNWPVLGMLPGLLVEFHRIYEFSVEILRSSNLTFTFKGPWYSGMDMLFTVDQANIHHIVSSNLSNYTKGPDFKEVFDVLGDGILTADSELWKNLRKASKVMFSHQGFRRLLMSTTRRKINDGLIPLFNHLAEEGAVVDLQDVFVRVTFDTTLVMVTGSADPRSLCVEXPEADEFAKAPNDV

SEQ ID NO: 44224 - protein, 517 aa, Staphylococcus aureus subsp. aureus MW2
MSEEKHVVEHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAILAGSDLLGTNHALSLAFSGYATSAVALVAAALFLAAAMQETNLHKRLALLVLSIVGDKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSVALYFIMIKVMPPEINTIEGGKDLIKEELHKLGPVSPREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKAGIPLTIVGYILVIVFSMTYWKWLGLL

SEQ ID NO: 44225 - protein, 467 aa, uncultured archaeon GZfos18H11
MRIVMKFGGTAIANGEKIKTAANLVMQSKEAVENMEIVVVTSAIYAVTDTIYEHANRIAEEGKVEKVKEFVGELRNKHNMVASVAIGDTQVLKKVKGEIKERIAEMEKALIGICLLGELTLRSLDYIGSFGERLAAPILAGAIQSVGIDAVHFTGGDIGIITNAEYGSAQLSGGVEQEVRARIMPLLRDKIPVVCGFTGETKDGKITTLGRGGSDYTATIIGAAIDADEIWLWKDTEGIMSADPKRIKNARKIPYMSYIEAMELSYFGAAVLHPRAIEPAMKKKIPIRVKNLLNPDDEGTLIGEEQEKTKKAAKAITLIENTSIVNIAGTGIGSISDVASRIFSVLAAKNVDIIMISHGSSERTVSLVIDSAQLERAIDAIHSIPAVDTVIRDISYNSNVCTVGVVGVGMAGTVGVAGKVFSALGNEGISVKMISQGSSEFNISFVVQKEEAYKAAQAIHDVFEMGS

SEQ ID NO: 44226 - protein, 508 aa, Synechococcus sp. RS9916
MSATMTTNPLRVGLRQERVIAPQCLVIFGASGDLTHRKLVPALFELFLQRRLPSEFAVLGCARRPWSDEEFRSKMAAAMGDKVSENPQAWEQFSAGMFYEPVDLQQTQDVVRLGTRLDAIDRLRATRNNRTFYLSVSPKFYGSGCRALADAGLLRDPERSRVVIEKPFGRDYSSAQALNKVVQSCGQENQIFRIDHYLGKETVQNIMVLRFANTIFEPIWNRNYISSVQITAAETVGVEERAGYYEGSGALRDMVQNHLTQMLAITAMETPGRFDPEAIRSEKAKVLQAARLADELEPWNCCIRGQYGPGGSQAAPLKGYREEPGVDPNSTTETYVAMKLFIDNWRWQGVPFYVRTGKRLAKRLSEVVLTFREAPVHLFDAAGGSPTANQLILRIQPDEGAEFRFEVKSPGSGMRSRPVEMEFSYDESFGEPSDEGYVRLLADAMLSDPTLFTRSDEVEAAWRLYTPLLELIEDSPWRLPIHPYESRTWGPAAADSMLARDGLLWRRP

SEQ ID NO: 44227 - protein, 344 aa, Triticum aestivum
MGSSNQEPGVSLRTDGWLQKPIDSLMRIPDKIQSSLKLHFGRFLKTDGVSGGGIKAQMPPEKVRVACTAAAASEVSLDRQLQAWRDNPSWTDQPPEIKVTVPQGSLCNLNLRFQAGLPPDAVYNIIIDPENKRVFKNIKEVVSRNVLLDEGSRQIVEVEQAAIWKFLWWSGILSVHVFVDQDRRNHTVKFKQGRSGFMKKFEGCWKIEPLFVDKEACLPLDPHTLEEYDSCSAGRGRVGSAITLDQLIEPALLPPQPIAWYVRGITTRTTEMLVNDLIAETARLRGLASNGDANEHTEENRDVNGDVLTEDCNDVKERWRQRRKAGRHGSSLRLTQDNRGRISY

SEQ ID NO: 44228 - protein, 388 aa, Escherichia coli O157:H7 EDL933
MKITISGTGYVGLSNGLLIAQNHEVVALDILPSRVAMLNDRISPIVDKEIQQFLQSDKIHFNATLDKNEAYRDADYVIIATPTDYDPKTNYFNTSSVESVIKDVVEINPYAVMVIKSTVPVGFTEAMHKKYRTENIIFSPEFLREGKALYDNLHPSRIVIGERSERAERFAALLQEGAIKQNIPTLFTDSTEAEAIKLFANTYLAMRVAYFNELDSYAESLGLNSRQIIEGVCLDPRIGNHYNNPSFGYGGYCLPKDTKQLLANYQSVPNNLISAIVDANRTRKDFIADAILSRKPQVVGIYRLIMKSGSDNFRASSIQGIMKRIKAKGVEVIIYEPVMKEDSFFNSRLERDLATFKQQADVIISNRMAEELRDVADKVYTRDLFGSD

SEQ ID NO: 44229 - protein, 287 aa, Rhodopirellula baltica SH 1
MDQAIAKADTLIEAMGWIRRFRGKTTVIKLGGSLLEDREALQHLLLDVIFMETVGLRPVVVHGGGKAITEAMAKAGIEAQFIRGRRVTDEKSLEVVEQVLAGELNVELTEMMERFGGRAVNLSPRTTCVLKGKKLIDPEGDDLGFVGEVTEVDRDVIESLAYTDQVAVIPSLCTDDKGQLYNVNADTAAMAVAQSLGADKLVFLSDVNGVRRDPEDPATIIPALSAEEARQLIADGVIKSGMIPKVEACLETLGRGVQKVHIIDGRLRHSLLLEIFTTDGVGTEIHQ

SEQ ID NO: 44230 - protein, 468 aa, Escherichia coli O157:H7 EDL933
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 44231 - protein, 335 aa, Brucella melitensis 16M
MTILVTGGAGYIGSHTCVQLIEAGHEVVVVDNFDNSHPEALHRIEKITGRAPRREPGDIRDRALMEQMIKRHKCTAVIHFAGLKAVGESSEKPLLYYDCNVLGTLRLLQAMEATGVKKLVFSSSATVYGDPDKLPITEDQPLSATNPYGRTKLVIEDMLRDLYNSDNSWAIAILRYFNPVGAHESGLIGEDPKGIPNNLMPIIAQVATGRREKLNIWGNDYPTPDGTGVRDYIHVNDLAAGHLKALKKLDKPKCFAVNLGTGQGYSVLDVIKAFEHVSNREIKYEIAPRRPGDVAECYADPGFAKKFLGWSAEKNLREMCQDMWNWQSKNPNGYE

SEQ ID NO: 44232 - protein, 317 aa, Synechococcus sp. RS9916
MTAAATSSESARSGGDQQAFDFKAYLGSQKQLVEAALDDSLGPERPESLREAMRYSLLAGGKRLRPILCLAACELAGGDPALAMPTAVALEMIHTMSLIHDDLPAMDNDDLRRGRPTNHKVYGDAVAILAGDALLTRAFEMVSLRSPGVPAERLLKVVAELSLVAGAPGLVGGQVVDLECEGKDVDLDTLEYIHLHKTGALLKACVITGALIGGADEAQLDSLRTYARGIGLAFQIVDDILDVTASSDVLGKTAGKDLIADKTTYPKLLGLEESRLRAKGLIQEAKTSLDAFKPVGGGSVQAAPLLALADYVIGRDC

SEQ ID NO: 44233 - protein, 184 aa, Glycine max
MSWPFLFDLQNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 44234 - protein, 255 aa, Rhodopseudomonas palustris
MDRRNILKAFAGLALCPLCATAGAAAEGAYHWGYEGEGGPAKWGELDPANQICSIGVQQSPVDIRSTVSANLFPLQVQWADTADTIINNGHTIQLNVAEGSTLKLGGATFKLVQFHFHRPSEHQIDGKSFPMEVHFVHRMDSGTLGVVGVVGVLMQEGAANAAFAKIVATMPQSEGPAVKADAAINPNALLPAKLGYYRYEGSLTTPPCSEVVDWMVLTDPITVAAEDVAAFAKLYPMNARPVQKDNRRFVLQSN

SEQ ID NO: 44235 - protein, 377 aa, Coprinopsis cinerea okayama7#130
MKAVNTRIILGFIAALAAVSTTPTALGSTLGPRDGSLTRRQAVCNGHAELCERGYGTLAYVGTHNSYAVDVNNLAANQDHDITQQLNDGVRMLQMQAHDESGVIKLCHTDCRLYDGGTLENYLRTVKTWLDANPNEVLSLLIVNSDNVPAARYAEVYANTGMDVVSYSPPTSPLPALEWPTLGSLIGSGQRVITFLSTTANPEIPYLIDQFPNVWETKFNVVDQSNFDCQVDRSRGDPSTSLFLINHYLDKLVLGQPVPDLDKLDATNAVSGFGSLGAHVETCRAVQGRPPNFLLVDFYEYGGGSVFEVAAQINGVPYNPATPVASPRPTAVGTQTAGRDATGGASGSAPALLQGSHLVALLSMVVGTVVIAPLLVF

SEQ ID NO: 44236 - protein, 195 aa, Triticum aestivum
  misc_feature (97)..(97): Xaa can be any naturally occurring amino acid
  misc_feature (100)..(100): Xaa can be any naturally occurring amino acid
MAPTVMASSATSVAPFQGLKSTAGLPVSRRSNGASLGSVSNGGRIRCMQVWPIEGIKKFETLSYLPPLKHGGPPQSRSDYLIRSKWVPCLRFKQVGXIFXREHNAPPGTTDGRYWDMWNCLFRVHRPTQVINEVEEARRIPDAYSASSVRHIASACVSSRLNHGLKIRKANSYHTGIINAFSLHPKCLVPLLLMS

SEQ ID NO: 44237 - protein, 511 aa, Oryza sativa
MARMGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAGGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGAAPTRPRKAGSLTSCDSAPSLLEGRFGLGGSSRRRSSLNAFDIISFSPGFDLSGLFDQDDGGGAGAGSIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 44238 - protein, 260 aa, Picrophilus torridus DSM 9790
MPMDTLAVISGLKRDMILNSIKRGKRLDGRGLNDFRDIKIFENYIPKASGSAMVELGRTKVVAGVKIEEGEPFPDTPDQGVMALNIEMLPMAFPTFEAGPPGEEAIEYSRVVDRGIRESKMIDVTRLVIEPGTKVWMVFIDIDIINYAGNIIDASTIAAVAALRNAIVPASRIGGEDFKLPVNANPVSVTMAKIGDELVIDPDLEEEQVSNGRITITMAEDDHIHAIQKGDVGEFTMEDIRKAIKASRDTGNRIRSQYFR

SEQ ID NO: 44239 - protein, 239 aa, Picrophilus torridus DSM 9790
MEEVKLINDDGLRLDGRAFNEMRPIRITTGVVDNADGSAYIEWGANKIVVAVYVREAYPKHAQNIDKAIVKARYNMAGFSVEERKRPGPDRRTMEISKLISEALESAIMVERLPRAEIDVYIEVLEADAGTRIASLTAASVAVADAGIPMKDLPVGCTAGKANGKVVLDLSKDEDNYGDADIPMAILPKSGKIILLQLDGDVSEQELEEAMEMMLGAMKNISRIQREALMNRYMIEDGE

SEQ ID NO: 44240 - protein, 420 aa, Zea mays
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFVFTLGKLMNAKEDYGELSSIARQGSGSACRSIYGGFVKWCMGEKDDGSDSIAVQLADETHWNDLVIIIAVVSSKQKETSSTSGMRDSVETSPLLQYRAQTVVPGRVLKMEEAIKNRDFESFAKLTCADSNQFHAVCLDTSPPIFYMNDTSHRIISLVEKWNHSEGTPQVAYTFDAGPNAVLIAQNRKTAAHLLQKLLYYFPPQDNDLSSYLVGDKSILGVAGLHSMKDVEALPAPPETKIPDQKFKGDVSYFICSRLGAGPKVVSDEGQALIDSVTGLPKGV

SEQ ID NO: 44241 - protein, 477 aa, Sinorhizobium meliloti 1021
MLDKRKFYIDGKWVEPATQNDLLVLNPATEKPIAVISLGTAVDVDRAVAAAKKAFASYSRTSVEERLALLEKLLAIYKRRYDEMADTITAELGAPRTMSHEQQADVGVGHLQGFIDALKRLKLREKLPNGDTLLREPIGVCGLITPWNWPVNQIALKVVPALATGCTCVLKPSEFTPLNAMLYAEMIEEAGFPAGVFNLVNGDGIHAGAALSKHKDIDMMSFTGSTRAGIAVSKDAADTVKRVTLELGGKSPNIVFADADIEERVTASILECFNNSGQSCDAPTRMLVERSAYDEVVEIARRVGMEARVGDPTKVGSHIGPLVSHIQFERVQALIEAGVAEGATLLAGGPGKPEGFETGYFVQPTIFADVDNSMRIAREEVFGPVLSIIPFDTEEEAIAIANDTNYGLAAYVQTRDRERAERVASRLRAGMVHINGGPHRYGSPFGGYKQSGNGREGGMFGLEDFLEVKTVHLPDAA

SEQ ID NO: 44242 - protein, 681 aa, Nostoc sp. PCC 7120
MATFTVTTLNDVVNPNDGLLSLREAVTAAEALPGTDTIAINGIALLNSPVVIRQGNSINFQGNGTSFTGFNGQGRTSLFLIDNSTVTFNNLQINRGLAQGGNGSRGGGGGLGAGGGLFLNPGANVTADNVVFFDNRAVGGNSFTGRGDGGRGGNDSSAGSNGFPGGSGGLPSFFAIGGIVPTSGGNGGAAGRIVGSTGLGAGGGVSGSSGGFGVGGGSGGGGGGGAGGAGAFRNATGGGGGGFGGYGGGGGGGGGGGGGGANVLGGQARPGGAGGLGGAAGAFAGAGRDGANGGNGRSTFNGNSPGNGGVGGQGGGGAGLGGAVFVSNSATFNVRNSSFLFNSAVGGSGFQNGQGRGGAIFVQSGGLLRDMGGVRFIQNSASTANPDSNIYPVKVNRGDRTIEVEGFQGVGRGSNPSLEVRETFDELIFTGEGLVAKNLLLTQTGDDLVVSFEGVDDTQVILKDFALENLDNLPIPGGQHGQIGNIMFDGDETLQDSFDVFDADSTQNRIWNRNTVTFLNDLDNHVRGFDNSDDVINGQGGNDIIGGLSGDDILRGGEGNDILYAGTGTDILVGGLGNDTLYLGSDRHIDTVIYRQGDGSDVIHQFQRGAGGDLLQFEGIEAIDVVVHGRNTYFHLGDGVTGNTGFGSGELLAELRGVGGFTSDNIGLNLASGNTAQFLFA

SEQ ID NO: 44243 - protein, 141 aa, Brassica napus
MKGIARIVNSLSRLGGREIISRGSSSSSSSLLLVSRRSLFISAATHFPTNSRDLTSSSRSSSLLPQKWAFLGGGQRRTMFIQTQSTPNPSSLMFYPGKPVMEVGSADFPNVRSALGSPLAKSIYSIDGGVPGFLGSDFVTV

SEQ ID NO: 44244 - protein, 416 aa, Picea sitchensis
MAALSRFFPALRRELGRLSAGSASRGRFLSSDASGYHLGNGPSSMRAAVFWEPGRPLSIEDFHMPRPKAGEVLIKTKACGVCHSDLHVMNGDLPFARPCVVGHEITGEVVEHGVHTESGIIKRFPIGAHVVGAFIMPCGNCFYCVKGQEDLCEPFFTYNRAKGTLYDGETRLFLRSNGKPVYMYSMGGLAEYCVVPATALAVLPASLPYTESAILGCAAFTAYGAMRHAADMRAGETVAVIGIGGVGSSCLQIAKAFGGSKIIAVDVQDEKLENARKLGATHTVNASKVNVVDTIKEITGGRGVDIAVEALGKPETFMQTALSVMDGGKAVMIGLAASGAKAEIDITRLVRRQIKILGSYGGRARQDLPILVGLAETGIFNLEAAVSKKCTFDEAGAVYDALNRGEIVGRAVVEIM

SEQ ID NO: 44245 - protein, 167 aa, Burkholderia xenovorans LB400
MIQTGDKLPDATLFELIEDERAGCTIGPNSFDVREQTAGKRVVIFGLPGAFTPTCSAKHVPGYVEHAGQLRALGIDEIWCVSVNDAFVMGAWGRDQHASGKVRMMADGSAAFTRALGLEQDLSARGMGIRSQRYAMVVDDGVVKTLNVEAAGKFEVSDAGSILATLS

SEQ ID NO: 44246 - protein, 279 aa, Staphylococcus aureus subsp. aureus MW2
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDNPVIVKIAEKYHKTPAQVVLRWHLAHNRIIIPKSQTPKRIQENIDILDFNLELTEVAEIDALNRNARQGKNPDDVKIGDLK

SEQ ID NO: 44247 - protein, 187 aa, Delftia acidovorans
MSVEGSGNDLVQVVSLLGAAVVAVPLFKKLGLGSVLGYLAAGLAIGPFGLKLFSDPQAILHTAELGVVMFLFVIGLEMQPSHLWSLRRQIFGLGSLQCIVCGALLTLVGMAFGFPLAVSFVCAMGFVLTSTAIVMQLLGERGDIAAPRGQRIVSILLFEDLLIVPLLAAVAFIAPPALDAQAVVPSR

SEQ ID NO: 44248 - protein, 313 aa, Rhodopirellula baltica SH 1
MMRHLLTLFDLTPQELRQILATAQTLKAKLKQGERPAILERYTLALLFEKPSLRTRVSFETGMNHLGGSSLFLGDDVGWGKRESPSDFTRVLGQFVDAVACRAKSHERVEQLAEYNAVPIINSLTDLCHPCQAIADVLTLLENFGEVKGRHMVFVGDGNNVSRSLALACAMLNIQFTLARPDGYELDQPWLDRILAKYPNAKMNQTADPIAAVQSADAIYTDVWTSMGQEAESIARRAAFKNFQVNEQLLEAAPKTARVLHCLPAVRGEEITDAVMDGPQSDVIEQAGNRMHAQKALMIQLLRPEWIAENIRV

SEQ ID NO: 44249 - protein, 376 aa, Photobacterium sp. SKA34
MTDKFIKSKAAIAWGPKQPLSIEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPDISLAKISKEAPLEEVCLLGCGVTTGMGAVLNTAKVEEGSTVAVFGLGGIGLAAIIGATMAKASRIIAIDINEDKFELARKLGATECINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 44250 - protein, 482 aa, Escherichia coli O157:H7 EDL933
MSDAPIIAVVMAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYMTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 44251 - protein, 447 aa, Zea mays
MAAAAAVFFPSTPNPRHRLAAAARRPPPSFTGATDAVPLPEDEDSSDDDADDDGAPRRSGRRDRRRAVRVAWEKLVRWSRSWRRRNRSDVLETTRKVVVLGGGSFGTAMAAHVAAKKADLEVAMLLRDDHICRSINNAHVNWLVTSAAFVFSIHELLAFYCSKYLSEHRLPENIVATTSAADALAGADFCFHAVPVQFSSSFLESISTHVDPKLPFISLSKGLELNTLRTMSTIIPRALGNRRQPFVVLSGPSFAVELMNKLPTAMVVASKDNKLASSVQQLLASPNLRISTSSDVTGVEIAGALKNVLAIAAGIVEGMSLGNNCMAALVAQGCSEIRWLATKMGAKPTTLSGLSGSGDIMLTCFVNLSRNRTVGLRLGSGEKLDRIMGSMNQVAEGVSTAGAVIALAQKYKVKMPVLTAVARIIDNELTPTKAVLELMNLPQVEEV

SEQ ID NO: 44252 - protein, 240 aa, Oryza sativa Japonica Group
MAHGGGEEEEERVLSHGDVVLFRCDLTILRGPHFLNDRIIAFYLAHLAADHDADDDLLLLPPSIPYLLSNLPDPASVAAVADPLRLASRRLVLLPVNDNPDVSHAEGGSHWTLLVLDNSNAVSGPRFVHHDSLPPTNLPSARRLAAVLRPLLPASAIPLIEGPTPRQTNGYDCGVFVLAVARAICNWWPTRARHSNSDSDWLEAVKREVNADSVKAMRTQLLQLIHTLIQNNTTTNQHSC

SEQ ID NO: 44253 - protein, 468 aa, Escherichia coli
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWELNYGEIAKIFRAGCIIRAQFLQKITDAYAQKAGIANLLLAPYFKQIADDYQQALRDVVAYAYQNGIPVPTFSAAIAYYDSYRSAVLPANLIQAQRDYFGAHTYKRTDKEGVFHTEWLE

SEQ ID NO: 44254 - protein, 329 aa, Zea mays
MHACSLVESKRKLTPHHHPRLDHLELPGHSPTHPAQADPSIFPKGWCSGELGEGSSASEADLSAVHAAANQRAQSFRCLFRMTTCRTANAAAVVRLLLLCSFCAAAAIACDPPNGAKFGYTGSVGPDHWGALSPSFRQCATGTKQSPIDISTAQAVSNPALQPLHRDYTVANATLVDNVVNVALRFDGDGGGGGAGSVSVGGKLYTLKQVHWHSPSEHTVDGRRFPVELHMVHASDDGNVTVVAMLYRFGRPDPLLWQIQDKLAALHAEGCRADKGAPVAAGDVSLWSLRLYSHTYYRYVGSFTTPPCTENVIWSVLAQVREMTVDSPA

SEQ ID NO: 44255 - protein, 243 aa, Oryza sativa Indica Group
MASFLAASLLIALVVSGSNVAATPSPSVVVGNGDIASTAQEMQRARYFTFVMLIRMVQEKIPHNTTFLMPNDRMLSTATIPESQVMEFLSRHSIPAPLMFDDLIKLPNATIVPTAHSSQTITITNVKHQKIYFNNIELISPDVCRVGDLFRCHGINGVIRPIVPRGKGSACPGHLAPATAAPGPASGANRSLETSSLTSPNMSSATSPSLQPAAESPQSSDTSTSQIASSYTTLILVLVFSIF

SEQ ID NO: 44256 - protein, 471 aa, Escherichia coli
MLLPVIMAGGTGSRLWPMSRELYPKQFLRLYGQNSMLQETITRLSGLEIHEPMVICNEEHRFLVAEQLRQLNKLSNNIILEPVGRNTAPAIALAALQATRYGDDPLMLVLAADHIINNQSAFHDAIRVAEQYADEGHLVTFGIVPNAPETGYGYIQRGMALTDSAHTPYQVARFVEKPDRDRAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRVEHWVILAGTGQVTVNGKQFLLSENQSTFIPIGAEHCLENPGCIPLEVLEIQSGSYLGEDDIIRIKDQYGRC

SEQ ID NO: 44257 - protein, 189 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 44258 - protein, 527 aa, Synechococcus elongatus PCC 7942
MSLEVLATEPALEYGLERFFLALVVALSVATLPQVFSWFRQIPYTLLLVIAGLGLALFNVRLINLSPELILSIFLPPLLFEAAWNLKWNNLKKDWVPISLYAVIGVGISILGIAFGLSQTTSVPIVIALLIGASLATTDPVSVIAMFRELGVAERTRTLVEGESLFNDGVAVVTLSLLLALPLEVQGFEAKSLLADLIRYLGIGIGSGCLIGFGVSFLTQRLDLPLLEQSLTLVAAYGSYLLSEQLGGSGVIAVVPVGLILGNFGSRIGMSPRTRVIVTEFWEFLAFFVNSIVFLLIGDQVPLESLWQNRGAIAITVVAMLAARAIATFGLGWLSNRLSHSDLSWRELVVVWWGGIRGAVSIALALSIPTVLLQRDLITATVFGSVLFTLLVQGLTMKPLLGALGLLGDQALRQQYAEAIARQTALQRVLLRLQQAEPQAEIDPEFCREQIQLIEAKLKSLAQELTELCDRQPELQHYALESLQDELLAIEADTYAEFVRSGQLSQELSPILRETLSFPAQPPAIAD

SEQ ID NO: 44259 - protein, 244 aa, Wolbachia endosymbiont of Drosophila ananassae
LKQLGINPVIIHDGEYEINSVLKVLGMDSKFVNGIRLTDRDTMKIIEMALCGSVNKKIVQHINSAGGSAIGLCGKDGNLIKVEKITATLREDRSNNIEKILDMGFIGRPTEINPDILFFIEESDFIPVIAPIGHGKDGETYHIDADSTASAIAIAVSASKMIILSDTDEEIDKIGGRKISVKNLNASIDCGKIKGEKFIERLMAYVKMAEECAGVVHIVDGRIPNIMLDLFTESNSSISIVSDL

SEQ ID NO: 44260 - protein, 280 aa, Coccidioides immitis RS
MWLSNNRKPATTGPPVILETSYTSKEVPIPDTFLTTPPPDAEPITANIIDFSSSSLPEYKDYYAVILDNVLSQSECAQLLSLAEQSVETGEAWKPALVSVGPGREALMTNYRNSDRIIWDNDVITSRLLERCFQADGIRKRLSVIAGEQYRGILGAWALESAQSWQVVKLNERMRFLRYTNGQFFKAHCDAPYTTGNQCTFYTLQLYLSDGKEDESKRLVGGATTFWSRDERRRLDVHPKPGRVLIFQHRGLYHSGDQVLQGVKYTMRSDILYKPETQGK

SEQ ID NO: 44261 - protein, 353 aa, Vitis vinifera
MEETEARAGGDLKWSRETIPKVLRIVGTRLPQRDLISLLLVSPWIHRTLVSCSSLWLVLDFRETNNAGNRLVAALSLFRYQHVKQINLEFAQDIEDKHLDLLKTKCLDSLQELESLNLNVCQKISDRGVETITSACPKLKVFSIYWNVRVTDIGMTHLVKNCKHIVDLNLSGCKNITDKSLQLIADNYPDLELLNLTRCIKLTDGGLQQILLKCSSLQSLNLYALSSFTDEAYKKISLLTDLRFLDLCGAQNLSDQGLCCIAKCKNLVSLNLTWCVRVTDVGVIAIAQGCTSLEFLSLFGIVGVTDKCLEALSRSCSNMITTLDVNGCIGIKGRSRDELLQYFPYLRCFKVHS

SEQ ID NO: 44262 - protein, 144 aa, Triticum aestivum
  misc_feature (19)..(19): Xaa can be any naturally occurring amino acid
  misc_feature (37)..(37): Xaa can be any naturally occurring amino acid
  misc_feature (42)..(42): Xaa can be any naturally occurring amino acid
  misc_feature (47)..(47): Xaa can be any naturally occurring amino acid
  misc_feature (60)..(60): Xaa can be any naturally occurring amino acid
  misc_feature (66)..(66): Xaa can be any naturally occurring amino acid
  misc_feature (69)..(69): Xaa can be any naturally occurring amino acid
  misc_feature (72)..(72): Xaa can be any naturally occurring amino acid
  misc_feature (75)..(75): Xaa can be any naturally occurring amino acid
  misc_feature (90)..(90): Xaa can be any naturally occurring amino acid
  misc_feature (92)..(92): Xaa can be any naturally occurring amino acid
  misc_feature (114)..(114): Xaa can be any naturally occurring amino acid
  misc_feature (122)..(122): Xaa can be any naturally occurring amino acid
  misc_feature (132)..(132): Xaa can be any naturally occurring amino acid
  misc_feature (140)..(140): Xaa can be any naturally occurring amino acid
MAPTVMGSSATSVAPFQGXKSTAGLPVSRRSNGASLXSVSNXGRIMXMQVWPIEGIKKFXTLSYLXPLXTEXLLXQVDYLIRSKWVPCLXFXKGGFIFREHNASPGYYDGRYWXMWKLPMFXGCNDATQVIXKVGEVNKXYPDA

SEQ ID NO: 44263 - protein, 444 aa, Bacillus subtilis subsp. subtilis str. 168
MSSYLIKPELSSAYPVVSYAKGSYVYDQTGKKYLDGSSGAVTCNIGHGVRDVTEKLKEQLDQVSFAYRSQFTSEPAEQLAALLAQELPGDVNWSFFVNSGSEAIETAMKIAIQYWQEKKQTQKSIFLSRWSSYHGITLGALSLSGFYERRYRFTHLIERYPAISAPHIYRLNHETEEDFVQTAADELDTMIKRIGSQFIAGFVAEPIIGAAGAAITPPPGYYERLSEVCRTHDVLFIADEVMTGLGRTGRMLATEHWDTVPDIAVLGKGLGAGYAPIAAAVVSDSIIETIKQGSGVIMSGHTYSAHPYSAKAALEVLRYVLKHGLIKQSEKKGAVLKKKLDEAASQSGIIGEVRGKGLLLGIEFVADQKTKKVFPPEQAITQLIVSEAKKRGLIVYPSKAGIDSGEGDAVIIAPPFTISDGEMEELISIFSETVAAVEKNLKKD

SEQ ID NO: 44264 - protein, 342 aa, Brucella melitensis 16M
MFNSVLDTIGNTPLIRLSKASELTGCDIYGKAEFLNPGQSVKDRAALYIIRDAEKRGLLRPGGVIVEGTAGNTGIGLTMVAKALGYRTAIVIPETQSQEKKEVLRLLGAELIEVPAAPYRNPNNYVRLSGRLAEQLAKTEPNGAIWANQFDNTVNRQAHIETTAQEIWRDTSDQIDGFVAAVGSGGTLAGTAIGLKERNHNIKIALADPHGAALHAFYTTGELKAEGDSITEGIGQGRITANLEGFTPDFSYQIPDAEALDILFALVEEEGLCLGGSSGINIAGAIRLAKDLGPGHTIVTVLCDYGNRYQSKLFNPAFLRGKSLPVPRWLEKKTEIDIPFEG

SEQ ID NO: 44265 - protein, 535 aa, Brucella melitensis 16M
MGRLIFIGFPGLGLVASHLPHRNGPAEEGTRNQFGHDSASRQRVFRRPVVIIKWNYVRQVALARRFKADRECAVPLKEIELTKENTGGFAALGITGVLLKGVEAAGMTEPKPIQTQAIPSQLEGQDILGIAQTGSGKTAAFSLPILQKIIGLGDKRRPKTARALILAPTRELAVQIEQTIRNVSKSAHISTALVLGGVSKLSQIKRIAPGIDVLIATPGRLTDLMRDGLVDLSQTRWLVLDEADRMLDMGFINDVKRIAKATHAERQTALFSATMPKEIASLAERLLRDPVRVEVAPQGATASEITQVVHPVPTKEKRRLLSAMLTDADMRSVIVFTRTKHGADAVVRHLERDRYDVAAIHGNKSQNARQRALNGFRDGTLRILVATDIAARGIDVPGISHVVNYDLPDEPETYVHRIGRTGRNGASGASITLYDPATEESKLRAVERVTRSKLSIKDAPVKLAPAPVAKGPAPQGQRTEQAESRKAPAHKHRRPAQKAGEQHRAGAHASAGEAAPKPKRPFRRKRRSNGGQRAA

SEQ ID NO: 44266 - protein, 419 aa, Brucella melitensis 16M
MMTPFVKSVAQAEKAMRALFCETPLQRNDYLSRKYGAQIWLKREDLTPVRSYKLRGAFNFISKAVETTDKNAVFVCASAGNHAQGFAFVCRHFGRKGVVFMPVTTPQQKIDKTRTFGGEFIEIKLVGDIFDVCYAASREFAAANKGVMVPPFDHPGIVEGQATVALEIERQLPDDSKPDLVLLPVGGGGLSSGVTQYIADLGWKTAFRFVEPQGAASLKASLEAGKRVKLSHIDNFVDGAAVAEIGKENFKLLKGFDPKTVITVPENKLCATIVEMLNIEGVVLEPAGALGIDALKDFKKSDIKGKRIVIVVSGGNFDFERLPDVRERALRFEGLKKYFIFRFPQCPGALRSFLDLLGPDDDIARFEYLKKSARNFGSVLIGIETRDAANFKLLEKKFAESGWAYQDISDNQVLADFII

SEQ ID NO: 44267 - protein, 374 aa, Coprinopsis cinerea okayama7#130
MEKTPLVVVEGFLGGGLGANLWKGVETLINPSHLDLDEHSEGYRRILTVSVGPVSSLHDRACELYYALRGGTVDYGSSHSSEHNHARYGRTHPTGIYPRWSKERPLHFLGHSIGGPTIIKLQHLMKEGHFGKDADPDMVLSVTSICSPFRGTQLVYTLGESTHSAPSVRPFSVGALIAKVVHLLAYIAPPTPVANDEASVDGRRSSWLEYFQVLDLHPESRSLSYRDISFLQFLRYLWRSDWAESKDATPYDMTFEAADLRESSGEGLPFPNTFYQSHVFSMTKLMSPSSGSGQNYHTPSGISWIASGPLYLMSRSIGKFDFSLIRPLPSFCVPPKSGLDPLEEFAKLSPLPAVDNRESSSILEDSPPFYLPPI

SEQ ID NO: 44268 - protein, 1149 aa, Oryza sativa
  misc_feature (477)..(477): Xaa can be any naturally occurring amino acid
  misc_feature (488)..(488): Xaa can be any naturally occurring amino acid
MDNPEAEPDDAVLFVGVSLVLGIASRHLLRGTRVPYTVALLVLGVALGSLEFGTKHGMGKLGAGIRIWANINPDLLLAVFLPALLFESSFSMEIHQIKKCMAQMVLLAGPGVLISTFFLGSALKLTFPYNWNWKTSLLLGGLLSATDPVAVVALLKELGASKKLSTIIEGESLMNDGTAIVVYQLFYRMVLGRTFDAGSIIKFLSEVSLGAVALGLAFGIASVLWLGFIFNDTIIEIALTLAVSYIAFFTAQDALEVSGVLTVMTLGMFYAAFAKTAFKGDSQQSLHHFWEMVAYIANTLIFILSGVVIADGVLENNVHFERHGASWGFLLLLYVFVQISRILVVVILYPLLRHFGYGLDLKEATILVWAGLRGAVALSLSLSVKRASDAVQTHLKPVDGTMFVFFTGGIVFLTLIFNGSTTQFLLHLLGMDRLAATKLRILNYTKYEMLNKALEAFGDLRDDEELGPPADWVTVKXKYITCLNDLDXAPVHPHAVSDRNDRMHTMNLRDIRVRLLNGVQAAYWGMLEEGRITQTTANILMRSVDEAMDLVPTQELCDWKGLRSNVHFPNYYRFLQMSRLPRRLITYFTVERLESGCYICAAFLRAHRIARRQLHDFLGDSEVARIVIDESNAEGEEARKFLEDVRVTFPQVLRVLKTRQVTYSVLTHLSEYIQNLQKTGLLEEKEMAHLDDALQTDLKKFKRNPPLVKMPRVSDLLNTHPLVGALPAAMRDPLLSSTKETVKGHGTILYREGSRPTGIWLVSIGVVKWTSQRLSSRHSLDPILSHGSTLGLYEVLIGKPYICDMITDSVVHCFFIEAEKIEQLRQSDPSIEIFLWQESALVVARLLLPMMFEKMATHELRVLITERSTMNIYIKGEEIELEQNFIGILLEGFLKTKNQTLITPPGLLLPPNADLNLFGLESSAINRIDYCYTAPSYQVEARARILFVEIGRPEIEADLQRSASLISQTLELPRTQSKEHSGLLSWPESFRKSRGAQNGASLTEIRDHPASFSARALQLSMYGSMINDMKSGQGQGQRRQRHRHTKASSNKAHSSSYPRVPSRSSNTQRPLLSVQSEGANMTTARQAAAAGASLPPEPEEAGRRRRRQRKAIEEDEDNSSDESAGEEVIVRVDSPSMLTFRQPSSAADR

SEQ ID NO: 44269 - protein, 365 aa, Yersinia pestis KIM
MRLAMKKTYRIAAIPGDGIGHEVMPEGINVLQAAALRWDLDISFENIEWASCEYYQHHGQMMPNDWQRQLQCFDAIYFGAVGWPATVPNHISLWGSLLKFRRDFQQYVNLRPVRLFPGIPCPLVGKQPGDIDFYVVRENTEGEYSSVGGRLFEGTEQEMVLQASIFTRRGVDRILKYAFELAQMRPRKRLTSATKSNGLAFSMPYWDERFEVMAAQYPQISADKQHIDILCARFVLNPERFDVVVASNLFGDILSDLGPACAGTIGIAPSANLNPERDFPSLFEPVHGSAPDIYKRNIANPIAMIWAGAMMLDFLGQGDERYHAAHNGILNAIEQVIAQGPKTPDMCGDASTQQVGSAIVQVLSH

SEQ ID NO: 44270 - protein, 455 aa, Sinorhizobium meliloti 1021
MSIDADDPEVFQSWLEQNGPIESIQAVICDLNGIMRGKRVPVEQARKVLGGGIRMPLSIVGVDVWGEDIIGSAQVFATGDRDGICGVTGRGALPVNWTSRPSALVPLWLFVENGRPFLADPRQALAAIMREYRELGLRPVVATELEFYLIDPEPDSAVPPISPYTGKRLDSDAILSIDELDDFGEFFSDVYRECARQNVPADAAIAENGIGQFEINLLHSDDPLKAADDAIFFKRIVKGVARKHGLAATFMAKPYGTRSGNGMHVHFSLLDEEGNNVFDDGSDEGSAVLKHAVAGLLRGMAETTLMFAPHFNSYRRLRPDTHAPTSISWGYENRTSAIRIPGGNPAARRIEHRVAGADANPYLVIAAILGAALVGIRNKWKPPVPVEGRAYAAEKLPKIPADWGQAVDAFEAGPIAAEIFDPVLRSMLIACKRQEIAGFAEQVTDYEFSAYLEIV

SEQ ID NO: 44271 - protein, 317 aa, Triticum aestivum
  misc_feature (133)..(133): Xaa can be any naturally occurring amino acid
  misc_feature (253)..(253): Xaa can be any naturally occurring amino acid
  misc_feature (272)..(272): Xaa can be any naturally occurring amino acid
  misc_feature (282)..(283): Xaa can be any naturally occurring amino acid
MPAREQGTAANALKLSSGHEMPAVGLGVWRMDAPAIRGLIHSAIRAGYRHFDCAAKYQNEAEVGDALAEAFEIGLIKREDLFITTKLWNSDHGHVVEACKDSLKKLRLDSLDLYLIHFPVVTKHTGIGKTASXALGDDGVLDINTTISLETTWHAMEDLVSMGLVRSIGISNYNILLTRDCLAYAKIKPAVNQIETHPYFQRDPLVKFCQKHGICVTAHTPLGGSTANTELFGSVSCLDDPVIKSLAEKYGKXPPQLVLGWGLQRNTVVIPXTSRKRGLREXXVVDSTSQRDMERSNLDALRSNSRQVWASLYLDPC

SEQ ID NO: 44272 - protein, 156 aa, Mesorhizobium sp. BNC1
MTDKTKLLIVEARFYDDLADGLLNSAKEALDEAGASFDLVTVPGALEIPGAIALAHQAAQKNGRRYDGFVALGCVIRGETYHFEIVSNESARGLMDLTVKEGLAIGNGILTVENEEQAWERVKGRPETGTIEGAGKGRAAAEAALRMIELKKRLGA

SEQ ID NO: 44273 - protein, 235 aa, Zea mays
MGGEEGGDGLKLIGQYGSAFVTRVKLALSLKGLSYEYVEEDLRNKSALLLSSNPVHKAVPVLIHRGKPICESQVIVQYIDEAFAGIGPPLLPADPYERSVARFWAAFIEDKLVSPWDRVFRAKTEDEREEAMKQMLAAVDALEGALKEGRPRPFFGGDSVGYVDVVLGGAVSYAKGHDALFGSELIDAAKTPLLAAWMERFCELDAAKAVLQDVDRVVQYGKMLIAKNAAATRQA

SEQ ID NO: 44274 - protein, 712 aa, Mesorhizobium sp. BNC1
MTMLYVVIACGLLSVLYAIWATQSVLAADQGNARMQEIAGAIREGAQAYLTRQYTTIAIVGVVVFLLAWWLLNAAAAIGFLIGAVLSGAAGFIGMHVSVRANVRTAQAASNSLSAGLEIAFKSGAITGMLVAGLALLGVSVYYWVLIGPMGYGPADRGVIDALVALGFGASLISIFARLGGGIFTKGADVGGDLVGKVEAGIPEDDPRNPATIADNVGDNVGDCAGMAADLFETYAVTVVATMVLGAIFFGGSEILGSVMLYPLAICGACIITSIIGTFFVKLGTNNSIMGALYRGLIVTGLLTILGIGAATSLTVGWGDLGTVNGITVNGTSLFVCGLIGLVVTGLIVVITEYYTGTNKRPVNSIAQASVTGHGTNVIQGLAVSLEATALPAIVIVGGIIATYQLGGLYGTAIAVTTMLGLAGMIVALDAFGPVTDNAGGIAEMSGLPPEVRQSTDALDAVGNTTKAVTKGYAIGSAGLGALVLFAAYSYDLQYFAANATEFPYFADIGDISFSLSNPYVVAGLIFGGLIPYLFGGIAMTAVGRAAGSIVEEVRKQFRDDPGIMQGTSKPNYARAVDMLTKAAIREMIIPSLLPVLAPLVVYFGVLLISGSKASAFAALGASLLGVIVNGLFVAISMTSGGGAWDNAKKSFEDGFVDKDGVKHMKGSDAHKASVTGDTVGDPYKDTAGPAVNPAIKITNIMALLLLAVLAH

SEQ ID NO: 44275 - protein, 168 aa, Avena clauda
VMASSATSVAPFQGLKSTAGLPVSRRSASSLGSVSNGGRIRCMQVWPTEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 44276 - protein, 177 aa, Glycine max
MNALAATNRNFRLASRLLGLDSKLEKSLLIPFREIKVECTIPKDDGSLATFVGFRIQHDNARGPMKGGIRYHPEVEPDEVNALAQLMTWKTAVANIPYGGAKGGIGCDPADLTVSELERLTRVFTQKIHDLIGVQTDLPTPMKGTGPQTMAWILDEYSKLHGHSGVGKLDIYGFCFQ

SEQ ID NO: 44277 - protein, 168 aa, Avena clauda
VMASSATSVAPFQGLKSTAGLPVSRRSASSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 44278 - protein, 369 aa, Escherichia coli K12
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 44279 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 44280 - protein, 561 aa, Delftia acidovorans
MTTLKITGMTCDSCAVHVKEALEKVPGVQSANVSYTKGSAKLAVETGTSPDALTAAVAGLGYRATLADALVPPVGGGLLVKMREWLGSGDKAGDDGGGLHIAVIGSGGAAMAAALKAVEQGAHVTLIERGTIGGTCVNIGCVPSKIMIRAAHIAHLRRESPFDGGMPPTPPTILRERLLAQQQARVDELRHAKYEGILDDNPAISVLHGEARFKDGHSLTVQLNGGGERVVTFDRCLIATGASPAVPPIPGLKDTPYWTSTEALVSDTIPERLAVIGSSVVALELAQAFARLGSQVTILARSTLFFREDPAIGEAITAAFRAEGIEVLEHTQASQVAHEGGEFVLTTAHGELRADKLLVATGRSPNTRSLALDAAGVALNLQGAIVIDVGMRTSTPDIYAAGDCTDQPQFVYVAAAAGTRAAINMTGGDAALNLAAMPAVVFTDPQVATVGYSEAEAQHDGIETDSRTLTLDNVPRALANFDTRGFIKLVIEEGSGRLIGVQAVAPEAGELIQTAVLAIRNRMTVQELADQLFPYLTMVEGLKLAAQTFNKDVKQLSCCAG

SEQ ID NO: 44281 - protein, 297 aa, Escherichia coli O157:H7 EDL933
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 44282 - protein, 452 aa, Escherichia coli
RELYPKQFLRLFGQNSMLQETITRLSGLEIHEPMVICNEEHRFLVAEQLRQLNKLSNNIILEPVGRNTAPAIALAALQATRYGDDPLMLVLAADHIINNQSAFHDAIRVAEQYADEGHLVTFGIVPNAPETGYGYIQRGVALTDSAHAPYQVARFVEKPDRERAEVYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGHVTVNGKQFLLTENQSTFIPIGAEHSLENPGRIPLEVLEIQSGSYLGEDDIIRIKDQYGRC

SEQ ID NO: 44283 - protein, 532 aa, Oryza sativa Indica Group
MTTLPTAILLLLLLLALPPPSAVVALTADGLALLALKAAVTDDPLSVLSSWSESDPDPCRWPGVTCSNVTAAGGEPRRRVVGVALAGKNLSGYIPSELGSLLFLRRLNLHDNRLAGGVPAALSNASSLHSLFLYGNRLTGALPAALCDIPRLQNLDVSRNTLSGGLPGDLRNCRSLQRLILAGNSFSGEVPAGIWAEMASLQQLDISSNGFNGSIPADLGELPRLAGTLNLSHNRFSGVVPPELGRLPATVTLDLRFNNLSGAIPQTGSLASQGPTSFLNNPGLCGFPLQVPCRAVPPPTQSPPAPTTTTTTTTPSSASAAAAAASEHHQPIRTSLIALISIADAAGVALVGVILVYVYWKVKDRKKQGRSSTVAAGDENESRHGLCRCIWGHRGVDSDTDTDDSSASENGGGGGKYGEGELVAIDRGFRVELDELLRSSAYVLGKGGKGIVYKVVVGNGATPVAVRRLGGGGGGGERCKEFAAEARAVGRARHPNVVRLRAYYWSADEKLVVTDFVGNGNLAAAMRGKHSL

SEQ ID NO: 44284 - protein, 287 aa, Medicago truncatula
MAKDIEAEPQGGVPHKDYHDPPPAPLFDTAELGQWSFYRALIAEFVATLLFLYVTVLTVIGYNAQTDPAHNGTNCDGVGILGIAWAFGGMIFVLVYCTAGISGGHINPAVTFGLFLARKVSLIRAVLYMVAQCLGAICGVGLVKAFQKGYYNRYKGGANMLSAGYSKGTGLGAEIIGTFVLVYTVFSATDPKRNARDSHVPVLAPLPIGFAVFMVHLATIPITGTGINPARSFGAAVIYNNEKAWDDQWIFWVGPFIGAAIAAIYHQFVLRAQAAKALGSFRSSSNL

SEQ ID NO: 44285 - protein, 478 aa, Escherichia coli O157:H7 EDL933
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPENDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEDAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 44286 - protein, 151 aa, Aeromonas punctata
METIMKFEKSQAAVDRLTPEQRRITQDSGTERPFTGEHNDNKEPGIYVDIVSGEPLFASTDKFDSGTGWPSFTKPIVPANVNEVRDSAHGMVRTEVRSVHADSHLGHVFPDGPSDRGGLRYCINSASLRFIPRDEMESEGYGEYLDQVEEA

SEQ ID NO: 44287 - protein, 292 aa, Debaryomyces hansenii CBS767
MTLRLYNYQGIIRSILYARSTNCIRSGFSLPPRHIANSFNSNKLQFHTFSRILHETKKTKLSDLEKSPKPSSKPLPPLEPISPLQPLLRENIYTIPNILTATRIITAPAVGYFLINQQAGLAMSIFVYSCVTDFIDGYIARKYNMKSIIGSILDPMADKLLMTICTVSLSYISSMPLYLACLIIGRDVLLSFMAIYYRYVTLPPPKTFKRLINISIPTVSVHPNLLSKVNTGLQMLYIGSLVLQPAIESIMAENWIEPFHSGLYGFELLVATTTFLSGCTYIFSKKAIKPVR

SEQ ID NO: 44288 - protein, 316 aa, Coprinopsis cinerea okayama7#130
MYGALTFALKQELDKIDTAKEYSGNLPKIQSKSGRSYFVKQGSPAEQEQYVGEAESLKAIQRAAPGLAPEVYAYGTLQDGKPYFISEYKNMGHLTTPAAKELAKRLANELHQLKSLHGFGFHVPTHCGPTRFENGWYPTWEKCYSAMYQHLISEIRRKGGKEHLCKVGDKVISQVIPRLLGHLVIQPVLLHGDLWSGNVGVDEATKKPKMAYRLIVPSLAIARIFGGFPQTFFDTYFENNPKTEPVDEFDLRAELYEAFHYLNHTVIFGGHYARHAETKLTGLLEAIERLGPVKQGNGEDKEQAALFEAPDPTKVN

SEQ ID NO: 44289 - protein, 611 aa, Oryza sativa Japonica Group
MDNARKFYNLKRRLYSSEEAISASLHEDHSSARLKNSFVFSSGYLIVSMFYLQATTNMELTSSSAMWLAMAILAITAALTKIALGGGRRRCLSESSDLTCKTPPPPPVVNCIALLGLLPALFRGDVPATMQQLYAKFGSVFTVSVAGLLKATFLVGPEVSAHFFQGLESEVSHGDLFEFTVPMFGKEVGHGVDNATRIEQGRFFAEALKPVRLRIHVDPMVQEVEDYFAKWGQHGTVDLKHELEQLLLLISGRCLLGKEVMGTKFDEVCNLFRDIEGGVNLMSVFFPYTPLIPSNRRRDMARERLHAIFSDIVRSRKQQQGDQEEVNDKDVLQSFIDSRYKADGRATTEAEVAGLITGVLFAAKHTSTHTSVWTGARLLTHEKFLAAAVDEQDQIVRKHGIINGRIVTDHYGFLMEMHMLHICIKETLRLHPPAPMIVRTALRQFTVRTREGHEYCVPAGHTMASPIVISNRVPYIYKDAHLYDPDRFGPRREEDKVGGKFSYTSFGGGRNSCVGENYAYMQIKAIWSHLLRNFELKLLSPFPKTDWSKLVPEPQGKVMEKKRKYNSEELARYTLLKEGNGGGSESARLPHHQVYVIFSYHLILMYFYITR

SEQ ID NO: 44290 - protein, 2167 aa, Oryza sativa Japonica Group
MSAAQGMAYKLRTDAAPTGAGRRARRSHSSVAAPYRAARLVQGGVSIEGGLVGGCQLTEERVAARPPRAAARDAEPVRPLSTLPESSIGLYDPSRERDSCGVGFVAELSGDYKRATVNDALEMLERMAHRGACGCEKNTGDGAGILVALPHNFFREVTKDAGFELPQPGEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDALRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLANGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEEDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQFKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 44291 - protein, 1678 aa, Oryza sativa Japonica Group
MAIILAITAAVTKIARGGRRRSATDPTCKMPPPPPVVNSIALLRLLPTLFRSGLPAILHELYTKFGSVFTINLAGLLKMTFLVGPEVSAHFFQGLESEISHGNLLEFTVPMFGKEIAHGVDSATRNEQARFFVDALKPARLRIHVDPMVQEVEVGARVLCRSKMSSADIRQGKYVYTHCSLDEMYSLSVCTCLLGKEVMGTMFDEVCNLFRDIEGGVNLMSVFFPYTPLIPSNRRRDMARKRLHAIFSDIVAALMICLLFAAKHTSAYTSVWTGARLLSHERFLTAAVDEQDKIAREHSNINGGGRITDDRYGSLMEMRTLHSCIKETLRLHPPVPMLVRTAHKQFTVRTREGHEYAVPAGHTIASPIVISNQVPYIYKDGHLYDPDRFGPAGREEDKVGGKFSYASFGGGRTGCVGEGYAYMQIKAIWSHLLRNFELRLLSPLPKSDFTKFVPEPHGELMILVPAYPNTLYIRSTGIPCRQWCARFYYYDIKFRRQQRQHWPHPRSPYFNNAGVDSSRRNRLPGLYHGTDLGWSINDRKQDAVAITPDDSMSKDPPAVAKNGTSTSYEPEKDPSAAKPCPFDKNHEPTRTTSEVTKPWCPIHKTRKHTLQACWVFLNVQAEIRACKERGIQRTSPTRDVYCPIHKTKNHDFSSCKVLLRAMKTPLSKVVTGPHIVYVAIQIVIGPHIVYAAQQEMHDHIHIFGMSSTYTRWIYHGELVDTEDVEYLEQVHETNHNEGTDVGGYEPEDDNGVPELIGELYTAAEEDGQPPRFARILEDAKQALCPGSNHSRFSFLVRLLHIKSYYRINNTAFTELLKLLSSAFPQCQLPKSYDEAKKYLRELGLGYVSIHVCKNNCVLFLKEYANMDLCPICGESRWEDGVGDRKVPRKVLRHFPLIPRLKRIFASKRTAEDTQWHKIKRKPVDNEMSHAADGEAWKDFDRKYRTFAEDARNMRLAIATDGFNPFGKVSNSYSMWPVLVMPLNLPPWESVDPSNCIMSLLIPGPTSPGKDFDLFLEPLIEELLELWIGVSTYDAFSARKFNLRAAVLWCIHDYPALSTLSGRTTKGYYACIHCDKNPLSRALRNKIGYFGHRRFLPRTHAWRRSHAFDGHHENQVEPGKFSTDEVLEQLEKVKDVRPGKHDTSKKRKRGENEGPLIYSRKVSLWKLPYWKDLLLPHNLDVMHFEKNICDNILGTLLKIEGKTKDTVNSRIDLHDMNKRHNLHLQQDGNSVRIPQARYVLKKEQRIDPGCSLYFYQYPGFEANVQSLLQSSMKAIMEEPVPDGETPRTSAEVVSKVLSRDNSNTTFLKNAGLQMSSKKSVTPTEAALQEELAAEKQSLAILHAEVVELKEQANLANEALAKTQKELAEFKQQQEENNLLLRRILSLSQGKDVCHKSDMYTWRFKMRARGASTFGNVALAYTTTVREMMIQRGVHVIRHITANMDSTTPRDVFANGGTSTSAHAIAEVENQAVTPAQHLGTINAILREIPYDPVLNDDLARWTERLRESVANLSNAFEEAATRAQPEQPTAGGADSEPPEQRTSPQRATPPPRGTGDLRDHLNGCRKARRARDNENCSRHRVSSRRRENEERGGRSSENRRHDNRHNRHDRDDREQRTPDDIGRGHRHDGDDNGDRRRDDNDIHGGRTIANNPPPPAPGVELSTIRYVMSDGLRDSDPGQ

SEQ ID NO: 44292 - protein, 175 aa, Triticum aestivum
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGLDNPRQLQCVSFIAFRPPGCEESGKA

SEQ ID NO: 44293 - protein, 452 aa, Escherichia coli
RELYPKQFLRLFGQNSMLQETITRLSGLEIHEPMVICNEEHRFLVAEQLRQLNKLSNNIILEPVGRNTAPAIALAALQATRYGDDPLMLVLAADHIINNQPAFHDAIRVAEQYADEGHLVTFGIVPNAPETGYGYIQRGVALSNSAHSAYQVARFVEKPDRERAEAYLSSGEYYWNSGMFMFRAKKYLIELAKYRPDILETCQAAVNAADNGSDFINIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGAYLGEDDIIRIKDQYGRC

SEQ ID NO: 44294 - protein, 269 aa, Picea sitchensis
MVRFSNNVIGILNFITFVLSIPILGGGIWLANRASTDCEKFLEKPVIAIGVFLMVVSIAGLIGACCRVSWLLWVYLLAMFLLIVLLFCFTVFAFVVTNKGVGEVVSNRGYKEYRLGDYSNWLQKRVENTANWKRIRSCIIDAKVCKSLADESVNKAADAFYKENLSPIQSGCCKPPTSCGFTYVSPIMWNGTATDTSNTDCNSWNNTQSQLCYDCNSCKAGVLQNLKHDWRKVAAVNIVMLIFLVIVYSVGCCAFRNNRHDNSYGKGYP

SEQ ID NO: 44295 - protein, 110 aa, Medicago truncatula
MASNSGQGGIQQLLAAEQEAQHIVNAAKNEKYARLKQAKEEAEKEITKHRAHLENQFQNKVTASSGDSGANVKRLEQETDTKIHQLKTEASRISGDVVSTLLKYVTTVKN

SEQ ID NO: 44296 - protein, 185 aa, Photobacterium sp. SKA34
MRLSIPNILSFVRLILIPFFVIAFYVPYEWSAFATAFIFWVAGVTDWFDGYLARKLNQTTRFGAFIDPVADKLMVATALVLVVEHYHSVWVTIPAVTMIGREIIISALREWMAEIGKRASVAVSWVGKVKTASQMFALLLLLWHPHEYVVWLGYVSLYVAMVLTYWSMVQYLKAAKGDLLNAENH

SEQ ID NO: 44297 - protein, 452 aa, Klebsiella pneumoniae
RELYPKQFLRLYGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 44298 - protein, 153 aa, Streptococcus pneumoniae
EHFIRGQYRSGKIDGMKYISYRSEPNVNPESTTETFTSGAFFVDSDRFRGVPFFFRTGKRLTEKGTHVNIVFKQMDSIFGEPLAPNILTICIQPTEGFSLSLNGKQVGEEFNLAPNSLDYRTDATATGASPEPYEKLIYDVLNNNSTNFSHWD

SEQ ID NO: 44299 - protein, 175 aa, Oryza sativa Japonica Group
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 44300 - protein, 314 aa, Triticum aestivum
  misc_feature (140)..(140): Xaa can be any naturally occurring amino acid
  misc_feature (195)..(195): Xaa can be any naturally occurring amino acid
MAACVDKWNPAYSCHRISRSIYRFMPDCTFTAPAGAAVNGNGGCCNGGDEVWEELYAEAQADAQDEPLLGMFYSELVLSHPSLEAALAAHLSAKLCIPGALPQDALRDILAGALAAHPEASQHTRADLLAARDRDPACAXMVHCFLYYKGFLALQAHRAAHALWSEGRRPPALLLQSRASEVFGVDIHPGARIGXGILLDHATGVVIGETAVIGDDVSILHGVTLGGTGKACGDRHPKVGDGVLIGAGASVLGNVRIGDGAKVGAGAVVLRDVACGATAVGNPAKPIGKKAAPSLRPEEQPGVTMEQRWSDYVI

SEQ ID NO: 44301 - protein, 969 aa, Photobacterium sp. SKA34
MSTLFNFGDTDLSTTVPVVNGLYDLTLDELLLSQEHYESDVRSYPRRLPLAIAKAAGVLVEDTRGQLFIDCLAGAGTLALGYNHPEINKSIVEQLESGLPYQTLDITTVAKDKFIKQLLSFLPESFANNACVQFCGPTGADAVEAAIKLAKQTTGRNTMAAFHGAYHGMTNGTMAMMGNLNTKSRRQGLMADVHFLPFPYSLRCPYGLSGDDGAKQSLRYIERMLSDDESGVQKPAAIIVEPVQGEGGVIPAPAFWLRELRRITQEHGILLIFDEIQCGIGKTGHNFAFEESGITPDILCLSKAVGGGLPMSVLVFNKEIDNWNPGEHTGTFRGNQLAMATGAKTLEIIERDGLVEHAQKAGMYLRRGLEKVAAQTSCIAEVRGKGLMLGIEIVQSDGSKNKFDEPIAAPELTAAIQRSALERGLIIEKGGRQGSVLRFLPPLIISFEQLDFVINTIKEAIEVHVEPIEQGLVLESDHKVNWKDYFIQTGKGGSESFETALNQTTQVLKKVFEQTNQPYSGMDPQLLKTLINGIDLNRPQSSLDAVIEQTGDLIAKHSIMVQHPHCIAHLHTPPLVPAIAAEAFIAALNQSMDSWDQASAATFVEQKIIDWLCDVYQLGQQADGVFTSGGTQSNLMGLLLARDWAADTISGHNIQQQGLPSYADKLRILCSKKSHFTVQKSASLMGLGEQSVVCVDTNPDGTIQLASLITTIEALKADDLIPFAVVGTAGTTDHGAIDDLTGLADISARHNLWFHVDGAYGGALILSRHQSRLHGIEKADSLSVDFHKLFFQPISCGAVLVKDKAHFKYLLHHADYLNREDDLLPNLVDKSIATTKRFDALKVLMTMQSVGADALGEMYDHLINQTQHVADLVNQQSQYELLADPALSTVLFRFVGEGANLTEQQLNQLNKQLRIDALVQGQAVLGETVVDEKVALKFTILNPCLTIHDFKTLLNKVSQLGQSLLSSTQ

SEQ ID NO: 44302 - protein, 443 aa, Oryza sativa Japonica Group
MTKPQQQSPPSTTATTTTSPPPPPPSTPPPASSSSSSLAKLPLRLHSLASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQNLVKKIKL

SEQ ID NO: 44303 - protein, 485 aa, Desulfitobacterium hafniense Y51
MDNLDPVVKEQNDIVVKVQNDTKKKVYALIGAIILGILVWFLGEGLGPQGRMALALTMTAIVLWIFEVYPVEITAVLLSTFFVFTGSATPVEAFSGYGDAIVWFIFAALVFGTAVEQSGIGKRIACSLMRFSGTSFKSMMGIIVLVGALLSFLTPAGVERLLIIYPIAIGVAAVFVKGNVQGTNTGKLAMSITYLAGNTFGFGILTGIAVNILGAGIIKEMLGIEIFWSQWILWFGVPTVITTLIAIFVAWKLFPPEDYVLTAKKENANQDFMNLGPMTIVEKRALLYLVITLGLWATDRWHHLPSWGVAIFSAALFCAPGFGVISKEQLKKIQFPIVIFSGAAITIGTVLGKTGVAAWIGKVFLGSFIRPDMSTQLMGAITYLVGVVAHIPLVESKTAAAAFTPAVAAYFDSMQLPALGPTLMSIMSADTVAFFPYMMMPFLALMGLGYFTTKDSIKLLSSYTFVAIIVQVISCFTWYHWVGLL

SEQ ID NO: 44304 - protein, 153 aa, Streptococcus pneumoniae
EYFIRGQYRSGKIDGMKYISYRSEPNVNPESTTETFASGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 44305 - protein, 162 aa, Escherichia coli O157:H7 EDL933
MLEDLRANSWSLRPCCMVLAYRVAHFCSVWRKKNVLNNLWAAPLLVLYRIITECFFGYEIQAAATIGRRFTIHHGYAVVINKNVVAGDDFTIRHGVTIGNRGADNMACPHIGNGVELGANVIILGDITLGNNVTVGAGSVVLDSVPDNALVVGEKARVKVIK

SEQ ID NO: 44306 - protein, 371 aa, Arachis hypogaea
MAGVNPNGAADFPAVPTHGGQFIQYNIFGNLFEVTAKYRPPIMPIGRGAYGIVCSVLNTETNELVAVKKIANAFDNHMDAKRTLREIKLLRHLDHENVIGLRDVIPPPLRREFNDVYIATELMDTDLHHIIRSNQGLSEEHCQYFLYQILRGLKYIHSANIIHRDLKPSNLLLNANCDLKIIDFGLARPTLENDFMTEYVVTRWYRAPELLLNSSDYTSAIDVWSVGCIFMELMNKKPLLPGKDHVHQMRLLTELLGTPTEADLGLVKSEDARRYIRQLPQYPRQPLARVFPHVHPLAIDLVDKMLTIDPTKRITVEEALAHPYLEKLHDIADEPVCMEPFSFDFEQQQLDEEQIKEMIYREALALNPEYA

SEQ ID NO: 44307 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAGATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGKQAGVIKSHDRVVVCQKVGDASVVKIIELED

SEQ ID NO: 44308 - protein, 136 aa, Photorhabdus luminescens subsp. laumondii TTO1
MAKHPEVSLYKELTDIQRHVTQNAGTEPPFSGKLLHNKKSGVYHCLCCEQPLFMSGTKFDSGCGWPSFYQPATHDAVQYLDDDSHNMHRIEVRCGHCNAHLGHVFPDGPQPTGERFCINSAALSFTDENTGEKTVG

SEQ ID NO: 44309 - protein, 119 aa, Brucella melitensis 16M
MYTIRIMNCAFFAHHGVFDEEHKLGQRFYVDAVLDVDEGNSLESDNIDGTVHYGIAFSVIEGIIMGRQRYLIETLALDVAKALVARFPQIKRAEITIRKPNAPVSGVLDYVEVTVVYPQ

SEQ ID NO: 44310 - protein, 159 aa, Staphylococcus epidermidis ATCC 12228
MKHMHRGTHEVERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 44311 - protein, 188 aa, Bacteroides fragilis
MEPIINSQMPEFKVQAFQNGSFKTVSSEDVKGKWAIFFFYPADFTFVCPTELVDVAEKYEQFQAMGVEVYSVSTDSHFVHKAWHDASESIRKIKYPMLADPTGILSRGFGVMIEEDGMAYRGTFLVNPEGKIKVAEIQDNNIGRNADELLRKVEAAQFVATHDGEVCPAKWKKGEATLKPSIDLVGKI

SEQ ID NO: 44312 - protein, 388 aa, Debaryomyces hansenii CBS767
MTVYTSSATAPVNIATLKYWGKRDKSLNLPTNSSISVTLSQNDLRTLTSVAASEDFKEDKLWLNGKLESLESERTKACLADLRTLRKELESNDSSIPKLSQFGVHIVSENNFPTAAGLASSAAGFAALVVSIAKLYELPQNMSEISKIARKGSGSACRSLFGGYVAWEMGQETNGEDSKAVEVAPLSHWPNMKAAILVVSDDKKDTPSTSGMQTTVATSDLFQWRIKEVVPKRFDDMKDSILRKDFATFGDLTMKDSNSFHAVCLDSTPPIFYLNDTSKKIIKLIHELNKREGKIIAAYTFDAGPNAVIYYEQENELKVLGVIYKYFSKVSGWEKLDTKTLDTTSDIQADPELYKGVSKIILTEVGQGPQGSSESLINDKGLPKAVAN

SEQ ID NO: 44313 - protein, 241 aa, Staphylococcus epidermidis ATCC 12228
MAENQAKKEQVHTVFQNISQKYDRLNNIISFEQHKVWRKHVMSTMNVQKGSKALDVCCGTADWTIALSEAVGSKGQVTGLDFSENMLEVGKQKTASLENIQLVHGDAMNLPFDDNSFDYVTIGFGLRNVPDYLSALKEMHRVLKPGGMVVCLETSQPTLPLFKQIYSLYFKFVMPIFGKMFAKSKEEYEWLQQSTFNFPDKQTLKGLFFEAGFNDIIVRSFTGGVAAMHLGYKENSSSKGD

SEQ ID NO: 44314 - protein, 401 aa, Solanum demissum
MPAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNAKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPLQAYQKSPRGR

SEQ ID NO: 44315 - protein, 328 aa, Picrophilus torridus DSM 9790
MKIRCISCGRDRKGNELFCECGSPFEIIPDFKYYDDINRNFPYIKRFISLGEVETPVIKRHNFSMKLDYFSPTFSYKDRGSRTLISYVNDLKINEINEDSSGNAGASIAGYGAAAGIKVKIFVPENASAAKLRQIMSYGAQVIKIKGSRDDVQRAAQESGGFYASHILRPEFRDGIRTLAYEIFNQGMPDHIYVPVSAGTLLLGLYSGLKHLYESSEIKTMPKIIGVQPENISPVCSRLNNIKYDPDNNLTSIADALVSKRPVLIERMLEALYKCISVSEEEIKIARDELAASGIYVEYSSATVYAAYKKVRLDNSMLILTGNGLKNQ

SEQ ID NO: 44316 - protein, 446 aa, Synechococcus elongatus PCC 6301
MSFDYDLLVIGAGSGGLAASKRAASYGAKVAIAETDLVGGTCVIRGCVPKKLMVYASSFASQYHYAEAYGWSAIQPQFSWPKLIAAIDAEVNRLSRLHISLLEKAGVDLILGHAQFVDEHRLQVGDRQVTAAKILIAAGGRPIKLPIPGGELAITSREMFHLPEQPQRFAVIGGGYIGCEFAGILRSLGSEVTQIIRRDRILQGFDQELREAVQTGMSQLGVQFRTGVTVERIDQTETGLQLSYSDGSQQIVDQVLMATGREPWLEGLDLDAAGVAIEGRRIAVDAWSRTNQPHIFAVGDCTDRVNLTPVAIAEGRAFADTEFGQKPRQISYENIASAVFSQPEACSVGLSEEAAKAEYGEERIRVYRSRFRPMFYTLPQAEERVLMKLVVETESDRVLGAHMVGKDAAEIIQSVAIAVTMGATKADFDATMALHPTSAEEFVTMP

SEQ ID NO: 44317 - protein, 1130 aa, Candida albicans SC5314
MFISHMSAPPSIPTITTPGTSSTNTRRVARRACLSCREKKIKCNGEPMTTITAADGTNRIIPEKTRTCSNCRFLGIPCVFVQSNRGGKRKKRSTEHQLSDSEATTAPATHPNQLGQHQQLPPIKKTKSTPSIHNLDSGVVIPSINQQQERHQDGYRNEELASTERVSSYILDGNNSTKLPSPVLTHTTFDSRRDEGQRFNNQLRRSSTTTAGFSLPPPQELLGRRSVSYSPGPSSIKSQLPHLTSSSTTTSSVQSPPPPPPPPQPPRGMGIQFHEASHQPGIFPPPPPPPPPPPPHPDHLHHQYYGYPPPPPPPPPPPLHHHHHYPPSHHPGFGFPPPPPGPPGPPGPPPVPPPPHYHQSAPPESPPKEFKHRHPKYFHKQNNKGHRHRHHPHLHHHHPPPPHHHHHHPRDFQQHNGQDDIKSKHTDENSQNSKPSSPRWLDNMSVSSSDSSRSVSSPQSQHNDKSQYSNHKSSTQMSSCTNSVTQTLDRLPKIVSTQQNNLTPTSKILSNSPFTESELAKYDLPKWEVLNKIFNYYYIYNQPSHQIFPGKAILLENLALNTDSSIIHAIIATTCLIISKYDSSINIVADELYWINKMHKFWDNLNDLGILCCYKLLVKCTSIRFNIKKMNDINIKLWEMINNNQYVDIFKQKKFDFQESRIIPTFGTKRQNYERELTLKIIWSFYINNIILLRFNQGRPYYKLSSIMNGFKFDYDRDQYSNNILLPMSDIDYLSLKSAGNRANWNQLYEKSHIPTDATSLILSSKSFENSLSKLSNKDITFSNLISKDEFHVDLRNKLKTKYYEIIHDEKLVVINTNYWFSNIILRLSELIQYNYILCDIMVFKMCKYDWKTDLGCNSDDRGDSKDTNTTQGEKCRDADGNSIQHKEDYKDSVSNPGLLQHPLISDEIQSVEGLTTKLKSLNNNDWKILIEMIKSTNEYVDLIKLIPSSEYTDYSIVVGPTTFDDNYNNENETTKRFRNLINNSSEWWNKQELKSSVQQSWAKLPIYILSFTSRVLSIIYSLAVLTKYIKFKKSFKSGDLIVEFLETNEVRTIEGCNISVLQQKQMSDVYEIFTEIHILSQLFVLCEYVKFKLSYSNEDLAALSIQRLNNLNQHLDEVLQQNFTKIKPE

SEQ ID NO: 44318 - protein, 796 aa, Oryza sativa Japonica Group
MGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 44319 - protein, 157 aa, Triticum aestivum
  misc_feature (151)..(151): Xaa can be any naturally occurring amino acid
NGTKESITKLVSDLNAATLESDVDVVVAPPFIYIDQVKSSLTGRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWTNVVIAYXPVWAYW

SEQ ID NO: 44320 - protein, 518 aa, Oryza sativa
  misc_feature (108)..(108): Xaa can be any naturally occurring amino acid
  misc_feature (324)..(324): Xaa can be any naturally occurring amino acid
MASSGSSTVVGEMESSLERVRRQLSSTSSRHLLQGPLLKRSDTLRKWNERWVILDPATGKMEYKIRRSDAAVRGIIVFDSTSTVTLSPMNFHGLPKYDGCCFCIHTDXLFLTLHSFAWVIFILGPSILFYSMTNVLDIGTPQKKEYFLCAETPSAARAWVSTLHASQLVLQAHKEAVNSLGGNGPTKLGKVATVVAVANATAIEASKEVEAAMKVSLRAALGSTTNKLSKGQLDDLTIMMETLRVKDDELHQLLQDIRARDATIRDITDKLQETAEAAETAASAAHSIDEQRRFLSSELERLKQDQEKQIEFSLLRLRESEEKXKLLSEEREHLLKERDSALQEAQMWRSELGKARGNAVILEAAVVRAEEKARVSAADADMRINDAASRLDSATKEKEELVALVDALQLQIRSQDTSTKQVCEERSELCSTSSKHVDMEDDNVDKACLSDTDPIPITENIVDLDDDGVDIPTIGVTEWNNPHSSEVSDVREVTTEPEDNSLDIPVDSQPVSENAFHG

SEQ ID NO: 44321 - protein, 391 aa, Moritella sp. PE36
MWKAPMTNLIKNVTDAFNSVLNYAPTHIVQAPGRVNLIGEHTDYNDGFVLPCAINYQTVVAAATRDDNIVRVIAVDYGNETDEFDITQAITFQDNKMWANYIRGVVKYLLERGFEFKGADIAVSGNVPQGAGLSSSAALEVVIGQTFKELYNLDISQAEVALNGQQAENEFVGCNCGIMDQMVSAEGNENHAMLLDCRSLETTAVSMPENMSVVIINSNKKRGLVDSEYNTRREQCEEAARVFGVKALRDVSIETFKAKEHELDEMVAKRARHVITENDRTVEAASVLASGDMQRMAELMAESHASMRDDFEITVKEVDTLVNIVKDVVGIAGGVRMTGGGFGGCIVALVPPALVDSVRCAVEELYEPATGLKESIYVCQAKNGAGLVATL

SEQ ID NO: 44322 - protein, 255 aa, Prochlorococcus marinus str. MIT 9303
MDSSCSPKHGWFDSVAASYAQQRPHYPESLFAWISSKASSHQRCWDVACGSGQASLGLARHFDRVDATDLSPAQVAAAPAHSNIHYQVAAAEDSGLPNACMDAIVVAAAIHWLDVPRFNEEAFKVARPGGLMVWVGYDPPQGAPPALQLWLDQLYGERLRNWWPPQRQHVDNHYQNLPFPAISTSLPQELCISLQWSCDQLIGYIGTWSALRKAKQEGHDLLPQLSMELQKLWPSDQTTIPLIFPLMGRWGYLTR

SEQ ID NO: 44323 - protein, 336 aa, Moritella sp. PE36
MKVLVTGGMGYIGSHTCVQMIEAGIEPIIIDNLDNSKLAVLDRIEALTNVRPVFYQGDVRDEECLGRIFSEHAISSVIHFAGLKAVGESVKKPLEYYDNNVNGSLVLARAMRKANVKSMVFSSSATVYGDPDVVPITEDSPTGATTNPYGRSKYMVEECFSDLFAAENDWSITLLRYFNPVGAHPSGTMGEDPQGIPNNLMPFIAQVAVGRRDSLSVFGNDYPTPDGTGVRDYIHVMDLADGHIAALTAVGQKAGLHIYNLGTGKGSSVLEMVEAFAQASGQPIPYQLCPRRAGDIAECWANTEKAERELGWKASRNVMEMSADTWRWQSTNPQGY

SEQ ID NO: 44324 - protein, 263 aa, Bacillus clausii KSM-K16
MDKPVLLITGGSSGMGKAIAKQFAEEGAFVAICARNGDKLTQAKQEIETFPGQVATYEVDVRNRADVEKMVTAIYESLGPLTGVVNNAAGNFLCPAEDLSENGWKAVIDIVLHGTWHVTQTVGKRWIADDAKGSIINIVATYAWTGGPGVVHSASAKAGVLAMTKTLAVEWGSQYGIRVNAIAPGPIENTGGVEKLLQDEHAHAKAVKSIPLNRFGKTTEVAKLASYLLSPDGAYINGTCITIDGGQHIGQSGFQTGAATFRT

SEQ ID NO: 44325 - protein, 519 aa, Chlamydomonas reinhardtii
MLMFALPFAFISRYAGWGDGATFSLSCLALVPLAERLGFVTEQLAMYTNDTLAFAMIQARRLGAEGGGTYLRVVQLSLLGSVISNLLLGAQRTSSGRSVSKGGHDKDRDGERLPLVLAAERPGGLDAVAGASDDEGDHNSKGGGSDDDEEELILSKAGCFIWLTVVTVFISFLSEFVTDAIRGASKSLGVPMPFLTTILLPIVGNAAEHASAIVFAYKNRVEIALGVAVAGASNNHTCSLSLPLAVLRAMLPPLSVLAPGHLRREMAQSLIDALQVARQLASHGSDVRAGCRQWQVPQGPRPDRGRLVLLSDYWQHASASGVRVPTAARAQNVVRVILCPAVVLAYVPAGDSTSDSASISRQHASPCCGHAAAASAAARRRRSTLQQQMVTTPRTSSLLLSLVQQGRKRTLQAQGLRRERQQRTRSLWDLYGGEIDGGEAGGGSDGAAGAASGSSRGDDSGEQLPPPPRPPQQPQIKRARIAAPPRAYASPSGHAALAYDAAVRRKYGSQARCNFPDEQ

SEQ ID NO: 44326 - protein, 331 aa, Photorhabdus luminescens subsp. laumondii TTO1
MTIKVGINGFGRIGRIVFRAAQERSDIEIVAINDLLDAKYMAYMLKYDSTHGRFNGTVEVKDGHLIVNGKAIRVTAERDPANLKWNEVGVDVVAEATGIFLTDETARKHIAAGAKKVVLTGPSKDDTPMFVMGVNHKAYAGQEIVSNASCTTNCLAPLAKVINDKFGIVEGLMTTVHATTATQKTVDGPSAKDWRGGRGAAQNIIPSSTGAAKAVGKVIPELNGKLTGMAFRVPTPNVSVVDLTVRLEKPATYQQICDAIKDAAEGELKGVLGYTEDDVVSNDFNGEKLTSVFDAKAGIALNDNFVKLVSWYDNETGYSNKVLDLIAHISK

SEQ ID NO: 44327 - protein, 455 aa, Xanthomonas axonopodis pv. citri str. 306
MLSPSVVPPSSTAAGAPPRTLGFWSALSANLLNMIGIGPFITIPLALSALAGPSVLIGWVAGALLCLCDGLVWAELGAAIPRSGGPYHYLREAYGRERWGRLFGFLYLWQTLLTAPLSVGSAAVGCVQYLAFLLPGLGHARLTAMAMALCAFNTLLLYRKVRSVQVLSLLVSAAVIGACVWIICSGVLHFDLGIAEDFLHARPASPHGFWLGLGAVALIAVYDYGGYNNVCMLGGEIRKPRRTIPRAVLVSIPIVALLYLGLNVTLLGVLPWQQAAQSKAVMADFMQAIYGPAGSTVAVALIVLASWGSALVVLLGYSRVPYAAAAAGQFFGVFARLHPRGGFPTVSLLFVGATSVLACLLSLDDLIATLMIIQILFQFLAQCLAVVLLRRKRRRRAFSMPLYPWPLLISVAGWLYLLAASPGHRVLAAVLALCVGSALYLIQARRERAWPFQLQ

SEQ ID NO: 44328 - protein, 229 aa, Triticum aestivum
AYLGDTFEQVCTKKQAATGPEFPGYRRPTRPGNSEGKIKTVALTNFDTERLQIILENGIPIVSNQVQHSIVDMRPQKKMAELCELTGVKLITYGTVMGGLLSEKFLDTNINIPFAGPPLNTPSLQKYKRMIDAWGGWSLFQALLQTLKKVSLKHGIPISTVAVRYILNQTSVAGSMVGVRLGLSEHIRDTNAILSLLLDEEDMGSITEASQRGRNLMEVIGDCGDEYRA

SEQ ID NO: 44329 - protein, 446 aa, Synechococcus elongatus PCC 7942
MSFDYDLLVIGAGSGGLAASKRAASYGAKVAIAETDLVGGTCVIRGCVPKKLMVYASSFASQYHYAEAYGWSAVQPQFSWPKLIAAIDAEVNRLSRLHISLLEKAGVDLILGHAQFVDEHRLQVGDRQVTAAKILIAAGGRPIKLPIPGGELAITSREMFHLPEQPQRFAVIGGGYIGCEFAGILRSLGSEVTQIIRRDRILQGFDQELREAVQTGMSQHGVQFRTGVTVERIDQTETGLQLSYSDGSQQIVDQVLMATGREPWLEGLNLDAAGVAIEGRRIAVDAWSRTNQPHIFAVGDCTDRVNLTPVAIAEGRAFADTEFGQKPRQISYENIASAVFSQPEACSVGLSEEAAKAEYGEERIRVYRSRFRPMFYTLPQAEERVLMKLVVETESDRVLGAHMVGKDAAEIIQSVAIAVTMGATKADFDATMALHPTSAEEFVTMP

SEQ ID NO: 44330 - protein, 311 aa, Xanthomonas axonopodis pv. citri str. 306
MAVPAAMSAAQIMVVGEVYLDHIFSGFERWPAPGEEALARHYTRELGGGTLITACALARLGCGVRVLGAIGAQDRPVFAQRLGEFGVSADGLVDSPAGTGVTTSVSLQDDRSFFTYHGANADLSALLLDETSIAAMSAATHVHFALPLPAAVAQPLLPLLARAGCSTSLDVGFSPAWLADPANHATCRAVTWFLPNQKEAALMGCGDGADACLAWAHALGLRQAVIKRGAAGAMVIDDAGARRVAAPIVPVRDTTGAGDAFDAGFLAAQLRGLSPDESAQHGCHAGAACCSALGALDGLFLLSPPTHEDVP

SEQ ID NO: 44331 - protein, 148 aa, Zea mays
MAMRMAAAAVALVAVMGVLAPRAAAQTPNCAEKLIPCSPYMNTTGTPPDTCCGPLKDAVQNDLKCLCDLYASPEIFKAFNISLDQALGLSKRCGLSDTTAACKGLSPTQSPPGSPPSGGSSNAAHRALPASFAGLVTSLFLALWSVMA

SEQ ID NO: 44332 - protein, 208 aa, Staphylococcus epidermidis ATCC 12228
MRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGWG

SEQ ID NO: 44333 - protein, 390 aa, Desulfitobacterium hafniense Y51
MYLYEYEAKEVFSKYGIPLGQNGIATNPAEAGMICAGIGKPVVVKAQVMAGGRGKAGLILPAADPEAAAKAAAQILGKEHHGEQVKKLLIEEQIEIAREVYASITMDFTEGKPVMMVSAQGGMEIESLAAANPELLIKEHIDPWREVFGHRLRDLWRRAGFRGGQVVELENILGRLVRVFLETDALTAEINPLVMTQEGKIIAADAKLILDDEASFRSEIIRNASRPEINPLEKRAGDLNVTYVSIEEGGDIGIIAGGAGLSMATMDAVYGIGAKPAAFIDLGGGISRERMKESLLLMTETPNLRGIIINVFGGINNCLTMAAGLADFLDEKPTDVKIVVKMRGHEQEEGWRILERYGIPTVKFETTDVAIRLLMQVLAKEVTAGGTHHQ

SEQ ID NO: 44334 - protein, 147 aa, Brassica napus
  misc_feature (34)..(34): Xaa can be any naturally occurring amino acid
  misc_feature (109)..(109): Xaa can be any naturally occurring amino acid
  misc_feature (137)..(137): Xaa can be any naturally occurring amino acid
RVLGMLSWTVQFRLSEECQSPDSWESLFRENGIXEFRRSSDHSLVSHEGFSDESESDSDGRRRVSKKRHKKGKKKKNRAKKKKKRAIDDEDEDDVLIDDEVLGLTQISXRSWLLSTDGFSATWTSVDLPEHIARYCXLSTWMKWVSS

SEQ ID NO: 44335 - protein, 322 aa, Staphylococcus epidermidis ATCC 12228
MKRLLIIHTGGTISMSQDQTNKVITNEENPISQHQNIISQYAEVDEINLLNIPSPHMTISNVVRLRDEIITYSKENIYDGFVITHGTDTLEETAFLIDLLIDIQEPIVITGAMRSSNEIGSDGLYNFISAIRVASSSEANHKGVMVVFNDEIHTARNVTKTHTSNINTFQSPNQGPLGVLTKNRVQFYHHPYRQTTYQYIDVNLRVPLVKAYMGMEDDVLSFYSQQHVDGIVIEALGQGNLPKSCLNGLQQCLKKNIPLVLVSRSFNGIVSPVYAYEGGGADLKNNGVIFSNGLNGPKARLKLLVGLSQDMTQNQLERYFEE

SEQ ID NO: 44336 - protein, 411 aa, Vitis vinifera
MNALVATNRNFKLAARLLGLDSKLEKSLLIPFREIKVECTIPKDDGTLASFVGFRVQHDNARGPMKGGIRYHPEVDPDEVNALAQLMTWKTAVANIPYGGAKGGIGCNPGELSLSELERLTRVFTQKIHDLIGVSTDVPAPDMGTNPQTMAWILDEYSKFHGYSPAVVTGKPIDLGGSLGRDAATGRGVLFATEALLHEHGKSIAGQRFVIQGFGNVGSWAAQLISEHGGKIVAVSDITGAIKNSKGIDIPSLLKHSVEHRGVKGFNGADPIDPKSILVEDCDVLIPAALGGVINRENANEIKAKFIIEAANHPTDPEADEILSKKGVVILPDIYANSGGVTVSYFEWVQNIQGFMWDEEKVNNELRTYMTRGFKDVKEMCRTHNCDLRMGAFTLGVNRVARATVLRGWEA

SEQ ID NO: 44337 - protein, 454 aa, Glycine max
MEPRVGNKFRLGRKIGSGSFGEIYLGTNIQTNEEVAIKLENVKTKHPQLLYESKLYRILQGGTGIPNVRWFGVEGDYNVLVMDLLGPSLEDLFNFCSRKLSLKTVLMLADQMINRVEFIHSKSFLHRDIKPDNFLMGLGRRANQVYAIDFGLAKKYRDSSTHQHIPYRENKNLTGTARYASMLTHDAIEQSRRDDLESLGYVLMYFLRGSLPWQGLKAGTKKQKYEKISEKKVSTSIEALCRGYPTEFASYFHYCRSLRFDDKPDYAYLKRIFRDLFIREGFQFDYVFDWTILKYQQSQLATPPTRAIGPSAGTSSGMPPAVTNADRHTGGEEGRPPALVSVDSSRRRMSGPILNTLSSANVLGQSSGSSRRAAVSSSRDAFVGAESDIRTRTAEASPGAAHRGLSGQRSSPIGSSDPKRVVSSGRNASHVKNYDTALRGMEGLQLENDERTHY

SEQ ID NO: 44338 - protein, 144 aa, Glycine max
  misc_feature (53)..(53): Xaa can be any naturally occurring amino acid
LPAYLNATAEDEQLTSDPVEDLCQQVYMLGFISNAIGKGIARAELETEMEAHXEAKNFEIARLLDRLHCYETMNREMSQRNQEAVEMARCERQRSSRRQRWIWGCITTVIALSTAAIAWSYLPTSKGSSSADHDLVPEYDDTAK

SEQ ID NO: 44339 - protein, 327 aa, Oryza sativa Japonica Group
MPERAITYAVVDAFTDEPFKGNTAAVCLLEESWEEQLDEQWMQSVAAEFNTSITAFLVRADADAANPQFHIRWFTPVRESELCGHGTLAAAHYLISSGLVKCNAIDFLAKSGFLTAKKVVGLKQSSTLISPLQEACTKFLIELDFPLIPVVKCSPLEMPSIPETLNGASVSNVLKTVSDSATDLIVISLTYILSVEMQPVTLKFSCVSFIVELNSSEEVVNVRPNISELVQSAGRGVAVTGPAPVGSSYDFFSRFFCPKYGLNEDPVCGSVHCALAPYWGKKLGKQCMTASMASPRSGTLYLQWDEAAQRVQIRGEAVTVMVGNILV

SEQ ID NO: 44340 - protein, 680 aa, Glycine max
AREKQLPKLVVGLLLIGAGLVLYTNRTERSAQLLQQPEVIAITVEEVSSTAKPLVRELQELPRRIKNIIASLPDQGVRNEEEASLFDMLWLLLASVIFVPIFQKIPGGSPVLGYLAAGILIGPYGLSIIRHVHGTKAVAEFGVVFLLFNIGLELSVERLSSMKKYVFGFGSAQVLAHYICGQAGPAAIVIGNGLALSSTAVVLQVLQERGESTSRHGRATFSVLLFQDLAVVVLLILIPLISPNSSKGGVGFQAIAEALGLAAVKAAVAITAIIAGGRLLLRPIYKQVAENQNAEIFSANTLLVILGTSLLTARAGLSMALGAFLAGLLLAETEFSLQVESDIAPYRGLLLGLFFMTVGMSIDPKLLVSNFPVITGTLGLLICGKTILVCLMGRMFGISLISAIRVGLLLAPGGEFAFVAFGEAVNQGIMSSQLSSLLFLVVGISMALTPWLAEGGQLLASRFELHDVRSLLPVESETDDLQNHIIICGFGRVGQIIAQLLSEQLIPFVALDVRSDRVAIGRSLDLPVYFGDAGSREVLHKVGAERACAAAITLDTPGANYRTVWALSKYFPNVKTFVRAHDVDHGLNLEKAGATAVVPETLEPSLQLAAAVLSQAKLPTSEIAATINEFRSRHLAELTELCEASGSSLGYGYNRTMNKPKSPSPDSLDETPVSEGTLAI

SEQ ID NO: 44341 - protein, 125 aa, Solanum demissum
MSMDACQILTNSGCCKPPTECGYVYQNETVWIPGGGLVGADPDCVKWSNDQEQLCYNCDSCKAGVLASLKKSWRKVSVINIVILILLVIMYMVAIAAFRHNKRIDNDEPYGETRMEKTQPSRIHF

SEQ ID NO: 44342 - protein, 269 aa, Escherichia coli K12
MEKKIGFIGCGNMGKAILGGLIASGQVLPGQIWVYTPSPDKVAALHDQFGINAAESAQEVAQIADIIFAAVKPGIMIKVLSEITSSLNKDSLVVSIAAGVTLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 44343 - protein, 598 aa, Magnaporthe grisea 70-15
MNCPSRTDEPPLTDHPTWNQNPPFLSGDLTTCQDLNGIANAREHRDGSGGAAVTDDERGGNGMQRDGWAVADRMPVEAEGRKGLAWGWGSFDASHSQAKGVTGGEGHSLSTAAGGGGFGAVAAATAAPPAPCSLFGWFSWVASVLVCAAIMSASRLPESLTGRLFGAPQPGLASPNTSTIATNSRDADVIPLGKRSTCATGGFLSEEEYNTPLHVGALLIILGVSFGACAFPIVASRIPRLRLPARFFFAVRHFGTGVLLATAFVHLLPTAFTLLGNPCLSSFWVSEYPAMPGAIALAAVFFVTVIEMVLQPARHMTEAAGSSTGGGCMSAAAVLQQQQERPRRTAEPAQDTSSEDGNGAMAGRPMSLEMRPAGGNANSLGRQLSNLGRTDDQNASVGAPSSDGQAGERLSDKSVVVDEENRLAGGHLQLTAQQQHQKDVLQCMMLEVGILFHSVFIGMTLSVSIGHEFVILLIAIAFHQTFEGLALGSRIANIKWEKGSWQPWMMSMAYGCTTPLGQAIGIATHRLYNPESEFGLVLVGTMNAISSGLLVFASLVELLSEDFLSDESWRILRGRRRVYACFLVLSGAIGMSLVGAWA

SEQ ID NO: 44344 - protein, 530 aa, Oryza sativa
  misc_feature (467)..(467): Xaa can be any naturally occurring amino acid
METLMAAELPQQKAGGGLARRLVRLLRRKRSTSGSVAGGGEYDESSMDSSINSLSKLKLSAAKLDVLFRSAAQPAASPAVDAAAAHALVASLFAGVSAVKAAYAQLQQAQHPYDSEAIQSADAAMVAELTKLSDHKRRFARDPAAAAKSAAAGPAALAAHADEQRHLLRTYEITAGKLGRELRARDAEAERARAALADDLRAARALEERAHPGRTLAALDGLHLSGLNATHFLTALRHAARSVRSFAKSMLGEMRRAGWDPVAAAAAAHPGVPLRHPGDAKFALESFVALKMFDGFHRRDFGLSALHDRSSYDRRRLFDEFAELKAAPAAEFLDARSSRWGALGEFLRDRYLSVVHERMEAAFFGSTAQRGAAASAGAALPGTPWFAEFAEMARRVWLLHCLFLAFDDGGASTIFQVSAGARFSEVYMESVGDGDGDGDDVGAGTAVAAAAAGDRVVGFTVVPGFKXWADGDAMPRIPLTAGATAMTAVELAGGGRRRWLAGDVVHAGISVTYMYDVSIYVFSVQQAIMY

SEQ ID NO: 44345 - protein, 774 aa, Brucella melitensis 16M
MTKKPSSPSTRSDFDEAALFFHRYPKPGKLEIQATKPLGNQRDLALAYSPGVAAPCLAIHDDPATAAEYTARGNLVAVVSNGTAVLGLGNIGALASKPVMEGKAVLFKKFADIDVFDIEIDAHEINRIVDVVSALEPTFGGINLEDIKAPECFEVEEQLRERMNIPVFHDDQHGTAIIVASAVLNGLELAGKKIEEAKIVTSGAGAAALACLNLLVNLGAKRENIWVCDIEGVVYDGRNTLMDRWKEVYAQKTDARTLADVIGGADVFLGLSAAGVLKPELLKQMAEKPLIMALANPKPEIMPEEARAARADAMICTGRSDFPNQVNNVLCFPYIFRGALDVGATVINEEMKLAAVRAIASLAREEPSDVAARAYSGDTPTFGPDYIIPSPFDQRLILRIAPAVAKAAMETGVATRPIEDMEAYLDRLNRFVFRSGLIMKPVFAAARTQGAPMRVIYADGEDERVLRAAQVVIEERIAAPILVGRPQVVETRLRRYGLKIRPGTDFELINPEDDPRYRDYVDLYLSYTGRQGVTPEAARTIVRTNSTAIAALAVMRDEADAMICGLEGRFERHLRVVRQIIGKVPGIRDYSALSLLISQRGALFLTDTYVNAEPDANEIAEMAVLAAREISRFGIEPKAALVSHSNFGSKESASAEKMRQAAAILAEKAPDLESDGEMHGDAALSQTLRDRVFPNSRLKGEANLLVFPNLDAANITLNVVKAVTDALHVGPILLGATRPAHILTPSVTSRGVVNMTALAVVEALQKNASNRRQN

SEQ ID NO: 44346 - protein, 386 aa, Silicibacter sp. TM1040
MVETVSPKPTACLALADGTVFYGHGFGATGRCVAELCFNTAMTGYQEIMTDPSYAGQVVTFTFPHIGNTGVTPEDDETADPVAAGMVVKWDPTLSSNWRATEELKSWLTRTGRIAIGGVDTRRLTRAIRQQGAPHVAMEHNPDGNFDLEALVAAARAWPGLEGMDLAKDVTCAQSYRWDEMRWAWPEGYTRQEEPKHKVVAIDYGAKRNILRCLASAGCDVTVLPATATSEEVLAHGPDGVFLSNGPGDPAATGAYAVPMIKEILDKTDLPVFGICLGHQMLALALGAKTTKMNHGHHGANHPVKEHGTGKVEITSMNHGFAVDAQTLPEGVEETHVSLFDGSNCGIRMTDRPVYSVQHHPEASPGPQDSFYLFERFAEAMAARKA

SEQ ID NO: 44347 - protein, 947 aa, Oryza sativa Japonica Group
MPSVSRAVCVQRASGNNGRRCRDGAAAAGRRSVVAQRARHGKPEVAIRSGSGGSARGGHCSPLRAVAAPIPTTKKRVFHFGKGKSEGNKAMKDLLGGKGANLAEMASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIALDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 44348 - protein, 419 aa, Thermococcus profundus
MVEIDPFEMAVKQLERAAQYMDISEEALEWLKKPMRIVEVSVPIEMDDGSVKVFTGFRVQHNWARGPTKGGIRWHPAETLSTVKALATWMTWKVAVVDLPYGGGKGGIIVNPKELSEREQERLARAYIRAVYDVIGPWTDIPAPDVYTNPKIMGWMMDEYETIMRRKGPAFGVITGKPLSIGGSLGRGTATAQGAIFTIREAAKALGIDLKGKKIAVQGYGNAGYYTAKLAKEQLGMTVVAVSDSRGGIYNPDGLDPDEVLKWKREHGSVKDFPGATNITNEELLELEVDVLAPAAIEEVITEKNADNIKAKIVAEVANGPVTPEADDILREKGILQIPDFLCNAGGVTVSYFEWVQNINGYYWTEEEVREKLDKKMTKAFWEVYNTHKDKNIHMRDAAYVVAVSRVYQAMKDRGWVKK

SEQ ID NO: 44349 - protein, 437 aa, Desulfitobacterium hafniense Y51
MEGFKIKSVKARQVFDSRANPTVEVDITLKDGTVGRGIVPSGASTGLFEAVELRDGEETFDGKGVSKAIHHVNEQLAPLLLDMDVRDQKAIDSRLIEIDGTPNKSRLGANAILGCSMAACWAGANYYKVPLYRYLGGSAANKLPVPMVQIIGGGAHADNVIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEKKTLTKEEMVGMLSDWVDNYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVFAAAGIQFNQY

SEQ ID NO: 44350 - protein, 244 aa, Brucella melitensis 16M
MRIRGGRNGNSGMDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIELARAAIIAGTDGIRTMNRS

SEQ ID NO: 44351 - protein, 167 aa, Arabidopsis thaliana
MMDPTGSPRTSNGSPPRSYLIFMRIMSKRRTWVCLFVAVYAILLASSWNFLTSVLSWYKLQYTSSPSPSRLPAVYASVVLGAVFGAMSMVAAAAVAVPAVMVIWISVVVLLAFFGKSRRVLVVEARKITREVFGFVFKVLLKEGNAVAAVCAVLGYFILIRKDFDSI

SEQ ID NO: 44352 - protein, 517 aa, Sorghum bicolor
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 44353 - protein, 525 aa, Vibrio angustum S14
MTTNIHEQRILILDFGSQYTQLIARRIREIGVYCELWSWDVDEADIREFAPNGIILSGGPESVTEAGSPRAPQYVFEAGVPVFGVCYGMQTMAEQLGGKVAGSNEREFGYAQVKIVEPTHFLEGIQDATAEDGTPLMDVWMSHGDKVVEIPSDFIKVAETETCPFAAMANEEKRFYGVQFHPEVTHTRQGMKLIENFVMNICGCEKLWTSANIIEDAVARIKEQVGDDEVILGLSGGVDSSVVAMLIHRAIGDKLTCVFVDNGLLRLNEGQQVMDMFGDKFGLNIVHVQAEDRFLSALAGIDEPEAKRKKIGHVFVDVFDEESKKLKNAKWLAQGTIYPDVIESAASKTGKAHVIKSHHNVGGLPDDMEMGLVEPLKELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGKVSNRIINEVDGISRVVYDISGKPPATIEWE

SEQ ID NO: 44354 - protein, 895 aa, Sorghum bicolor
MSGGLKVKNNGENYSCLFCSSKKKNNYSKSSLVQHASGVSAAPNRKAKEKAAHRALFKYLKNDLAKSSEPQPLVIPVEPQPLQNRDEKFVWPWMGILVNVPTEWKDGRQIGESGNRLKEQLSHFCPLKVIPLWTFRGHTGNAIVEFGKDWNGFRNARTFESHFAAGGFGKKDWTGKKNQGSELYGWLARAEDYNSPGIIADYLRKNGDLKSVNDLAKEGARKTDRLVANLANQIEVKNRYLQELESKYSETTASLEKMMGQREQLLQSYNEEISKMQQLARRHSQKVIDENQKLRSELEAKMNDLDVRSKQLDELAAKSDYDRRNLEQEKQKNAIKSSHLKLATLEQQKADENVLKLREKHAALKKILMLEQQLDAKQKLELEIQQLKGKLKVMEHMPGDEDSASKNKINELSEALQEKIDELDGMESLNQTLVIKESKSNIELQEARKELENVCGQAHIGIKRMGELDLKAFSKACQKERTEDAEVTAAFLCSKWEAEIKNPDWHPFRVEIIEDDAKLRALKEEHGEEIYALVTKALLEINEYKSKGSYPVGELWNFKENRKVTLKEAVQFYWSEALKSFLDHIPVSSVKLDGSVLGALDAMYSSNAAGAVIVDVVQSSFGKYVDRDIGFVEFSSLVLWALEIAWLAKLFLWEPFFPVRTQDTLFHTMLLFSKHHRLNVAPVVESINSSVIGFVTQNAVMELLLQSSGLEWLDKIADKQLSEFRFANVRKPVLVYSDQTLADGLHILSKEKMGVAVIDRKTSCLIGSIQCSDLYLFLDDSSLFSKRTTAEDSSPPGQNILALRNRQPSMVGLPATNLKSDTLKQAMEKLTTSRSSCSFIVDEQGHVEGVVTTRDIISVFSPPCMDSRIDGGTFFSAALEQAGCRVENGQMIQNS

SEQ ID NO: 44355 - protein, 557 aa, Oryza sativa
  misc_feature (29)..(29): Xaa can be any naturally occurring amino acid
MAGTAGYLPLRAQAQVGLVPLRPSGSAAXAGAGLPGRTARRRLAARGGTEAAGIRAEAVPGGGGVERRGAMVPPYNVLITGSTKGIGYALAKEFLKAGDNVVICSRSAERVESAVTDLKKEFGEQHVWGIVCDVREGKDVKALVDFARDKMKYIDIWNHKKAGFSPYLCVPLAQINNAGSNAYSYKPLVETSDEALMEVITTNTLGLMICCREAINMMRNQPRGGHIFNIDGAGSDGRPTPRFAAYGATKRSVVHLTKSLQAELQMNEVNNVMVHNLSPGMVTTDLLMSGATTKQAKFFINILAEPANVVADYLVPNIRAIPTNQSMKPTYIRFLTGLKAYSRIFSRIAFGARRNKIMSNSQPAQEDDCMSSILVSRLIRAMQPTRSYLRWSDDLHKMFVEAVAYHGGPYEAKPTAVKETMQAMGVTSLTTHNIKSHLQKYRESFSSGVGSLHDHDLLRTTSPSKEALDLASEMVRDNDAAMAEIEMLNDLLLDHDIEMVETSFSVDDLQMMERELMSEIKLIEHNFEISESALDEYMDDLANYAFDLTGPANSSSP

SEQ ID NO: 44356 - protein, 272 aa, Triticum aestivum
  misc_feature (170)..(170): Xaa can be any naturally occurring amino acid
  misc_feature (185)..(185): Xaa can be any naturally occurring amino acid
  misc_feature (201)..(201): Xaa can be any naturally occurring amino acid
  misc_feature (248)..(248): Xaa can be any naturally occurring amino acid
  misc_feature (251)..(251): Xaa can be any naturally occurring amino acid
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMACIFDEYSKFHGHSPAVVTXGKPLNLGGSLGRDSXSGRGVMYATEASPAEXGKSISGSTLGIRGFRECGSIGLPKSIPENGVSGISLGGRLWPNQNTXGLXVLGCITHKRPGLLHTFHRPFY

SEQ ID NO: 44357 - protein, 358 aa, Oryza sativa Japonica Group
MESDASTSPRRSDSSDSSTCSDGDDLLSSSSPKGTGIHRLPPLPCATDGAIAALVEELESPASSLDDLRRAAMELRLLAKHSPDNRLRIVAAGALPPLVALLSRPDPLLQEHGVTALLNLSLREDNRGAVVDAGAVGPLVRALRSAASPAARENAACTLLRLAQLDGSAAAAIGRAGAVPVLVSLLESGGARGKKDAATALYALCSGAPEENGPRAVEAGAVRALLELMGEPERGMVEKAAYVLHALVGTAEGRAAAVAEGGVPVLVEMVEGGTPRHKEMATLCLLHVCEDNAAYRTMVAREGAIPPLVALSHSSDARPKLRAKAEVLVGLLRQPRSGSLLRARPSVAASRLPAGLCN

SEQ ID NO: 44358 - protein, 255 aa, Zea mays
MVHLAQVKRDSDVEKTAERVDSIQLEDDAFYSSVYGTRFATEQLPSTEMPEREMPREVAYRMIKDELSLDGNPMLNLASFVTTYMEEEVEKLMTESFSKNFIDYEEYPQSAEIQNRCVNMIARLFNAPTDSDDEHPMGTSTIGSSEAIMLGTLAMKRRWQNKRKAEGKDASRPNIVMNSAVQVCWEKAARYFDVEERYVYCTEDRYVIDPKQAVDLVDENTIGICAILGTTYTGEYEDVKAINDLLVERGIDCPI

SEQ ID NO: 44359 - protein, 281 aa, Zea mays
YSQEATASLCGFRCFTDLPASLVCEVLARLDAKDLGIVSCVSTLLHALATDHQGWKKLYCERWGLPDLPTTLNGPLLPGVPLDGKFWKTFFVEREFRSKSFMGRFNLDILRGHNEDVRAVSLLVSANLIFTGGRDSVVRMWKMEEGLLIDTSRALGGTIRAIAADSRLLVSGGTNAYIQCWRAVEGNGQLFHISGSGTDQNAEFRLWGHEGPVTCLALDSLRIYSGSWDMTVRVWDRDQMECVQKFMHADWVWDLALRGNTVASTAGRDAYVWDIRAGELT

SEQ ID NO: 44360 - protein, 455 aa, Solanum demissum
MAATIVRSPKLSLSLPPPESTTSNLPSLNQSFFTPLPKRRRCISIYACTAGDQSNSAFGGEIKKGQAIELNKVNDENPYEFNAKDSPNPLPRPLTSADLSNMASEGSRLRVAYQGVRGAYSESAAEKAYPNCEAVPCEQFDTAFDAGDIHAGLHYSKPVLVGGHIPPGGLVEERASFAFLYDEFQILLVDIYSNQRQRFILFNLLKAVERWLVDRAVLPIENSLGGSIHRNYDLLLRYRLHIVGEVKLAIRHCLLANNGVKIEDLKRVLSHPQACFFCFLIIYMALAQCENTLTKLGLVREAVDDTAGAAKYIAFSKLKDAGAVASLAASRIYGLNVLAQDIQDDSDNVTRFLMLAREPIIPRTDKPFKTSVVFSLDEGPGVLFKALAVFAMRSINLTKIESRPLQKQALRVLEDSVDGFPKLFLKDPQLKNFVFRKWFEINVRVKHPKVWPGGQ

SEQ ID NO: 44361 - protein, 100 aa, Narcissus pseudonarcissus
KVEVKDSQVEFKLIMKMVWLQLVKNPNTYASIFGLSWALVSSRWHIKKPAIMENSVTMLSNAGLGMAMFSLGLFMALQPRIIACGKKQAAIGMLIRFIVG

SEQ ID NO: 44362 - protein, 485 aa, Triticum aestivum
  misc_feature (55)..(55): Xaa can be any naturally occurring amino acid
  misc_feature (163)..(163): Xaa can be any naturally occurring amino acid
  misc_feature (231)..(231): Xaa can be any naturally occurring amino acid
  misc_feature (239)..(239): Xaa can be any naturally occurring amino acid
  misc_feature (259)..(259): Xaa can be any naturally occurring amino acid
  misc_feature (363)..(363): Xaa can be any naturally occurring amino acid
MVKICCIGAGYVGGPTMAVIAVKCPAIEVVVVDISKPRIDAWNSDKLPIYEPGPXEVVKACRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGXTAIEDLFKPDRVLIGGRETPEGRKAVQALKEVYAHWVPEENIITTNLWSAELSKLAANAFLAQRISSXNAMSALCXEATGANVSEVSYAIGKDSRXIGPKFLNASVGFGGSCFQKDILNLVYICECNGPPGRWPNYWKQVIKINDYQKSRFRQPLSVSSMFNTVSGKKVAILGFAFKKDTGDTRETPAIDVCKGLLGDKXMLSIYDPEVTEEQIQRDLAMNKFDWDHPMHLQPTSPSAIKQVSVVWDAYEATKGAHAVCILTEWNQFKELDYQKIFDNMQKPAFVFDGRNVVDAEKLREIGFIVYSIGKPLDAWLKDMPAIA

SEQ ID NO: 44363 - protein, 255 aa, Narcissus pseudonarcissus
TVMQGNSLGLSDYAYSFPLPATVLGSLDSQNVSLYVNTTRKPTANIQKTQVVNDPAAPYVVSFSSRGPNPITSDILKPDLTAPGVDILAAWSPIASMSTYAGDERSVPYNIISGTSMSCPHASGAAAYVKSFHPTWSPAAIKSALMTTAHRMNSTSNSDAEFAYGAGQINPIAALNPGLIYDADESDYVRMLCGQGYSTGNLQLVTGDNSSCTSTNNGTVWDLNYPSFTLSVDSGRTFSQFFNRTVTNVGSPSSS

SEQ ID NO: 44364 - protein, 594 aa, Zea mays
MGSFLRKQPSYLFILIILHLVAHEARTLSSDGEALLAFKKAVTNSDGVFLNWREQDADPCNWKGVRCDSHSKRVINLILAYHRLVGPIPPEIGRLNQLQTLSLQGNSLYGSLPPELGNCTKLQQLYLQGNYLSGYIPSEFGELVELEALDLSSNTLSGSVPHSLDKLSKLTSFNVSMNFLTGAIPSSGSLDNFNETSFVGNLGLCGKQINSVCKDALQSPSNGLQSPSPDDMINKRNGKNSTRLVISAVATVGALLLVALMCFWGCFLYKNFGKKDMRGFRVELCGGSSVVMFHGDLPYSSKDILKKLETMDEENIIGAGGFGTVYKLAMDDGNVFALKRIVKTNEGLDRFFDRELEILGSVKHRYLVNLRGYCNSPSSKLLIYDYLQGGSLDEVLHEKSEQLDWDARINIILGAAKGLSYLHHDCSPRIIHRDIKSSNILLDGSFEARVSDFGLAKLLEDEESHITTIVAGTFGYLAPEYMQFGRATEKTDVYSFGVLVLEILSGKRPTDASFIEKGLNIVGWLNFLAGENREREIVDLNCEGVHTETLDALLSLAKQCVSSLPEERPTMHRVVQMLESDVITPCPSDFYDSE

SEQ ID NO: 44365 - protein, 345 aa, Bacillus cereus G9241
MKAVVVNKNSKANIEVIEKELRPLHSGEALVDVEYCGVCHTDLHVANHDFGNTDGRILGHEGIGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSNIKPGQPIVIYGCGGLGNLAIQYAKNVFGAKVIAVDINDDKLALAKEVGADMTINPISQGPADKIVQDEFGGAYAAVVTAVSKVAFNSAVDAVRACGKVVAVGLPVETMDLNIPRLVLDGIEVVGSLVGTRKDLEEAFMFGAEGKVVPVVQTCSLDRVQNVFEEMEQGRIQGRMVIDFKQHNCDCK

SEQ ID NO: 44366 - protein, 193 aa, Zea mays
MGVAVLNPQDCLKQPFSHMKYPRNHTACPNRHQKKPVPNRTRRSPPRNQTTRSPPKAPPPPPQRAAVSSYVPKGTVEKSPTKNVVVGQVRILKRGEEIPKKTLELVVEKTNLVVEKTDLVVEKPDLVSTQRIGPDPCLIPSQIRLSDRKSKKTTVVPFYAGPVTMTSPPPSDVPLPAFFTTKRTLQPYHQLLR

SEQ ID NO: 44367 - protein, 351 aa, Chlamydomonas reinhardtii
MLPGRALRCSRGTHQPRIQVEMCRDAGLGVEFVLRVATALKAKPNGPPQPAQDKAAAAPSAPAPAPWRNPFSPPEPELTVGPLGPTGTHTAVLNKFNVVAHHVLVITNQFRSQAEPLHGADLAAALEVLQAMPEGGVAFYNCGPESGRSQPHKHLQLGAAFDKLLQLAFPGYSYSPPPAMAALPPGASPTDAATAAAVAAGSVSYNVLMTRQWLLLAPRRTERCGPLALNSLAFAGTILVRSEEELGFVREKGPGSILAEIGVPCRQHASIRYNFDTKQFELVVLGKNGVSVDHGDGNFHLYTPESPPTALKSRDLLMLGEKKFYFLLPRTLGPPLPPPLWCSPAQPTPDM

SEQ ID NO: 44368 - protein, 544 aa, Bacillus clausii KSM-K16
MPKVASMIVKFIKEKGCKTVFGVPGKPVVPLILAMEESGVSFVLARHEGGAGFMATGYALQTGGLGVAIGTSGPGGTNMITAAAQAQAFHAPVLFITGHPPLSQSGMALGQDSSMFGTDLVALFKPVTKFSAKVESKGMLKRYLQHAEEQALTGAKGPVHLSVPLDILIEEVDEFTLSRLPVQDHIRSGNIQLAIKALNRAKRPLMLVGKGAHFSGAYKEVEQVAEKWSLPVVTTPGGKGTFVTDHPLSLGSLGLGGTEGAAAYVKDKPIDLLLVVGSKLSDMSTVGLTAGGMPSQVLHFDYQGLFVGKSLPADTLFVQGDAKINLQQLLLEAKEFPQRQQVDLREYRDRNRAPVDGCDRLSTAQTMGALREVLPADTVVYGDDGSHTFYAIKHFRTLVPGTFYFDDVFGAMGHAIGLSIGAKMAQPQRPIACFTGDGCLYMHGTEIATAVDQKTNVLFVVFNNGMLDMVDKGMKHNLGRTAGTRYEQEINAALFAESLGAKGFRCNTVAEVKEAVQKGNRFEGPVVVEVMVSKEETPPTLGRG

SEQ ID NO: 44369 - protein, 451 aa, Vibrio vulnificus CMCP6
MATHFDYICIGGGSGGIASANRAAMYGAKVALIEAKDLGGTCVNVGCVPKKVMWHGAQIAEAMSLYAPDYGFDVEVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLNALGTETHLFCRKESPLRSFDPMIIDTLVEVMAAEGPTLHTHSVPKEVVKEADGSLTLHLENGESQNVDQLIWAIGRHPATDAINLSATGVATNERGYIKVDEFQATNVAGIYCVGDIMEGGIELTPVAVKAGRQLSERLFNNKPNAKMDYDLVPTVVFSHPPIGTIGLSEPEAIAQYGEENVKVYTSGFTAMYTAVTQHRQPCKMKLVCAGEDEKVVGLHGIGFAVDEMIQGFGVAMKMGATKADFDSVVAIHPTGSEEFVTMR

SEQ ID NO: 44370 - protein, 374 aa, Silicibacter sp. TM1040
MALLETVDPDGLDEFSVVFTDRSLNHMSKEFQQVMLDINAMLKEVYKADATALVPGGGTFAMEAVARQFARDQDALVVRNGWFSYRWSQIFESGGLTKSATVLKARQIGNGAQSPFAPAPIEDVTKAILEQKPSIVFAPHVETSAGVILPDDYVTRMATAAHEVGALMVLDCIASGCAWVDMRATGVDVLISAPQKGWSASPSAGLVMLSKRALARLEETTSDSFAIDLKKWRAIMQAYEDGGHAYHATMPTDALRQFRDTMAETKAYGFKRLREAQWKLGNGVREMLAKKGVTSVAAEGFGAPGVVVSYTDDPQIQNGKKFSDQGMQIAAGVPLAVDEPDGFMTFRLGLFGLDKLYDVNGTLSRLKTVLDQLL

SEQ ID NO: 44371 - protein, 172 aa, Zea mays
  misc_feature (50)..(50): Xaa can be any naturally occurring amino acid
  misc_feature (144)..(144): Xaa can be any naturally occurring amino acid
MVKICCIGAGYVGGPTMAVIGLKCPNIEGGGGDIFKPRIGGRNQDPLPIXYNPGLIVVGNNGRARTLFLRTVVEKNVVEAAIFFVWGTTPTKTRGLEAGKVADLTYWKSAARLIADVSKSAKIVVKKSTVPVKTAEAMEKILTXTSKGLNYQILSNPEFLAEGTAIEDLFKP

SEQ ID NO: 44372 - protein, 633 aa, Gibberella zeae PH-1
MDAKPFRPRGAENAPHLQQQHKSTGNLANMAKSTTAAGFRGPAKRAAFGDVTNVSKQIGHTRDDGKSIKVYATNGVSHGLTGVPVSKENGAYGKEAFSRPAQRIANQASTRTALENKNFDANKKPYVRKDGHVATKPPAPSSVQNAPSLQPRHHKSQPQLKPQQQPNSLRRTQSKQLDKVVPKPDADTGHKATNPAGFQLQETEYPYDHAAYLDSMYLPIEAGAPLDVLQKEEYPELPAKLPEISEDDAAIHSFEEAHMPAMSEPEECWEEDEDEDYDDQDQAYTTAHSVRSRDMTAGGATEIDPLPRVTARVQRELEDAREEVERTRTTDEIEEEMWDVSMVAEYGDEIFEYMRELEIKMLPNAHYMDDQTEIQWSMRSVLMDWLVQVHNRFGLLPETLFLTVNYIDRFLSQKIVSIGKLQLVGATAILVASKYEEINCPSLGEIVYMVDNGYTAEEVLKAERFMLSMLSFELGWPGPMSFLRRVSKADDYDLDTRTLAKYFLELTIMDERFVASPPSFLAAGAHCLSRLILKKGDWTKQHVYYSGYTWGQLKSLVTMMIECCDRPHLHHAAVFDKYTDRRYKEASLLVQSALDAGFTLPHQVAPVRQELDAYREDSAELPIAQPQLIPIEG

SEQ ID NO: 44373 - protein, 241 aa, Frankia sp. EAN1pec
MQPLVLERAGRKHLSGHRSMQFGRETTAAEVLQGVDLEGRRAIVTGASSGIGVETARALADAGAEVTLAVRNTEAGGRVADDIIAGTGNKAIFVSKLDLADRASVTGLVEAWNGPLHILVNNGGVMALPQLQRTPEGWEQHFATSHLGHFALALGLRDALAAAGSSRVVSVSSDGHVHANAPVDFDDIRFERRDYSGHRAYAQSKTANILFAVEGAKRWAKDGIAVNALHPAGSRPASSGT

SEQ ID NO: 44374 - protein, 376 aa, Vibrio angustum S14
MTDKFIKSKAAIAWGPNQPLSVEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPEISLAKINKEAPLEEVCLLGCGVTTGMGAVLNTAKVEEGSTVAVFGLGGIGLAAIIGATMAKASRIIAVDINEEKFELARKLGATDCINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 44375 - protein, 557 aa, Oryza sativa Japonica Group
MATRRALTSVLRSASRLRAASPSPCPRRAPLHPHRRPSPAGFLLNRAAAAYASSAAAQAAPAPPPASGKATGGGKITDEFTGAGAVGQVCQVIGAVVDVRFDEGLPPILTALEVLDHNIRLVLEVAQHLGENMVRTIAMDGTEGLVRGQRVLNTGSPITVPVGRATLGRIMNVIGEPIDEKGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVQSFQGVLDGKYDDLPEQSFYMVGGIDEVIAKAEKIAKESAS

SEQ ID NO: 44376 - protein, 854 aa, Silicibacter sp. TM1040
MDTTPKSTLITATAPIANQTHGGRAKCLQRLVRLELPVPQTVALSFDAVHEIAEGYMVDVNAILADLRPGALLCVRPSSEDPDWGGPGAVLNIGMNDARYVELSDTLGPAAAAALYLRFVQSYAVHVARLDPDVFEDVEDGGPDALSEMLQAYEAEAEEPFPQDPGEQLAAVLRSMARAWEGTSARLLRAAKGAPEDAGLGLIVQEMVPGLGQGECGSGVLQLVNSQTGLPQITGRYLSQSQGRDALGVDAEAIYLEQDERGPSLEELAPEAFAELKAHAALMRRKLRAEMQVEFVIENGRVHILDGVRVPRSSRAAVRIAVRLAEDGIIPAEEALMRVDAYSLNELLHRQVDPNAKRDVIGSGIAASPGAATGRLVFTATEAQASKSRGEPCILARRETSPEDVRGMHAAAGVLTEKGGMTSHAAVIGRGLGLPCIVGASRLRFDSRRKQLTAPDGRVFKAGEIITVDGTSGEVLAGEPAMVEAAEDDALVTLMAWADAARDIAIRANADTPADAQTARNFNAEGIGLCRTEHMFFDPGRLTVMREMIFAETSSGRAAVLARLLPMQRKDFRELFRIMEGLPVCIRLFDPPLHEFLPTTTAGQRELSEALGLPVSDVTRRVAEMGEYNPMLGLRGVRLGVTVPEIYDMQARAIFEATLEASRDGAPVVPEIMIPLVSAKREVELVKARIDAVAAAVKSERGADFTYRLGVMVETPRAALRADEIAAHTAFMSFGTNDLTQMTYGLSRDDAGRFMSAYVQQGVFPEDPFHVLDVDGVGELLQLGVQRGRMAKPEITLSICGEHGGNPESIAFCREAGFDYVSCSPFRVPVARLAAAQLAIADKTGQIAPTYIKN

SEQ ID NO: 44377 - protein, 173 aa, Rickettsia conorii str. Malish 7
MFIDKIKAKANNYEINVIIEIPMNSGPIKYEFDKESGAIFVDRFMQTTMSYPCNYGFIPHTLSNDGDPVDVLVVAHHPVVPGSVIKCRAVGVLMMEDESGLDEKIIAVPTSKLDITFDHIKELDDLCDMLKQRIVHFFEHYKDLEKGKWVKVTGWENKSKADALINEGIDRVS

SEQ ID NO: 44378 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 44379 - protein, 513 aa, Solanum demissum
MAGLSLAAGGWTSNLIVFLINEFNMKSIAAAKVFNVVNGLTTIFPIVGGIIADSYLGCFSVIWISSLISALGILLLLLTVVIDALRPLACGDGSSLCTSPSTNQYVFLYVSLALASIGVGGTRFTVAPMGAYQFDKPKHQTMFFDWYIFIFYLCWALSTAFIVYVEDNISWAWGFGISMACNILGLAIFLAGKRFYRHVKEQGGSPFVNLARVVVAATQKWRAPLSDQTQHYYHDPSDKTTLVPTKFFKFLNCAAIITEGDTKPDGSICNPWRLCTVQQVEDLKSLIKLFPLWASGLLISTQLVMQLSLLTLQALKMDRHMGPHFEIPAAISIIDRILNPFLAKYTTFSLTPLQRVGIGHALTISCMAVSALVESRRLRVARSHHLQGQKDAIVPMSVFWLLPQLALNGIGEGFHFPGHIAFYYQEFPTSLKNTSTAMVSLFIGIAFYLGNVLIDVVQRETGWLPDNINDGRMDNVFWLCCTLGSVNFIYFLLVASFYKYKNMESKPNNVPSK

SEQ ID NO: 44380 - protein, 531 aa, Solanum demissum
MAGLSLASGGWTSNLIVYLIDEFNMKSIKTAKVYNVINGCTTLFPIVGGILADSYLGSFSVIWFSSLISALGILLLLFTSAIDVLRPPPCDDGSSLCTSPSTHQYAVLYVALALASLGVAGTRFIIAPMGANQFDKPKHQAIFFNWYIFAFYMSFAISTTVIVYVEDNVSWSWGYGISMAFNILGLAMFLIGKRFYCDVKEQGGSPFVNLARVIVVAIQKWRVPLSEQTQHYYHDPSDTTTTLTITQIPTKSFKFLNCAAFITEGDTKPDGSISNPWRLCTVQQVEDLKSLIKLFPLWASGFLISTQLVIQASLLILQALKMDRHMGPHFEIPAGSMLVFILLFTCIAIFIIDRFLYPFLAKYTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAHYLGNTLIDLVQRLSGWLPDNINKGRTDNVFWLCCILGSANFMYYVVCASLYKYKNVDNKSNIAPSK

SEQ ID NO: 44381 - protein, 531 aa, Solanum demissum
MAGLSLASGGWTSNLIVYLIDEFNMKSIKAAKVYNVINGCTTLFPIVGGILADSYLGSFSVIWFSSLISALGILLLLLTSAIDVLRPPPCDDGSSLCTSPSTHQYAVLYVALALASLGVAGTRFTIAPMGANQFDKPKHQAIFFDWYIFAFYTSFAISTTAIVYVEDNVSWSWGYGISMAFNILGLAMFLIGKRFYRDVKEQGGSPFVNLARVIVIAIQKWRVPLSEQTQHYYHDPSDTTTTLTKTQIPTKSFKFLNCAAFITEGDTKPDGSISNPWRLCTVQQVEDLKSLIKLFPLWASGFLISTQLVIQTSLLILQALKMDRHMGPHFEIPAGSMSVFILLFTCIAIFIIDRFLYPFLAKHTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAYYLGNTLIDLVQRLSGWLPDNINKGRTDNVFWLCCILGSANFMYYVVCASLYKYKNVDNKSNIAPSK

SEQ ID NO: 44382 - protein, 347 aa, Oryza sativa Japonica Group
MANPAAAAGPSGGARSFLQAVSTVTEEAPSPLRVVQMEGLAVLKIIKHCEEFAPALVTGQLLGLDVGSVLEVTNCFPFPMREDDEEADADGANYQLEMMRCLREVNVDNNTVGWYQSCLLGSFQTVELIETFMNYQENIRRCVCIVYDPSRSNQGVLALKALKLTDSFMDLYRNNGLTGEKLREKKLSWVDIFEEIPIKVSNSALVSAFMTELEPESPVSQCDFDRLKLSTAPFMERNLEFLIGCMDDLSSEQNKFQYYYRNVSRQQSQQQAWLQKRRQENMARKAAGEEPLPEEDPSNPIFKPIPEPSRLEGYLVTNQISSYCNHINGVAGQNFNRLYLMKALQED

SEQ ID NO: 44383 - protein, 140 aa, Zea mays
  misc_feature (59)..(59): Xaa can be any naturally occurring amino acid
  misc_feature (63)..(63): Xaa can be any naturally occurring amino acid
  misc_feature (121)..(121): Xaa can be any naturally occurring amino acid
DLTHAILSVAYGMLTGDHCRICDVGDLCALVSSPFQGDITAPHDKPPHRELLYHLHHNXMHEXPAMDDLLSTTLSYERYFSYYSFYELGGLDRDDEREVLTYYAVAPSQRTGQRAQVSLSXLIMPVLLPQLRSSCPLLLP

SEQ ID NO: 44384 - protein, 527 aa, Synechococcus elongatus PCC 6301
MSLEVLATEPALEYGLERFFLALVVALSVATLPQVFSWFRQIPYTLLLVIAGLGLALFNVRLINLSPELILSIFLPPLLFEAAWNLKWNNLKKDWVPISLYAVIGVGISILGIAFGLSQTTSVPIVIALLIGASLATTDPVSVIAMFRELGVAERTRTLVEGESLFNDGVAVVTLSLLLALPLEVQGFEAKSLLADLIRYLGIGIGSGCLIGFGVSFLTQRLDLPLLEQSLALVAAYGSYLLSEQLGGSGVIAVVPVGLILGNFGSRIGMSPRTRVIVTEFWEFLAFFVNSIVFLLIGDQVPLESLWQNRGAIAITVVAMLAARAIATFGLGWLSNRLSHSDLSWRELVVVWWGGIRGAVSIALALSIPTVLLQRDLITATVFGSVLFTLLVQGLTMKPLLGALGLLGDQALRQQYAEAIARQTALQRVLLRLQQAEPQAEIDPEFCREQIQLIEAKLKSLAQELTELCDRQPELQHYALESLQDELLAIEADTYAEFVRSGQLSQELSPILGETLSFPAQPPAIPD

SEQ ID NO: 44385 - protein, 231 aa, Triticum aestivum
  misc_feature (61)..(61): Xaa can be any naturally occurring amino acid
  misc_feature (88)..(88): Xaa can be any naturally occurring amino acid
MAPSQEVAAATKEPSTNGNGTQAAAAPKTKTPALNERILSSITRRSVAAHPWHDLEIGPGXAPTIFNCVIEIPKGSKVKYELDKERTXGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYICEGLRR

SEQ ID NO: 44386 - protein, 391 aa, Nostoc punctiforme PCC 73102
MAMKAVCWNGANDVRVETVPDPKIINPRDAVIKITTTAICGSDLHLYNGYVPTMEKGDILGHEMMGEVVEIGSAVKNLNIGDRVVVPFPIACGNCWYCQHDFWSLCDNSNPNAWLAEKFMGYSPSGIFGYSHMLGGYAGGQAQYARVPFADTGLFKIPDGLTDEQVVFLTDIFPTGYMAADNCNIQPGDIVAVWGCGPVAQFTIKSAYLLGAERVIAIDRIPERLQMAKDQGKAEILNYEEVDVGEALKEMTGGRGPDACIDAVGLEAHGTGLEGVYDEVKQAVRLETDRPHVLRQVMIDCRKGGHVSIPGVYVGVVDKIPMGAAMNKALVFKMGQTHVHKYLNTLLDHIQNGRIDPSFVITHRLPLDEAPRGYEIFRDKKENCIKVVLKP

SEQ ID NO: 44387 - protein, 636 aa, Synechococcus elongatus PCC 6301
MHLSEITHPNQLHGLSVAQLEQIGHQIREKHLQTVAATGGHLGPGLGVVELTLALYQTLDLDRDKVVWDVGHQAYPHKLLTGRYHNFHTLRQKDGIAGYPKRTENRFDHFGAGHASTSISAGLGMALARDAQGEDYRCVAVIGDGSLTGGMALEAINHAGHLPKTRLLVVLNDNDMSISPNVGALSRYLNKIRVSEPMQLLTDGLTQGMQQIPFVGGAITQGFEPVKEGMKRLSYSKIGAVFEELGFTYMGPVDGHNLEELIATFREAHKHTGPVLVHVATTKGKGYPYAEEDQVGYHAQNPFDLATGKAKPASKPKPPSYSKVFGQTLTTLAKSDRRIVGITAAMATGTGLDILQKALPKQYIDVGIAEQHAVVLAAGMACDGMRPVVAIYSTFLQRAFDQVIHDVCIQKLPVFFCLDRAGIVGADGPTHQGMYDIAYLRLIPNMVLMAPKDEAELQRMLVTGIEYDGPIAMRFPRGNGIGVPLPEEGWESLPIGKAEQLRQGDDLLMLAYGSMVYPALQTAELLNEHGISATVINARFAKPLDEELIVPLARQIGKVVTFEEGCLPGGFGSAIMESLQAHDLQVPVLPIGVPDLLVEHASPDESKQELGLTPRQMADRILEKFGSRQRIGAASA

SEQ ID NO: 44388 - protein, 774 aa, Rhodopseudomonas palustris CGA009
MAGERMASYSEDLQAAALGYHRRPKPGKLEIQASKPLANQRDLALAYSPGVAAACNAIAADPAQAAELTVRANLVAVVTNGTAVLGLGNIGPLAAKPVMEGKAVLFKKFAGIDVFDIEIAAETVERVVETVAALEPTFGGINLEDIKGPECFEIEAMLKDRMKIPVFHDDQHGTAIIVGAAVKNALALTGKDISKVKIVAAGAGAAALACLNLLVSLGAQRKNIFVCDLEGLVYEGRNVLMDRWKEVYAQKTDKRTLAEVIPGADIFLGLSGPNVLSQDMVKQMAERPLVMALANPTPEIMPEDVRKVRPDAMICTGRSDFPNQVNNVLCFPYIFRGALDVGATAINEAMKHAAVDAIAQLAREAPADPVSVGLDNDEAFGFGPGSLIPSPFDPRLILRIAPAVAMAAMDSGVATRPITSFDDYYAQLERFAFRSGLVMKLVFAKAKGQPVRVIYAEGEDEKVLHAVQTILEEKLARPILVGRPSVVEARIKRSGLSIRPGEDFDLVNPQDDPRYRSYVQSYIDIAGRAGVTPAAARTVVRTNSTVIAALAVARGEADAMICGLDGRYMNHLRHVRDVIGRRPGVSDYAALALLITKKGPIFIADTQVRPNPTAEELAELAALAAVHVQRFNIKPKIAFLSHSDFGSFPTDSSLKMRRATAILAEKHPEIEADGEMQGDSALSETSRQMILPHSRLTGVANVLIMPNLDTANVAYQMIKVVGEALPVGPILIGPALPAHILTPSATARGILNMTAVAVVEAQERAGRHQGTLFA

SEQ ID NO: 44389 - protein, 492 aa, Rhodopseudomonas palustris CGA009
MTAHFPFDNSYVALPPNFFARVAPTPVAAPRLIKLNRPLAVQLGLDPDLLETPEGAEILSGNQMPETAASIAMAYAGHQFGNFVPQLGDGRAILLGEVVDRNGVRRDIQLKGAGRTPFSRMGDGRAALGPVLREYIVSEAMAALGIPTTRSLAAVLTGETVLRDPIQPGAVLTRVASSHIRVGTFQYFAARGDLASVRALADHAIARHYPEAAQAPSPYLALLEGVIGRQAELVASWMMVGFIHGVMNTDNCSVAGETIDYGPCAFMDTFDPKTVYSSIDQFGRYAYGNQPPIALWNLTRLAECLVRLLADDDDKGIEIAQTALGGFAEQFNAAYLAKLAAKLGLFTSQPDDQQLSQEFLTALAKGEADFTLAFRRLSDAAVDPSDLGEVRALFADPAAFDEWAPRWRARIATEPQDATTRQAAMRRVNPAYIPRNHRIEAVIRAAVDRDDFAPFEEILTVLANPFEEKAEFARYAEPPQPHEQVLETFCGT

SEQ ID NO: 44390 - protein, 135 aa, Glycine max
MADAGSADRRGRRGGRRGGRGRRGEGGAEGGSRRGGDRRGARRGGNSASARAGGKGDEEKWVPVTKLGRLAKDGKIQQLEEIYLHSLPVKEYHIIDEFLGSKLKDEAMNIMTVRNYTTVVPRSRFKAFAVDCDLE

SEQ ID NO: 44391 - protein, 363 aa, Photobacterium sp. SKA34
MGFKCGIVGLPNVGKSTLFNALTKAGIEAANFPFCTIEPNTGVVPVPDPRMDALAVFVNPERILPTTMEFVDIAGLVAGASKGEGLGNKFLANIRETDAIGHVVRCFENDNIVHVAGRIDPLEDIDIINLELAMADLDTCERAIFRLAKRAKGGDNDAKFEIKVLEKMQPILTDGGMARSMELSKEELAAVDYLHFLTLKPTMYIANVNDDGFENNQFLDKVIARAAEENAVVVPVCAAMESEIAELDDEDREEFLADMGIEEPGLNRVIRSGYELLSLQTYFTAGVKEVRAWTIPVGATAPKAAGVIHTDFEKGFIRAEVIGYDDYINCGGESGAKEAGKWRLEGKEYIVKDGDVVHFRFNV

SEQ ID NO: 44392 - protein, 315 aa, Photobacterium sp. SKA34
MPDMKLFAGNATPELAQRIADRLYISLGDATVNRFSDGEVCVQINENVRGSDVFIIQSTCAPTNDNLMELVVMIDALRRASAGRITAVIPYFGYARQDRRVRSARVPITAKVVADFLSNVGVDRVLTVDLHAEQIQGFFDVPVDNVFGSPVLLEDMLAKDLQDPVVVSPDIGGVVRARAIAKLLDDTDIAIIDKRRPRANVSQVMHLIGDVEGRDCIIVDDMIDTGGTLCKAAEALKERGAKRVFAYATHPVFSGSALENIRESVIDEIIVTDSITLTKEIEATGKVSVLTLSGMLAEAIRRISNEESISAMFEH

SEQ ID NO: 44393 - protein, 153 aa, Streptococcus pneumoniae
EHFIRGQYRSGKIDGMKYISYRSEPNVNPESTTETFTSGAFFVDSDRFRGVPFFFRTGKRLTEKGTHINIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 44394 - protein, 153 aa, Streptococcus pneumoniae
EHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 44395 - protein, 246 aa, Zea mays
MSPTPAPAARAGEELPSTEVVVVRHGETAWNASRVVQGQMDPELNEAGRRQAVVVARRLSREAKPAAVYSSDLRRAAETAETIARACGVSNVVLTEALRERHMGYLQGLRWDDAVDKSPDSLHIVKVIEGSDPDSRNQELPGGGESLNQLNERCVCFVNKIAQEHAGERVVVVSHGAAILELCRHTDPPGSCVRRHVPNTSLSVFRVSAATGQWALERCGDVGHLKGHGDGDGFLEGSFGGDGASA

SEQ ID NO: 44396 - protein, 106 aa, Triticum aestivum
DAPVPPCITQLQGGLVQGAIEVEDRAQRSAITRVNADDVRVAVAAPAARGEANNELLEFMGKVTFFNLNSWQYFRYLNVYGIRLHWYLYGYKSNNVFKLLTRTCLY

SEQ ID NO: 44397 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKRTFFGNFKPRTDLPNVVEMYMKKELEVEKFITHSVPFSEINKAFDLMAKG

SEQ ID NO: 44398 - protein, 367 aa, Vibrio angustum S14
MALSSAKEIIDDIRQGKMVILMDDEDRENEGDLIIASEKITPEAINFMATYGRGLICLTLSKARCQKLNLPLMVQENTEQFGTPFTVSIEAAEGVTTGISAADRSRTVQAAVAANATAADIVMPGHIFPLMAQEGGVLTRAGHTEAGCDVARLAGLEPSSVIVEILNEDGTMARRPQLEVFAEKHGLKLGTIADLIEYRNNHETTIERVAECRLPTEFGEFDMITYRDKIDNEVHYALRKGGIKAGEETLVRVHLQDTFKDILQSGATQWTLPAAMKRISEESGVLVILSKQESTDAIIHKVKNIAAEEAGQPKVKVTQKDPSRQVGVGSQILSDLGVSKMRLLSSSTQRYHSLSGFGLEVVEYICD

SEQ ID NO: 44399 - protein, 156 aa, Vibrio angustum S14
MKVIEGAIAAPNAKVAIVIARFNSFINESLLSGALDALKRQGQVSEDNITVVRCPGAYELPLVAQQVAKSDRYDAIVALGSVIRGGTPHFDYVAGECNKGLAQVALEYNTPVAFGVLTVDSIEQAIERAGTKAGNKGAEAALSALEMVNVLSQIES

SEQ ID NO: 44400 - protein, 148 aa, Triticum aestivum
MAADRRHPAVNDVYLTLVGASNTLADVQRRLDLEFRASYPDHANPAKLVGRVKRVQEEVAALKDLCRDLLAQKQELIDMMRTSLAAQRSATQRLLASSGLPLMTDDEEAAYASLKQVIDEWTDQLKPMAGGPDGENEDTNQILFSAIL

SEQ ID NO: 44401 - protein, 398 aa, Cryptococcus neoformans var. neoformans JEC21
MSNSATQPQHHWHGVLSSALDAVGHTPLIRLDRIAAEEGFKCNLLGKCEFFSAGGSVKDRIAKRMIEHAEKSGQLIPGKSIVIEPTSGNTGIGLALACALKGYKCIITLPAKMSLEKEVMLKALGAEIVRTPTEAAFDSPESHIGVARTLQQAIPDSVILDQYSNPNNPLSHYFGTYEEIMYALETSNLPRKDMTLLVAGAGTGGTITGLARAIRDSEAHVYPSGSDCSNPINGKSNGFKASRTLILAVDPVGSILGGGEPGNYEVEGIGYDFFPDVLDREPQLIDEWLKTTDDESFEATKRLIKREGLFVGGSSGSAFAGALYYLQSPAGRHIAEDPEANVVILFPDGVRNYMSKPWFLTENNAREGQELRAKIKDVIGRDLGDVHGGRATNNVNKH

SEQ ID NO: 44402 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKASDLMAKG

SEQ ID NO: 44403 - protein, 100 aa, Glycine max
  misc_feature (13)..(13): Xaa can be any naturally occurring amino acid
  misc_feature (81)..(81): Xaa can be any naturally occurring amino acid
MASSTISDPAVTXVNHAQADIVTTFTDLKSKTALPTRNTNNDITSIGSNTGRVHFMQAYPAHNKNNTDTVSYLAHLYDAQXSKDEEYLIMNGWMNCLQFK

SEQ ID NO: 44404 - protein, 188 aa, Methylobacillus flagellatus KT
MLLMLDNYDSFTYNLVQYLGELGQNVQVYRNDEIDLAGVAALNPRHIVISPGPCTPNEAGISVPLIHEFAGKIPILGVCLGHQSIGQAFGGKIVHAKQLMHGKTSEIHHADLGVFKGLPNPYTATRYHSLVIERESIPDCLEITAWTEDGEIMGVRHKTLPIEGVQFHPESILTQYGHELLNNFLKAY

SEQ ID NO: 44405 - protein, 146 aa, Brassica napus
RHERLAQRGESLILELLPEELRGSTIEIVPYFFDSFGNASRIDYGTGHETNFAAWLYCLARMGVIKEEDYHGVVARVFVKYLELMRKLQMVYCLEPAGSHGVWGLDDYHFLPFIFGSSQLVDHKYMKPKSIHNDDILENFSGEFMY

SEQ ID NO: 44406 - protein, 474 aa, Streptomyces ghanaensis
MTSTAQQPAAGGLAARPNQLRHVVFIAASAAMGGFLFGYDSAVINGAVEGIRGRFDVGAATLGAVIAIALLGAAAGAMLAGRLADRVGRLRVMQLAALLFLASSIGSMLPFTAWDLSFWRIVGGVAIGMASVIGPTYIAEVAPTEYRGRLVSFQQAAVVLGIAVSQLVNWMVLSLADGDQRGSLLGLEAWQVMLGIAAVPALVYGLLALRIPESPRYLVSVGRTGEAKEVLRTLEGAQVDLDARVAEIEHAARSDKAPRFKDLRGRFGLLPIVWVGVGLSVFQQFVGINVIFYYSSSLWQSVGIDPSSSFFYSFTTSVINIVGTVIAMVLIDRVGRKPLAATGSAGMAVSLAAVAWAFSYKTGTGDDISLPDTQATVALVAAHAFVLFFAMSLGVAAWVLLGEMFPSRIRAAALGVAACAQWVANWLVTATFPSMAEWNLSGSYVIYAIFATLAVPFILKWVPETKGRTLEEMG

SEQ ID NO: 44407 - protein, 247 aa, Zea mays
LSLVTPHHCLPASQVSLPHLLPPRNSLLLPEPKLSPAATQNKMQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAGIVTERDYLRKIIVQGRSSKSTKVGDIMTEENKLITVKPETRVLKAMQLMTDKRIRHIPVISGTEMMGMVSIGDVVRAVVSEHKEELNRLNAYIQGGY

SEQ ID NO: 44408 - protein, 139 aa, Oryza sativa
  misc_feature (109)..(109): Xaa can be any naturally occurring amino acid
AELFIHESEHRTAVAAGVLICRGHSPAYSKRVFYLIAMNLINVENAFAQKHYCDLSSKPFFRGLVEHIVFGPGGAMDWEGKHGVSTDRKLVGATNHLAVERGTIRGDFXAVYIRQDGIHGSDSIENAMKEIALCVPEGI

SEQ ID NO: 44409 - protein, 251 aa, Vibrio angustum S14
MTDTTQDTTHFGFRTVAKDEKATMVAEVFHSVAAKYDIMNDLMSMGIHRVWKRFTIDCSGVRKGQRVLDLGGGTGDLTAKFSRIVGETGQVILADINNSMLNVGRSKLRDSGIVGNVGYVQANAEELPFPDNYFDCITISFCLRNVTDKDKALRSMYRVLKPGGRLLVLEFSKPLLEPLSKVYDAYSFHLLPKMGEIIANDAESYRYLAESIRMHPDQETLKGMMDEAGFDQTSYYNLTGGIVALHRGYKF

SEQ ID NO: 44410 - protein, 197 aa, Methanosarcina mazei Go1
MVLGSKLLDNVKMHLCTCSAGLRPTPDMEAFLKMPMRELYVSLPIHMDDGSIKVFKGFRVQYNEALGPAKGGIRFHPDETMETIRALAALMTWKCALHRLPLGGAKGGIVCSPKELSHRELERLSRAYIRAVYQIIGPDRDIPAPDMYTNPQIMAWMMDEYSKLAGKMSSAQLQANPQVWEVLLAGLMQRLKVACMR

SEQ ID NO: 44411 - protein, 324 aa, Haloferax volcanii
MTEEIVVIPGDGIGAEVIPAAVDVLKAVGDFEFVEADAGDHVKEETGEALPQETYDLAAEADATLFGAAGETAADVILPLRTAVDSFVNVRPAKAYPGVDALRPETDLVFLRENTEGVYSGHEDRLSEDLSTLTRVVTTSASERLAEYACDYVGGEGGSFQVAHKANVMRETDGRFRDAAVAVADERGVETEEVLMDAFATRVCLDPTQFDTIVCPNLAGDVLSDLAAGLVGGLGLLPSANIGPDAALFEPVHGSAPDIAGEGIANPAATILSAAMLLDYLDHEAEADRVRSAVEGVLADGPRTPDLGGDASTEDVTAAILDRL

SEQ ID NO: 44412 - protein, 306 aa, Prochlorococcus marinus str. MIT 9303
MNETRFMAAAVSTFFDFPAYLAAAKASVEEALDDSLGPERPEQLREAMRYSLLAGGKRLRPILCIAACELAGGEPTQALPTAVALEMIHTMSLIHDDLPAMDNDDLRRGRPTNHKVYGDAVAILAGDALLTRSFEMVALRSKGVAPERLLKVVGELSLVAGAPGLVGGQVVDLECEGKEVDLETLEFIHLHKTGALLSACVICGALIGGAEDDLIDALRIYARGIGLAFQIIDDILDVTASSDVLGKTAGKDLLADKTTYPKLLGLEESRRRAELLVSEAKAALDPWQSSAAPLLALADYITSRDR

SEQ ID NO: 44413 - protein, 420 aa, Photobacterium sp. SKA34
MTLLALGINHKTASVDLREKVAFSPEKLSLALQQLKNHPEVLSGVIVSTCNRTEVYCDISQSGPGVIIDWLTKFHQITAEELMPSLYFHEEQAAARHLMRVACGLDSLVLGEPQILGQVKQSYSESKDNEAVGGTLEKLFQKTFKVAKRVRTETDIGGNAVSVAYAACSLARQIFESLSGATILLVGAGETIELVSRHVVEQGCNSLIVANRTRERAEGIAQEFGAEVISLEEIPDYLHRADIVISSTASPLPIVGKGMVEMALKRRRHQPMLLVDIAVPRDIEQQVGELNDAYLYSVDDLHSIVEKNREQRKVAAIQAEAIVSEESAVFMQWLRSLEAVDSIRDYRQFAEQIKQELLQRSLQAIANGTEPEKALAELSNKLTNKLIHAPTKAMQQVAKNGESDKLAVIREALGLDSYND

SEQ ID NO: 44414 - protein, 216 aa, Vibrio vulnificus
MSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLLEDEEGSNSAE

SEQ ID NO: 44415 - protein, 580 aa, Zea mays
MRLPLPLLALVCCALMARQHCAAAGKARHLRWEISNMFWSPDCEEKVVIGINGQFPGPTIRARAGDTVHVQLRNALHTEGVVIHWHGIRQIGTPWADGTAAISQCAINPEETFTYRFVVDKPGTYFYHGHYGMQRAAGLYGSLVVDVAEGEEEPFQYDGELNLLLSDWYHESIHTQMVALSSRPFRWIGEPQSLLINGRGQFNCSLAAAHMLGATNTQCAATAANTQCAPVVLPVQPNKTYRLRVASTTSLASLNLAIGNHKLTVVEADGNYVDPFVVDDIDLYSGDSYSVLLTTDQDTSSNYWLSVGVRGRLPKTAPALAVLNYRPNRASDLPALAPPVTPAWDDYGHSKAFTYRIRARAGTPPPPPTAARRIELLNTQNRMDGRIRWSINNVSMVLPATPYLGSLKMGLKSTLAAARPAETFSREYGVTLPPPNPNTTVGDNVYVLAHNTTVDVLLQNANALSRNVSEVHPWHLHGHDFWVLGYGDGAYRGDAADEARLNLRDPPLRNTAVIFPYGWTMLRFVADNPGVWAFHCHIEPHLHMGMGVIFAEAVDLVAKVPNEAVSCGATATALMAGGHL

SEQ ID NO: 44416 - protein, 140 aa, Rhodopseudomonas palustris CGA009
MAIERTFSILKPDATERNITGAINALIEKAGLRIVAQKRIRMTRDQAETFYAVHKERPFFGELVDFMISGPVVVQVLEGEGAIAKYRDVMGATDPSKAADGTIRKLHAKSIGENSVHGSDAAETAKIEIAQFFSGNEIVG

SEQ ID NO: 44417 - protein, 474 aa, Bacillus cereus G9241
MKKHLYINGDWKSVNTYKPLYAPYSEETLAEIAQGTEEDVKEAVTAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPKGALNIISGPGSTVGEAIVTNDDVASITFTGSPKVGIGIKAKAGLKRVTLELGSNAAVIIDKDVELTDELIERVKWGAFVNNGQVCISVQRVFVHEERMDEFLSKLQKAMETLVVGDPLIEETDVSALISKKDVDRIDNWVQEAVKEGANVLYGGNKRDERIFEPTVLTNVPKHVSVQCQEVFGPLMTVNTFKEFDEAIEQANHSRYGLQAGVFTNNLFKAMRAIDELEVGGVMINDIPTFRVDHMPYGGVKESGTGREGIKYAIEEMTEMKLVCIKK

SEQ ID NO: 44418 - protein, 216 aa, Vibrio vulnificus YJ016
MSVKIHYQNTHFITSAPDIRHLPADEGIEIAFAGRSNAGKSSALNRLTNQKNLAKTSKTPGRTQLINLFKVTEGCHIVDLPGYGFAQVPLEMKNKWQKSLGEYLQKRECLKGLVVLMDIRHPMKDLDQQMIFWAIESRIPVQVLLTKADKLKSGARKAELLKVRKLAETFGGDVQVDVYSSLKGLGVDQLRAKLDTWFAPALAHLQEDEEGSNSAE

SEQ ID NO: 44419 - protein, 494 aa, Bacillus clausii KSM-K16
MGKPTGFLEYKREAPQKKDPFERTKNWQEFQLFMPEDKLRQQGARCMDCAIPFCQAGTTMAGSGEIGCPVYNLIPEWNDLVYRGKWREALDRLHKTNNFPEFTGRVCPAPCEGSCTVALNGDPVTIKSIEYHIVERGFQEGWIQPEPPKTRTGKHVAVVGSGPAGLAAAAQLNKAGHTVTVFERDDRIGGLLTYGIPDVKLANEVVERRVQLLEAEGITFKTEVEIGVDITAEELETSFDAVILATGATKPREVQAPGKELNGIHYAMDFLTANTKSLLNSQLADGEFISAKGKHVIVIGGGDTGADCITTSIRHGAASVIQFDINKQKGAMRSGDNVWPLYPIIHTVEDAHKEAMAVYGKDPRSYMLQTKAFFGNQDGQVTGLQTVEVTTELKNGQKIRTEIPGTERTWKADLILLAIGFTGPEQELLQQLGIETTSRTTVKAPYGKYTTSKPGIFAAGDNRRGQSLVVWAIHEGREAARECDRYLMGSTRLP

SEQ ID NO: 44420 - protein, 303 aa, Physcomitrella patens
MDQYEKVEKIGEGTYGVVYKARDRLTNETIALKKIRLEQEDEGVPSTAIREISLLKEMHHGNIVRLQDVVHSEKRLYLVFEYLDLDLKKHMDTCPDLAKDPRLIKTFLYQILRGIAYCHAHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRTLGTPNEEVWPGVTSLPDFKTAFPKWPPKPLSSVVPSLEPAGIDLLEVCDLSTPASEFCVVLFFFIISTFSLIVRLKQCMQSYAS

SEQ ID NO: 44421 - protein, 117 aa, Glycine max
MAEEGQVIGVHSVEEWKEHLKKGEESKKLIVVDFTASWCGPCRFIAPILAEFAKKLPNVTFLKVDVDELETVSKEWGIEAMPTFLFLKEGKLVDKVVGAKKEELRLTIAKHAAIAAA

SEQ ID NO: 44422 - protein, 536 aa, Silicibacter sp. TM1040
MTRGVLGLLAKNISPPNLSIMQDEGFTVARVRTELLSGLTVALALVPEAVAFAFVAGVHPLVGLYAAFLVGLITALIGGRPGMISGATGALAVVMVALVAEHGVEYLFATVVLMGILQVIAGVMHWGKFIRLVPHPVMLGFVNGLAIVIFLAQLTQFKQPGTGGEEWLAGPQLLMMLGLVVLTMVIIWGMPKLTKVIPAPLAGIGITAIIVIAFGLDVPRVGDMASIEGGLPSFHVPMVPFNMETLQIILPYAVILAAIGLIESLLTLNLVGEITGKRGGASQECIAQGTSNIVTGFFGGMGGCAMIGQSMINVNSGGRTRIAAIAAALFLLLFIVAASPLIEQIPLAALVGVMFMVVIGTFAWNSFKIMTKVPLTDAFVIVLVTVVTVMTDLAIAVVVGVIVSALAYAWNNARRIHAITRDSVSEKGAKVYEIQGPLFFGSTDGFIELFDVENDPDVVIVDFAASRVVDQSALQAIEAVAGKYEAAGKALQLRHLSRDCHELLSKAGHLMVDSDDDPEYGLAVDYSVKTGVLGGH

SEQ ID NO: 44423 - protein, 507 aa, Prochlorococcus marinus str. MIT 9303
MSTTITNPLRVGLRQERVIAPQCLVIFGASGDLTHRKLVPALFELYKQRRLPSEFALLGCARRPWSNEIFRQKMAEALGETINENQLAWDQFAAGLFYEPVDLQKPEDLIKLSHRLEEIDRLRATRSNRTFYLSVSPKFYGSGCKALANAGLLSDPKRSRVVIEKPFGRDYASAQSLNQIVQSCGQENQIFRIDHYLGKETVQNILVLRFANTIFEPIWNRNYISSVQITAAETVGVEERANYYESSGALRDMVQNHLTQMLAITTMEPPGRFDPEAIRNEKAKVLLAARLADELEPWNCCIRGQYAPGGTKEAPIAGYRQEPGVDPSSTTETYVAMKLFIDNWRWQGVPFYVRTGKRLAKRLSEVVLTFREAPVHLFDAAGGSPTANQLILRIQPDEGAEWRFEVKSPGSGMRSRPVEMEFSYDESFGEPSDEGYVRLLADAMLSDPTLFTRSDEVEAAWRLYTPLLELIEDSPWQLPIHPYESRTWGPAAADTLLANDGLLWRRP

SEQ ID NO: 44424 - protein, 291 aa, Synechococcus elongatus PCC 7942
MSERAIAHLGPVGTYAEMAALRFQAWLTQQDQQPSRLLACRSIPATLQTLADGAVDYAVVPVENSVEGSVAATLDSLWQLPQLSIQRALILPIAHALISFESDRTAIRQVLSHPQALAQCQQWLQRHLPQAELIPANSTTEALQDLERHPQRAVIASTRAAELYQMPIQSFPINDSPDNRTRFWVISRSPTPGGACTSLNFSLDANVPGALVKPLQILADRRINLSRIESRPTKRSLGEYLFFLDLEADLRDPAIAAAVQAVADCTEQLRVLGSYDSLDFTQSVLVPAQAR

SEQ ID NO: 44425 - protein, 99 aa, Brassica napus
  misc_feature (19)..(19): Xaa can be any naturally occurring amino acid
  misc_feature (53)..(53): Xaa can be any naturally occurring amino acid
MEMDLTPKLPDQVCGGDGXGTYYAWCPAEKPMLKEGNIGTHMLALKQYGVDVXNYDDPKVAYVLQGSGTDGIVLPETEETVTAIKKGDYIALHCAFRTL

SEQ ID NO: 44426 - protein, 443 aa, Vibrio angustum S14
MSSDTSKKIGLIACTGVVAGNMMGSGIALLPSTLAKVGSISIFSWIICLIGALSLAFVYARLATSNPQEGGPIAYAGEVSPAFGFQTGVLYYHANWIGNLAIAITGVSYLSVFFPILNNTIPAAIATIASVWIFTVINLLGGSWVSRLCTLGLVLILIPIVGTAVIGWGHFDSAMYMQNWNTSHGSNSHAIVSAVLITLWSFVGVESAAVSSGMVKNPKKTVPLATLLGTVIAGVIYILSTQVIAGMFPASEVAASGAPFALATTAIFGKWSAPFVAAFTALACFTSLGSWMMLVGEAGKRAANDGNFPAVFGETDKNGVAKKGLVLASVMMTILMIAITVFSSSDSHASNLFDILTSDAVLLTMLPYFYSAVNLIRYEGMTTRNVFVMLFSGVACIFCFIALIGADPSALAATFVVSLAIFIFYARKLGFRQHLQLEQQQKA

SEQ ID NO: 44427 - protein, 179 aa, Silicibacter sp. TM1040
MSTSKTVKDYIRTIVDFPHEGIMFRDVTTLFADPRGFRMAVDQMLHPYAGQRIDKVVGLEARGFILGGAIAHQLGTGFVPVRKKGKLPGATISQEYKLEYGEAVVELHKDAIQPGEKILVVDDLLATGGTAGAGIKLIEKLGGEIISCSFIIDLPELGGRKHLQSLGMDVHVLCEFEGL

SEQ ID NO: 44428 - protein, 190 aa, Gibberella zeae PH-1
MASDAPEKTAEQTPPAPEVPSEEAPPAPTVPESRLPTRKDVSLREFLNKMDDYAPIIPDAVTNYYMTKAGLPPPPQTDPRLARLLALATQKFIADIAADAYQYSRIRASSNTNNPMGSLGAAAGFPIPGQPTGQPGSKDQTKGAPLGIQRPGYGGGGQGGSQNRTVLTMEDLGMAVGEYGVNVKRSEFYR

SEQ ID NO: 44429 - protein, 156 aa, Haemophilus influenzae
NRANTPVLVDGKDVMPEVNAVLAKMKDFCQRIISGEWKGYTGKAISDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 44430 - protein, 420 aa, Silicibacter sp. TM1040
MTVKQDTLPNGFRIVTEYMPGLQSAALGIWVSAGGRHERLEQNGVAHFLEHMAFKGTKRRSALQIAEAIEDVGGYINAYTSREVTAYYARILKDDVDLALDVIGDIVLNSVFDEREIEVERGVILQEIGQALDTPDDIIFDWLQEESYREQAIGRSILGPAERVRSFNKEDLTRFVAEHYGPGQMILSAAGAVDHDRLVKAATEMFGHLEPKQQDVIECARFTGGEARHDKALEQAHVALAFESPSYRADDIYAAQIYAAALGGGMSSRLFQEVREKRGLCYTIFAQAGAYEDTGMMTIYAGTSGAQVSDLLGITVDELKRSADDMSDAEVERARAQMKAGMLMGLESPSNRAERLARLVQIWDRVPSLEDTVAKIDAVTTADVRAMAARISREAPAALALYGPVAEAPRLEEIARRRAA

SEQ ID NO: 44431 - protein, 621 aa, Vibrio angustum S14
MTLDISKYPHLALANTPDELRLLPAESLPQVCDELRTYLLKSVSQTSGHFASGLGTVELTVALHYVYNTPFDKVIWDVGHQAYPHKILTGRRDDMATIRQKGGLHPFPWRGESEYDTLSVGHSSTSISAGLGLAIAAEKEGLNRKVVSIIGDGAITAGMAFEAMNHAGDVHSDMLVILNDNEMSISENVGALNNHLAHLLSGNFYTSIREGGKKVLSNAPPIKEMVKRAEEHIKGMVVPSTMFEELGFNYIGPVDGHDVHELVKTLKNMRNLKGPQFLHIMTKKGKGYAPAEADPINYHAVPKFDLSQKPLPKAKDASPTFSKIFGDWLCDMAAVDDKLMAITPAMREGSGMVRFSKEFPDQYFDVAIAEQHAVTLATGMAIGGYHPIVAIYSTFLQRGYDQLIHDVAIMDLPVMFAIDRAGLVGADGQTHQGAFDISFMRCIPNMVIMAPSDENECRQMLYTGHQYQGPSAVRYPRGCGMEVDVDPKMTELEIGKGIIRRHGEKIAILNFGSMLGYALEAAENLNATVADMRFVKPLDETLVLELAKTHDVLVTVEENAIAGGAGSGVIEFLMKEKTLKPVLNIGLPDRFIEQGTQAELHEMLEIDGAGIEKQIRTYLAK

SEQ ID NO: 44432 - protein, 300 aa, Vibrio angustum S14
MTNSSSLSLSLKCYQQRSNDVLANWLSTQPFADKALLKAMQYGTLLGGKRARPFLTYVTGEMLGVTQDDLDTPAAAVECIHAYSLIHDDLPAMDDDALRRGQPTCHIAFDEAIAILAGDALQTLAFDILANGQLSQDGNTQRIAMVSELAKASGAAGMCLGQALDLDAEGKHVGLEQLELIHRHKTGALIRCAVRLGALAAGDKGVAILPQLDKYAEAIGLAFQVQDDILDVISDTETLGKPQGSDLALDKSTYPALLGLDGAQEKAQLLYQEALQALAAIPYNTSQLEVFARYIIERNN

SEQ ID NO: 44433 - protein, 231 aa, Prunus dulcis
NSCRARRMWNAARFAASSLTRSTRRFSTAIPGPCIVHKRGADILHDPWFNKDTGFPLTERDRLGLRGLLPPRVISFEQQYARFMESYRSLEKNTKGQPEGVVALAKWRILNRLHDRNETLYYRVLIDNIQDFAPVIYTPTVGLVCQNYSGLFRRPRGMYFSAKDKGEMMSMIYNWPAHQVDMIVLTDGSRILGLGDLGVQGIGIPIGKLDMYVAAAGINPQRILPVMLDVG

SEQ ID NO: 44434 - protein, 232 aa, Methylobacillus flagellatus KT
MAKPFRIAPSILSANFAKLGQEITDVITSGADIVHFDVMDNHYVPNLTIGPLVCEAIRPVTDAIIDVHLMVKPVDRIIPDFAKAGANIITFHPEASDHIDRSLSLIRDNGCKSGLVFNPATPLSYLDYVMDKIDMVLLMSVNPGFGGQKFIPGTLDKLREARARIDAYTEKTGREIWLEIDGGVNPSNIAEIARAGADTFVAGSAVFGAGKDTDPNRYDTVIGALRAELAKV

SEQ ID NO: 44435 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMEKG

SEQ ID NO: 44436 - protein, 165 aa, Aloe vera
SGYSLLRDPHHNKGLAFTDKERDAHYLRGLLPPVCISQELQEKKLMRSLRQYQVPLQRYMAMMDLQERNERLFYKLLIDNVEELLPVVYTPTVGEACQKYGCIFKRPQGLYISLKEKGKILEVLKNWPERSIQAIVVTDGERILGLGDLGSQGMGIPVGKLSLYT

SEQ ID NO: 44437 - protein, 109 aa, Brassica napus
MGNCLRHESETHWSGEDWDDDFITEHEEEQDHHHHHSSKTTSIKASKTIIVTQDSNSSHHEIKIRLTKKQLQDLLNQVNVHDLTGSDRKTGEGNHHRLWTPVLHSIPEV

SEQ ID NO: 44438 - protein, 536 aa, Petunia integrifolia subsp. inflata
MGTCMSVQNASFLKRTRNRPVPIDQETCSKNTSRTSVPKSQKFSRPLNVVKDPSGDDINKRYEFGKELGRGEFGITYHCVDKVSGENVACKTIAKSKLRTEIDVEDVRREVVIMRHLPKHPNIVSYKEVYEDKEAVYLVMELCEGGELFDRIVARGHYTERAAARVTKTILEVVKVCHEHGVIHRDLKPENFLYANATENAQLKAIDFGLSIFFEPGQRFSEIVGSPYYMAPEVLRRNYGPEVDVWSAGVILYILLCGVPPFWAETEEGIAHAIVKGTIDFNRDPWPRVSEEAKDLVKGMLDPNPYNRLTVEEVLDHYWIQNAEKVSNICLGEGVRAKIKQFTLMNKFKKKVLRVVADNLPQDQVHGIKQMFYMMDTDKNGNLSFQELKDGLHLMGQAVADPEVQLLMDAADVDGNGMLNCEEFVTMAVHLKRLSNDDHLRKAFLHFDKNKSGYIEFEDLKDSLFDDHLGPKNDQVIHDIIFDADLDKDGRISYQDFKVMMSTGTDWKMGSRQYSKAMLNALSMRLFKDKSIQVKN

SEQ ID NO: 44439 - protein, 414 aa, Methylobacillus flagellatus KT
MHLFTVGVNHTTAPVSIRENVAFQNEHLSGALRDLNSHGIREAAILSTCNRTELYCNTDDPQKALEWLANYHRLKPQAIAPYMYTLPQENAVKHAFRVASGLDSMVLGEAQILGQMKQAVRIAENAGTLGTLLHKLFQRTFSVAKEVRTNTNIGANSVSLAAASTRLAQRIFGALNNQHVLFIGAGEMIELCAEHFAAHRPLSLTVANRTLERGQELAASIGGTSMLLADLPDRLAEFDIVITSTASQLPIVGLGMVERAIRARKHKPMFMVDLAVPRDIEPEAGELDDVFLYTVDDLAQIVQEGMENRQEAAAEAEAIIDMRVENFMQWLKTRSAVPTIRALREQAERHRLNELEKARKLLARGHDPAQVLDALSNALTNKLLHGPSHALNSATGEDREQLEATLRQLYQIHH

SEQ ID NO: 44440 - protein, 115 aa, Zea mays
  misc_feature (53)..(53): Xaa can be any naturally occurring amino acid
  misc_feature (80)..(80): Xaa can be any naturally occurring amino acid
  misc_feature (104)..(104): Xaa can be any naturally occurring amino acid
YLYSLSVLEHQIVGTLVPVLKDVVMNISRVQKLTPAVQCSLFKAFVDVGDRYXHLSLGVKCSNEVITDIRGAIMLPKLSXCPVRMRYWGNLIGHPDTVLCKVTXGKCWSNIVRIV

SEQ ID NO: 44441 - protein, 532 aa, Petunia integrifolia subsp. inflata
MGNCCSRGQPNESNDHTESISTAKNGDGKVMQGGSVTPPKTPPPASPDPSSKPSKTSPIGPVLGRPMEDVRKTYSIGKELGRGQFGVTHLCTHKQSGEQFACKTIAKRKLVNKEDIEDVKREVQIMHHLTGQQNIVELKGAYEDKHSVHLVMELCAGGELFDRIIAKGHYTERAAATLLRTIVQIGHTCHSMGVIHRDLKPENFLLLNKDEDSPLKATDFGLSVFYKQGDVFKDIVGSAYYIAPEVLKRRYGPEVDIWSVGVMLYILLSGVPPFWAETEHGIFNAILRGHIDFSCDPWPAISHGAKDLVRKMLTIDPKQRLTAIQVLNHPWIKEDGDAPDTPLDNAVLSRLKQFRAMNNFKKVALRVIAGCLSEEEIMGLKQMFKSMDTDNSGAITLEELKTGLAKQGTKLSDYEIQQLMEAADADGNGTIDYEEFITATMHMNRMDKEEHLYTAFQYFDKDNSGYITVEELEQALREFGITDGKDIKDIVAEVDSNNDGRINYDEFVAMMKKGTPDTAANLKKRRESFDAK

SEQ ID NO: 44442 - protein, 327 aa, Pseudomonas syringae pv. tomato str. DC3000
MILFLNFRYENMNSIELAIGNTPMVELKSFDLPPGIRIFAKLEFLNPGGSIKDRVVNHIFNDAEARGLLCRGSTVIENTSGNTGAAIAMLAAARGYRVILTMPDKVSKEKQDTLRALGAEVIMCPTSAAPDSPEHYVQVAKSLHADTPNSFMLHQYDNPLNPEAHKLTTGPEIWRDLKGGISVFVAAGSTGGTISGISRYLKSQDKTIRSVLLDPKGSIYYKYFYEGVIDPLVIGPYQVEGVGEDHLAKCMDFEMIDDVIQFDDAAAFGTCRLLAQKEGLLCGGSSGANVWGCLQVAKRLSSPANIVTVLPDSGVKYLSKIYNSPFT

SEQ ID NO: 44443 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERNLKGTFFGNFKPRTDLPNVVEMYMKKELEVEKFITHSVPFSEINKAFDLMAKG

SEQ ID NO: 44444 - protein, 349 aa, Oryza sativa Japonica Group
MEEEKAAAYYDELSRKGEGARRFKQGLGFSSSDPQSTSFPSKPPSTSSSFLSGFVRAGATPAPAQPTKQPPPPPPPPHEPSRTGRHSRSPSPSRRHRTRSSSPSRSRRHRSRSRERRRRSRSREREREDRRASRRRSRSRSRSRSPSRRSGRSSYSENRHGDRRRDDGGGRRGSSKGRGGREGGKVDYSRLIEGYDRMTPAERVKAKMKLQLSETASKDSTLGNATVGWERFEFNKDAPLDEDDNDVEVANDDASLVKHIGKSFRLSAVQSKHEDTVRDAHENAIFGVPAYPIVDTETTEAEPETNDESEKAKDVEAEPSSSLISDKVLATQSGSWRERAQKLRQNPNA

SEQ ID NO: 44445 - protein, 180 aa, Methylobacillus flagellatus KT
MLAAYQGISPQVGQEVFIHPSAVIIGDVVLGDHASVWPGAVIRGDVNHIRIGEGSNIQDGSILHVSHKSSWEPQGCPLIVGRNVTVGHRVILHGCTLEDECLIGMGSIVMDKVVVQKHVLLGAGSLVPEGKVLESGFLYLGSPARKVRALTEKEIAHFMYSAQHYMRLKQHYLMAVGNAL

SEQ ID NO: 44446 - protein, 340 aa, Streptomyces ghanaensis
MSSDTHGTDLADGDVLVTGAAGFIGSHLVTELRNSGRNVVAVDRRPLPDDLESTSPPFTGSLREIRGDLNSLNLVDCLKNISTVFHLAALPGVRPSWTQFPEYLRCNVLATQRLMEACVQAGVERVVVASSSSVYGGADGVMSEDDLPRPLSPYGVTKLAAERLALAFAARGDAELSVGALRFFTVYGPGQRPDMFISRLIRATLRGEPVEIYGDGTQLRDFTHVSDVVRALMLTASVRDRGSAVLNIGTGSAVSVNEVVSMTAELTGLRPCTAYGSARIGDVRSTTADVRQAQSVLGFTARTGLREGLATQIEWTRRSLSGAEQDTVPVGGSSVSVPRL

SEQ ID NO: 44447 - protein, 625 aa, Rhodopseudomonas palustris CGA009
MLTLTDISIRLAGRLLIDQSSVQIAPGARVGFIGRNGAGKSTLFRAIRGELATETGRITLPPRWRIGSLAQEAPNGPETLLEVVLAADVERAALLLEAETAHDPHRIADIQTRLVDIDAHSAPARASAILSGLGFSAADQARSCSEFSGGWRMRVALAATLFAAPDLLLLDEPTNYLDLEGTMWLEDHLANYPRTVIVISHDRDLLDTSVNEILHLDRGRLVHFRGSYSAYADFRANKLALDAKNAKRDEARRKHLQDFVDRFKAKATKARQAQSRVKMLEKMKPIAPLVADDTPEINFPAPEKTLSPPIIAVDNVAVGYDPKHPVLRHVTLRIDPDDRIALLGANGNGKSTLVKLLANRLAPFSGSVTRADKLSIAYFAQHQLDELNEDGSTYDHVRKLMPDAPESRIRARAGAMGFSGKAADTLVKSLSGGEKARLLLGLATFYGPNMIILDEPTNHLDIDSRAALAEAINDFPGAVIMVSHDRYLIDACADRLWVVADHKVKQFDGDLDDYRRAVLSSRGARSGSSETKDRKADDSAIKAPASRPKKTVSLKQQIADAEAEIDRITAIIEKIDAALAIPDLFTRDPKQAAQLSTARANAQAALQAAEEKWLEASAAQDAAQG

SEQ ID NO: 44448 - protein, 396 aa, Escherichia coli CFT073
MFENITAAPADPILGLADLFRADERPGKINLGIGVYKDETGKTPVLTSVKKAEQYLLENETTKNYLGIDGLPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAALHKELIVASSYSKNFGLYNERVGACTLVAADSETVERAFSQMKAAIRANYSNPPAHGASVVATILSNDALRAIWEQELTDMRQRIQRMRQLFVNTLQEKGANRDFSFIIKQNGMFSFSGLTKEQVLRLRQEFGVYAVASGRVNVAGMTPDNMAPLCEAIVAVL

SEQ ID NO: 44449 - protein, 248 aa, Borrelia burgdorferi
MYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 44450 - protein, 541 aa, Neurospora crassa
MVLGFQFSFHSPPLNPVTKKAQRVPIFNPIDRHGRVFFFSWTGFMVAFWAWYTFPPLLTHTIKHSLHLTPAQVANSNIISLLATLLVRLISGWACDRYGPRLVFAFILLLGAIPIGLAPTITNVTGLYVIRFFIGILGGSFVPCQVWTTAWFDKNVVGTANAVAGGWGNAGGGVTYFVMPAVFDSLVRNWGMSDGKAWRVTFVVPLICLLVVGLALVLVCEDMPTGRWRDRNQGVEVPVVIDGVDLKSGSGAETPMTTTTKMDEEKGSKSVSDTESTTRPDVEKGEVVSAGPSNTTTIPSVTTILLSPQTLFHILTYACSFGSELAINSVLSSYFLSVAPSSLSQTSAANYAAIFGFLNFITRPLGGLASDYLFSFFGGSSPCSSPSSSSLSPSSPEAKPKALWARKLLITTCTLLTGTFLLLLGLLRPSSLGTAIGLVILAAIFIEAGNGANFGLIPFVHPERNGVVSGVTGAGGNLGGVAFALVFRFVGGHGMKGGYEKAIWIVGIINLVVAVVGVGIKPVPVAGMGSTKKEGGRRWFW

SEQ ID NO: 44451 - protein, 215 aa, Oryza sativa
  misc_feature (67)..(67): Xaa can be any naturally occurring amino acid
  misc_feature (164)..(164): Xaa can be any naturally occurring amino acid
PNSPNPRELSPPSPPPLSLTKQTTRNASTRRRRLLSTAPPRPVWGTGHGDDGAKEEDEEDDDDAVHXAALQEEVESEDEDLDDEVDDGAVDEPEHEVDDTSAEPAGKKAAVPVAPPKDTERQLSKKELKKKELAELDAVLAELGISGGSSNAAQDENNAEKKGXKQTGDGDAAVPSESTSSRTTTHPRQGANHARTTAGPRTAVRTGEQNTSVRR

SEQ ID NO: 44452 - protein, 220 aa, Crypthecodinium cohnii
MADILEAVIGEPMEPTEPTAEPMQETDLPDNAEDLPEEVAASVTAFTIMAKFNLRCEIDLRQLAFALRHAEYNPRKHSSLTLRLVEPRATAMVRSSGVVSITGVLDLDELKQSAKKVARLVQRSGEGHEKVKFAGFTICSILAKASMGFPIRLDQLAAKWRRNALYEPELYCGCIFRTTRPKCTYLLTSGGKVMISGFRNMEDVHEAVQRIYPILAEFKT

SEQ ID NO: 44453 - protein, 466 aa, Vibrio parahaemolyticus RIMD 2210633
MAHVNHYDVIVIGSGPGGEGAAMGLTKAGLNVAIVEKESSVGGGCTHWGTIPSKALRHAVSRIIEFNSNPLFCRNNTSLHATFSDILGHAKTVIDKQTRLRQGFYDRNDCTLLFGTARFIDTHSIAVMQNDGTEETYSADKFVIATGSRPYRPSDVDFLHERIYDSDSILSLKHDPRHIIIYGAGVIGCEYASIFRGLGVKTDLINTRDRLLEFLDNEVSDALSYHFWNSGVVIRNDETYEKIEGTEDGVIIHLQSGKKMRADCLLYANGRTGNTDKLSLDVVGLESDSRGQLKVNRNYQTAVEHIYAVGDVIGYPSLASAAYDQGRFVAQAITKGQAENYLIEDIPTGIYTIPEISSVGKTEQELTAAKVPYEVGRSSFKHLARAQIAGKDVGSLKILFHRETKEILGIHCFGERAAEIIHIGQAIMEQKGQANTIEYFVNTTFNYPTMAEAYRVAALNGLNRLF

SEQ ID NO: 44454 - protein, 153 aa, Streptococcus pneumoniae
EHFIRGQYRSGKIDGMKYISYRSEPNVNPESTTETFTSGAFFVDSDRFRSVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 44455 - protein, 105 aa, Zea mays
  misc_feature (65)..(65): Xaa can be any naturally occurring amino acid
LVITHARSGSIFETLRLGIPLILVVDEDVMDNHHSELPEELAARKHVFCARARPLAETIRAMDLXTLLPYQPRDANPVVSLINRVLGYPDDRRIYSDALQSMWIR

SEQ ID NO: 44456 - protein, 461 aa, Oryza sativa Indica Group
MATCSWAATTAAAAPPRPPARCRSRVAALRRTAAASAAAATCVLAEAPKGLKVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVAFVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 44457 - protein, 506 aa, Coprinopsis cinerea okayama7#130
MATNAARKLPQRRGIGQRVKADENAMSRHSRHGSIGASRFSAKENASKGGVVRQALGEVTAVAVNRNKQDPVHKAGVGKELKEEIGMKRGRSDSTTLAQRVPLGPSRNPPMANVPQATVNMRVPSVRPKIPAAISNNRISRSSTLETVVYQDPVPAETHVRMEVEHAEDDVGHEQEVEAMVGVDVDDVPETPGAALASEEDKPERVWPEYSTQRAKRFQREVDHVRERFEDEVDMYDTTMVSEYADEIFKYMEEMEDEIMPNPDYMDGQNEITWSMRQTLVDWLLQVHLRYHMLPETLWIAINIVDRFLTKRVVSLVKLQLVGVTAMFVAAKYEEILAPSVDEFVFMTESGYTKEEILKGERIMLQTLDFRISHYCSPYSWMRKISKADDYDVQTRTLSKFLTEITLLDYRFLRVKPSMIAAIGMYCSRRMLGGDWNEAFVFYSGYTEEQLIPGFDLIISKLVEENFSKLYVCKKYANKKFLKASIFAIEWAHAHLERKHETMTLE

SEQ ID NO: 44458 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFLEINKAFDLMAKG

SEQ ID NO: 44459 - protein, 305 aa, Oryza sativa Japonica Group
MAALAEHLLGLSSAPVDWEAESYPGYGDFAVLPFLVAFFPAVRFLLDRFVFELLARRLVLGKGYDKLAETDESRKKINKFKESAWKFVYFLSAELLSLSVTYNEPWFKNTRNFWVGPGEQIWPDQKTKLKLKAVYMFAAGFYTYSIFALLFWETRRSDFGVSMSHHLATVVLIVLSYIFRFARVGSVVLALHDASDIFLEIGKMSKYSSCEGLAVAAFLLFVASWILLRLIIFPFWILRSTSYEVLLTLDKEKHKFYGPIYYYVFNSLLFSLLVLHIYWWVLIYRMLVKQIQSRGRIGDDVRSDD

SEQ ID NO: 44460 - protein, 886 aa, Aspergillus nidulans FGSC A4
MLTSKAYAGPLGLPSSQTPTASYHTTTQKSSTFSESQTGTVYTSPTKSEFSEADDGLDAVRSWDENQVISWLHSINCQQYEPLFRANNFNGNNLIECDQKILQEMGIKKIGDRVRIFVAIKQLRNKSVVNKKQKNLRQLAALEAAHQQASPDSARSYSARQQTSSAGHASRTGDYSYGRPTSRPGSPLRPHRYVANSPMDSGRKDYLSAGSGAGRNPGTPVERIGTHSRQNPSLDGMTMGSLLSNAPVIRVIYSGGQTKVLDIKHCKTPDEIILCVLKKLQLPEHQYRNYCFYVLDGLDPDPSNCRRLSDHELMEICEGFHRSERGRLILRKIHAGEPDAEEVHRAAQLALDESQQAHMNALSSSNARNQMKIQQLTGESWHNIRQPMSPVSSRHNTTPSDHEIRPPQVSERVSKLRSFFGARPPSEMIIHEISSYFPGHQREDIEKTMRMSVRRSQRLSRAASRLSVVSNTSYASSLRDAPPIPSIADTWLNNGTPPTRAARPLSVLSTRPGLPSTSYRDSIASSSLHPLQEESPVEPNRKSYVSFDSGSDDPNNSRHSLLDENASVAATDGGSFNERLSVLVAEDGEEEDDGLAEFLAGNNFVNWMKGSLIGEGSFGSVFLALHSITGELMAVKQVEIPSATKGTEFDKRKNSMVEALKHEIDLLQGLHHPNIVQYLGTTADDQYLNIFLEYVPGGSIATMLKQYNTFQEPLIKNFVRQILAGLSYLHSKDIIHRDIKGANVLVDNKGGIKISDFGISKRVEASTVLGSRASNGGGHIHRPSLQGSVYWMAPEVVRQTAHTKKADIWSLGCLVIEMFIGSHPFPDCSQLQAIFAIGSNKARPPAPEHASKDAVAFLDMTFQLDHEKRPDADELLKSPFLATTLT

SEQ ID NO: 44461 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPQGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 44462 - protein, 298 aa, Bacillus licheniformis ATCC 14580
MKPIEVLRYDAFSKTAGQGNPAGIVLEADGLTDWEMQKIAEQAGYNETAFLLPSESADIRIRYFTPGHEMNLCGHATVASLYALLEKGAIEAGAELKVETKAGVLSVYTASDGNRRFLVTLEQAPPCFQSFTGSRSQLAEALGISEADFHEALPVVYGSTGIWTLLVPVRDLAAIRRMKPVQAEFPNVLTEMPRASVHPFCLETIHRDCQLHGRHFSSPYSGTSEDPVTGTASGVMGAYMKTFGKEFCEEGQTDFQIEQGQEMGKDGKVKIEVAEQNGIMKVRMTGTAVFAEKQSFEV

SEQ ID NO: 44463 - protein, 854 aa, Synechococcus elongatus PCC 6301
MTLTRFQPTAGNESRDQRFVLWFEEVGIDDIPLVGGKNASLGEMIRELLSKGVNVPLGFATTAAAFRFFLAGAGLEPQLRQLFADLDVEDVVNLRERGRQARNLILNTPFPAELETAIATAYQQLCDRYEPTPAVCDRLSGLDRDRCQRQFGSVDVAVRSSATAEDLPDASFAGQQETYLNVRGVQAVIQACHRCFASLFTDRAISYRQIKGFDHFEVALSVGVQKMVRSDLAASGVMFSIDTETGFRNAALVTAAYGLGENVVQGAVNPDEFFVFKPTLQQGFRPTLDKRIGSKEIRMVYDEGGSKLTKNVSVAESDRQRFAISDDEVLQLAQWACIIEDHYSAKRGCFTPMDIEWAKDGLSGELFIVQARPETVQSQRASNLLRSYQLQGSGSVLVEGRAVGEMIGQGTARVILDVHHIADFQAGEVLVTNRTDPDWEPIMKKASAIVTNQGGRTCHAAIIAREMGIPAIVGCGTATTAIATGADVTVSCAEGDQGRVYAGLLPFEVHETVLDDLPRPRTQILMNVGNPEEAFGLAAIPCDGVGLARLEFIIANHIQAHPLALLHFDQLEDLFVQDQIAKLTANYDRKADFFVEKLAQGIGRIAAAFWPKPVIVRLSDFKSNEYANLLGGRQFEPREENQMIGWRGASRYYDPQYREAFALECQAFRQVREGMGLTNVIPMVPFCRTPEEGQRVLAEMAANGLKRGENGLQVYVMCELPSNVICADAFSEVFDGFSIGSNDLTQLTLGLDRDSALVAALFDERNPAVKRMVAQAIQTVKAAGRKIGICGQAPSDYPEFAEFLVEQGIDSISLNPDSVLKTLLAIAAVEARLETGRDRGSQGTLRQIQDRQRR

SEQ ID NO: 44464 - protein, 658 aa, Shewanella livingstonensis
MAELKEVLVPNIDTDAVQVIEICAAVGDYLEKEASIITVESDKATMDIPAPFAGTLAELKIAVGDTVSEGTLIAMMSAANAAPAKAEAAVPAPKAEAPVAQAADPAPVTPVAAPSVGSSEVIEVKVPDIGGDTDVSVIEVLVAVGDSIDVDTGLITLETDKATMDVPSPKAGVVKSVTVAVGDKVSEGSLVITLEVAGSAPVASAPQATAPVAQAAQAPAAQAATTTQVQEIHVPDIGDANDVDIIEVLVAVGDEITADQGLITLETDKATMEVPAPFAGKLVSLTVKVGDKVSQGSLIATIETTSSAPVAQAAPTQAEPAAAAPTMAANRPSTPPVPFHPSAAVTASTGVVHASPAVRRLAREFGVDLTKVSGTGRKARILKEDVQAFVKYELSRPKATAATAVSGGAGGLNVIAAPKVDFSKFGEVEEIPLSRIQKISGPNLHRNWVTIPHVTQFDEADITEMEAFRKQQNDLAAKKKADYKITPLVFMMKAVAKALAEFPVFNSSLSADGESLIQKKYFHIGVAVDTPNGLMVPVVRDVDKKGIVELSRELTDISIRARDGKLKSADMQGSCFTISSLGGIGGTAFTPIVNYPDVAILGVSKSEIKPKWNGKEFEPKLMLPLSLSYDHRVIDGAMAARFSVTLSAILSDIRTLIL

SEQ ID NO: 44465 - protein, 333 aa, Vibrio vulnificus CMCP6
MTIKVGINGFGRIGRLAMRAAFDWPELEFVLINDVAGDSTTLGHLLEFDSVQGRWHHEVTVQGQQLHINGHVIETTQQRDISAVDWSGCDVVIEATGVHRKSRFLNQYLEQGVQRVVVSAPVKEEGIANIVVGVNDEIFNPEQHRIVTAASCTTNCIAPVVKVIHEKLGIEQASFTTIHDLTNTQTILDAPHKDLRRARACGMSLIPTTTGSATAIVEIFPELKDRINGHAVRVPLANASLTDIIFDVKRDTTAEEVNALLKEASQGELNGILGFEERPLVSIDYRGDQRSTIVDALSTMVVGTRMVKIYAWYDNEMGYATRTAELVRKVGAA

SEQ ID NO: 44466 - protein, 244 aa, Myxococcus xanthus DK 1622
MSGIEGKVIAITGASSGIGEATARLLAKRGAHVVLGARRTDRLETLVSAIRAEGGSARYRKLDVTKRDDVESFMGFVRAEHGRIDVIINNAGVMPLSKLEALKVEEWDRMIDVNIRGVLHGIAAGLPIMQAQRSGQFINLSSIGGHQVVPTAAVYCATKYAVIAISEGLRQEVGGDIRVTVISPGVTTSELADSISDPVAREGMREYRRVAIPPEAIARSIAFAIEQPDDVDVNEIIVRPTAQS

SEQ ID NO: 44467 - protein, 357 aa, Geobacter sulfurreducens PCA
MYVVILAGGSGTRFWPLSRKAHPKQLMSVFGGKSMLQRTVERVIPLNPKRILVVTNHLQADETRRQLEYLRGIRIDVIEEPMGRNTAPAISLAATLIARHDPEAVMAVLPADHYIADEDAFCAALQRGREPAMNGWLVTFGILPDRPETGYGYIEADRHLRGDGPYPVKRFVEKPDAATAAQYLAAGGFYWNSGMFMWRADVILDRIANHMPDLARAFAGIAFDADIWEPADLAPQIEAVYAMVSGQSIDYGVMEKADNVLVLPASFGWSDVGSWSALPGLIAPDGDGTVRLAGETVISVDSAGCVVRGEKLVALVGVRDLVVVDTPDALMVCARDGAQDVRKIVEELERRGLKQYL

SEQ ID NO: 44468 - protein, 246 aa, Chlamydomonas reinhardtii
MQVCNGSRMARQNLSQRRSVTRLQRSLHVTCQASQQRSSDACVVQSAKLLAVAGMAASILLGAPLDAMAAKSRLPPIDVNDPNRCTVAALDKFADTRAAFSQESSGGNMVEAIVDVRNCDFSGQNLSGKVMSGVILEGADFTGAKFVGSQFARANARSAKMAGADFTDTNLYSTQFEGADLQGANFENSILTGSTFGKNEDGVWANLKGAHFEGALVSSSDIGRICENPTLELSTRKYELGCRANR

SEQ ID NO: 44469 - protein, 301 aa, Synechococcus elongatus PCC 6301
MVASSSLRFDLKSYLKERQRQVEAALNAILPPQDPPLIYESMRYSLLAEGKRLRPILCLASCELAGGTAAIALPTACALEMVHTMSLIHDDLPSMDNDDFRRGRPTNHKVYGEDIAILAGDALLTYAFEAIARHTPEVPADRVLKVIAALARAVGAEGLVGGQVVDLQSEGRDDVNLETLHYIHTHKTGALLEVSVVSGAILAGASEELQEQLRTYAQKIGLAFQVIDDILDITATAEELGKTAGKDLAAKKATYPSLLGLDASREYADQLITEAKAAIAAFGAEADPLRAIADYITARKH

SEQ ID NO: 44470 - protein, 486 aa, Geobacter sulfurreducens PCA
MTPFEYLLLGVSLLLLVSILASKVSSRLGVPALLLFLLVGMLAGSDGPGGFQFDNPVLVQSLGIVALAYILFAGGLDTNWRSVRPVLGRALILSTLGVFVTALLVGWFVHAVLDFSLLEGLLVGAIVSSTDAAAVFSVLRSRNVSLSGELKPLLELESGSNDPMAVFLTVAIISLLVDPGAKLYHLPLLVLWQMVVGGAAGYLLGKGGVLLINRLRLEYEGLYSVLTLTLVLLIYSGTVLLKGNGFLAVYAAGLVMGNSSFVQKKSLVRFHDGLAWLMQITMFLILGLQVFPSHLVPVTLVGLCTAAFLMLVARPVSVFATLLFTPMTVREKTMISWVGLRGAVPIVLATFPLMAGVGKAEMIFNVVFFIVCSSALLQGSTIPLAARWLGLDAPMLAKRRRPFEFEASDEGKGELVEIEISPVSLAVNRQIVDLHLPAGSLIVLIQRRGEFVVPGGGTLIEAGDTVHLLADRERIDEIRAMFETPS

SEQ ID NO: 44471 - protein, 369 aa, Escherichia coli CFT073
MATLTRLFIHPVKSMRGIGLTHTLADVSGLAFDRIFMITEPDGTFITARQFPLMVRFTPSPVHDGLHLTAPDGSSAYVRFADFATQDAPTEVWGTHFTARIAPDAINKWLSGFFSREVQLRWVGPQMTRRVKRHNTVPLSFADGYPYLLANEASLRDLQQRCPASVKMEQFRPNLVVSGASAWEEDSWKVIRIGDVVFDVVKPCSRCIFTTVSPEKGQKHPAGEPLKTLQSFRTAQDNGDVDFGQNLIARNSGVIRVGDEVEILATAPAKIYGAGAADDTANTTQQPDANVDFDWQGQAFRGNNQQVLLEQLENQGIRIPYSCRAGICGSCRVQLLEGEVTPLKKSAIGDDGTILCCSCVPKTALKLAR

SEQ ID NO: 44472 - protein, 322 aa, Bacillus thuringiensis serovar konkukian str. 97-27
MNILITGGAGFIGSNFVHYMLQSYETYKIINFDALTYSGNLNNVKSIQDHSNYYFVKGEIQNGELLEHVIKERDVQVIVNFAAESHVDRSIENPIPFYDTNVIGTVTLLELVKKYPHIKLVQVSTDEVYGSLGKTGRFTEETPLAPNSPYSSSKASADMIALAYYKTYQLPVIVTRCSNNYGPYQYPEKLIPLMVTNALEGKKLPLYGDGLNVRDWLHVTDHCSAIDVVLHKGRVGEVYNIGGNNEKTNVEVVEQIITLLGKTKKDIEYVTDRLGHDRRYAIDAEKMKNEFDWEPKYTFEQGLQETVQWYEKNEEWWKPLKR

SEQ ID NO: 44473 - protein, 171 aa, Zea mays
MEHKEAGCQQPEGPILCINNCGFFGSAATMNMCSKCHKEMIMKQEQAQLAASSIDSIVNGGDGGKGPVIAATVDAAVPQVEEKTIVVQPMHVAETSEAAAVIPKAKEGPNRCATCRKRVGLTGFNCRCGNMYCSVHRYSDKHDCQFDYRTAARDAIAKANPVVKAEKLDKI

SEQ ID NO: 44474 - protein, 163 aa, Oryza sativa
MQNPGGHHASPASAAKSKSSTAAAASASGQGSSHHHHHHHSGGGGGGGGGADASATTLKRKRGVFQKDLQHMMYGFGDDPNPLPETVALVEDIVVEYVTDLVHKAQNVASKRGKLLTEDFLYLIRKDVRKLHRATELLSMNEELKQARKAFDVNEETLATNNE

SEQ ID NO: 44475 - protein, 175 aa, Zea mays
METMSALARTAPPLAGTIRRPSCALRPTASLSFAAASTTPRGRLGLGLSTAPAGSGRAARARAVPQRIVASSEHYKDLKDKPFFPKLIDYITSGPVVCMAWEGAGVVASARKLIGATNPLQAEPGTIRGDLAVQTGRNVVHGSDSPDNGKREIELWFKEGELCQWESVQAPWLIE

SEQ ID NO: 44476 - protein, 277 aa, Pisum sativum
LQAFSIHTKMAESSSTKTGLRLAGKVAIVTGGASGIGKETAHLFANQAARMVVIADIQDELGIQVAESIGTDRCTFIHCDIRIEDDVKNLVQSTVDTYGQIDIIHCNAGIISPSDQTLLELDVSQANGVFATNAIGTALCVKHAARAMVDGKVRGSIVCTASISASYGVTTGTDYSMSKHAVLGLMRSASVQLAKYGIRVNSVSPNGLATPLTEKLLDADAKTVEEIFSKFSMLKGVVLRTNHVADAVLFLASNDSDFVTGLDLRVDGNYITSDAVI

SEQ ID NO: 44477 - protein, 195 aa, Triticum aestivum
  misc_feature (148)..(148): Xaa can be any naturally occurring amino acid
MVDLQAAALVISVVAAEVAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDSRYWTMWKLPMFGCTDATQXVINEVEEVKKEYPDAYVRIIEFDNMRQVQCVSFIAFNPPGCEESGKA

SEQ ID NO: 44478 - protein, 627 aa, Oryza sativa Japonica Group
MRSKLFRSLLTDVLDGFLPLAVGFRRAHPLPPPAASATLLRKAAVQALERWHHLFGAHYRQLRLAVEYLKESARVQFPGLRAAVEARAAREARTQEILTAKVEQLRRNLAAIKAEIRSAIDEIRNGLDIIRIESEKFNNYANDEDEEQEIASLAMRSIRMASLMAGEWVPETQENEAVFDALRESYRLLVSKHLVTVQEWISVLVRVNLADNRFRDSALKEFIDVKNEIRAVRNRCSELGLNLDNVHRRKGVQEEEDDDFWVEGNIEVPSPGRVGTSADVASSSKDTRKGKKPVGGTDTDDGKAPNAGNSPQELDPERAKLHAEAPVLPWSSVLDRWGSNRDALVNQRGLELESHWGRVDNDAVIPAAKIAELNVHSSIYREDPVEILPCLAPLKKGGLCQRRDLKICPFHGPIVPRDAEGNPIHQSDGHCDAEGNPVGQTDGHYDAAVSPIDPNEDSSDVRENMIMPDGSSDGECIYESSPSRTANINNDISDSDVGHDLGKITVEQLARQAVQNVRKRDRDDKKALEKAQRARIRQHNQDVLREAALASTSRSAADYDLPSPAVSRRGRRGKTKGPTLASMLKKKVTSKDRIAERLLNARARDATIREVSHTEDMSYREAFPNQW

SEQ ID NO: 44479 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDSEFKTHPMNFLNERTLKGTFFGNFKPRTDLPNVVEMYMKKELEVEKFITHSVPFSEINKAFDLMAKG

SEQ ID NO: 44480 - protein, 184 aa, Glycine max
ENGKRPPRTFGSRSGLNDQVSNNDAAQVNSEGDSKMALDKKFVKRDLHGLGSGEKTEKRTRNKDRPDRGVWTPLRRSDVSNAGNDHSSSSLAQPTQSNPESAEGEVKENVPSGNRGGEFSASAGGRGNPSIENDSQRNFTRRGASYIVKDDGAVSISEGKPSKKSVGHSAHEKQVWVQKSSSGS

SEQ ID NO: 44481 - protein, 334 aa, Triticum aestivum
MAAEEAAASASAAATNFEVDLGHLLAYDPSHHLAAAAAASSRAELREECLRKATELAQAVANALFSLPATEGRDGPLVRLPPPTNRLPREKHLPRPKPPTKWEQFAKSKGIIKHKKNKRAWDEQTNSWKRTYGYDRVNDDRDVPIIEAKLTDEPGVDPFAQRREEKKGRVDKQEKNRLGNLKNAAKVGALPSHIQLAATSVPITGTKADLPRKAKKEDLENVAGMASAATASGGKFDKKLPGEKPLKKAGKNRKFLPVVQGKGMGNLEKQQNDKILNSLLAKNFEEPLDVSKAITMYKVKKDNKRRKDKQSSSSGSNKLKPQKKIHKKSSKKSA

SEQ ID NO: 44482 - protein, 410 aa, Arabidopsis thaliana
MTMISDLSKDLVEEILSKAPITSLGAVRSTHKQWNALSKGRLLYKAEAKDQFLGFMVMDHRFLSMIFHLNGILKGDGEGFDRPSIREVGDIVNQIDISKVFQCDGLVLCVPSDNSSVVVWNPYLGQTKWIEAREPHDESDMFALGYDKDKNHKILRLYDECYYYYEVYNFKTESWGEEDHLPGWDIDSYNRGVSLNGNTYFLTQEQRAKDKYRVFLLCFNFTTEKFENFIAMPFKYHRKYVGTLSCVGNEKLAALYQRWDTGEMAIWVTTKIESNEVLWSNLFKVDMKPLVRFGFQQCKDEAGSFFIDEEKKLAVVFNLDKKRGKRNNKTRCYHTAYIIGEKGYLKKEVLGEAVEVRKDVYRSALVCSSSYVPSLEKINQIEEEEEDKCKSIKMVDTKRQRKKRKRKSKR

SEQ ID NO: 44483 - protein, 192 aa, Glycine max
EIEDGDFFVCVVIHNIDGPGLRDSETQRYLARLAACARIRVVASIDHVNAPLFWDKNMAHTQFNWCWYHVPTFAPYKVEGMFYPMILAHGSASQTVKTATIVLLSLTRNAQSVFKILAEHQLSHPDEGMPISDLYSVCRERFLVSSQITLNSHLTEFKDHELVKIKKHSDGQDCLHIPLTAEALQKVVLEIN

SEQ ID NO: 44484 - protein, 449 aa, Bacillus pumilus SAFR-032
MEKEHVQLKRTMTSRHIMMLALGGAIGAGLFKGSSSAIDIAGPAVILAYMIGGLILLFIMQGLAEMTVARPGARTFRDLIEPVLGKYPAYFLDWIYWKMWVLNIAAEAIVSAIFIQYWFPQVPIWTLVLIISLVVTLINVCSVKMFAETEYWLASIKIAVILLFIIIGLTMLFVSFGQHAAPGLSNLTDHGGFFPNGTGGLIAAMLVVVYSYGGTEMIGVTLAETKNPEKVIPKAIQSTFVRIIGFYVLPFFIIVSLIPWNQVNNEQVSPFVTVFATIGVPYASDIMNGIILLAILSSMNSGLYASSRVLFTQAMDGRVWKGFSKLSKQQVPVRAILVCTSTLYAAVLISLFVGSQTFNYLMGSLSYTVLFIWFIIAVGHLKSRSVAQPGGYRVKLYPFTTWFSVIAIMAIFVGVVLNTPIVQTLVTMCIYLIITLSFFINRKRFETAV

SEQ ID NO: 44485 - protein, 248 aa, Ralstonia solanacearum
MHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 44486 - protein, 499 aa, Klebsiella pneumoniae subsp. pneumoniae MGH 78578
MSTSQIALLASVQQFLDRQHGLYIDGAPCAAQSENRLTVWDPATGQAIATTADASPADVDRAVMSAWRAFVDRRWAGRTPADRERILLRFADLVEQHGEELAQLETLEQGKSIAISRAFEVGCTLNWMRYTAGLTTKISGRTLDVSIPFPQGARYQAWTKKEPVGVVAGIVPWNFPLMIGMWKVMPALAAGCSIVIKPSETTPLTLLRVAELATQAGIPDGVFNVVTGSGAGCGAALTAHPQVAKVSFTGSTATGKQIARVAADRLTRVTLELGGKNPAIVLKDADPQWVIEGLMTGSFLNQGQVCAASSRIYIEAPLFDTLVSGFEQAVKSLQVGPGMQETAQINPVVSRAHCDKVAAYLEEARQQKAELISGSAGPDAGGYYIPPTLVVNPDAGLRLSREEVFGPVVNLVRVADGEEALRLANDSDFGLTASVWTRDLTQALNYTDRLQAGTVWVNSHTLIDANLPFGGMKQSGTGRDFGPDWLDGWCETKSVCVRY

SEQ ID NO: 44487 - protein, 1722 aa, Oryza sativa Japonica Group
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMGTPVNIIVGSHVWAEDPDDAWIDGEVVEIRGGDATIVSTDGKTIVASLASIYPKDTEAPPAGVDDMTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDCFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEEEVVVPPIKNLSKQKSLTDRQQENHDVLIKSLAEDRRFDNGRPAAACIVYKSLLHWHSFEAEKTNIFDRIIHTISTLKVLQNWLIGCRLHQLFSTYYKILLSLAVQQNARSSSLGSGISSGYSGMVGRPDTASKVEAKYSALRFKQQLTAYVEKIYGMIRDNLKKEINPFLIMCIQVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSIPISLDDIARLMLDIDLSDVEPTPLLRQNSQFHFLLQHHATQTDGIVC

SEQ ID NO: 44488 - protein, 206 aa, Brucella melitensis
MSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALEGLTPEQILKQELNTGVPIIYRLNADSTVASKEILSA

SEQ ID NO: 44489 - protein, 123 aa, Geobacillus thermoleovorans
MKTFVLLGALNAFLAVALGAFGAHGLEGKIPDRYLEIWKTAVQYQMFHALGLLVVGLLAGKAPNVGLIGAAGWVMFAGIVLFSGSLYVLSVTQIKPLGAITPFGGVAFLVAWVMIGYAALKWL

SEQ ID NO: 44490 - protein, 133 aa, Triticum aestivum
RESAIQSGKFLTRQLALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 44491 - protein, 587 aa, Vibrio angustum S14
MPRFTSATAFLLSVCCFSFPALANEAQQASDHIEPEPSVNQQSQQLVSGTEWMIATANAYASQAGADILRQGGSAVDAMITAQLILGLVEPQSSGIGGGGFLVYWDNDKNQMKTFDGRETAPFAATPRLFQDNQGQPLKFYDAVVGGRSVGTPGTIKLLWRSHQQYGKLPWKTLFLPAIKLAKEGFIVSPRLAAMVQNDAKNLRRYPDTKAYFFDSQGKPLQAGNRLVNNAYSNTLRQVADYGPKAFYQGDIARDIVNTVQNAEGNPGVLNTMDLASYSVKQREPICAPYRQYQICGMGPPSSGALTLGQILAMLNHYPLEKLGADNVKSWQLIGDASRLAFADRGRYMADSDYVPMPVRGLLDPNYLTERAKLLDGNRALTQVKAGMPPWNHANNRASDEAIELPSTSHLSIVDKEGNVVSLTSTIENRFGSRLMVRGFLLNNELTDFSFRSQIDGIPVANRIEPGKRPRSSMTPTIVMKNNQPVLTIGSPGGSQIIGYLAKTLVAYIDWGMDLQQAINLPNMNNRFGTFELEKNTPAAEWAPKLEKLGYKTQIKDLNSGIQAISIAPNQLIGAADPRREGKVISQ

SEQ ID NO: 44492 - protein, 263 aa, Agrobacterium rhizogenes
MQSTEDVISPDFLRRLAAVAARETLPRFRLPGTVVNKIAGGFDPVTEADRETEKALRALIRSEYPGHGVLGEEYGNEGADAELVWVIDPIDGTRSFISGIPLWGTLVGLTRDGDAVAGMMAQPFIGELFYSTGNGAFYEGPHGQTQLATSATKDLADATLFTTTPAIFEADRRSSYDLLEKQVRLARYGTDCYAYCMLAAGQIDCVVEAGLYPYDIVALIPIIEQAGGVVTDWDGGPAERGGGIVAAANATLHAQIMACLHGY

SEQ ID NO: 44493 - protein, 712 aa, Moritella sp. PE36
MSKINNKIIVKNRFIQGAVVISALSFQPFVNAQVSAQLDPPPQVCFYEHDDYAGLQTCFDSTQHTVGSENDIWSSVKVPSGSLLTLFEHDDYGGKQWTLYPGEYASLSDYYFNDIVSSFSIDPLVCFYDKTDFQGTPSCYSASHQSIGKANDSWSSVTVPVGYKLTIYQDDHYNGSSAEVNAAGQLRLANINFDNKVSSFLLTKADKTFNEYSWVGAHNAHASQGYVFAIGYMNQWLDIPEQLRDHNVRSLLIDIRYEDGRVELTHSTDNAGEFIDRMNNEIVPFLKANPDVVLTFDVEVTNNVLTKDQLKEAMDQMPEFTAMMFDPRDPVWDGKQEWPTLEEMAAANQRILLYIDKYDVSGDYGDYYVLYRKDVTMENMWAVTDYDSCEERHKYGVPTVNILGHKTWSRLFSMNHFPNVPHSGIAASDNNWDGLYPRIIDTCMPATLLDKKPNFIAVDFIEQGDVQEITEVLNEGGVIFYEGNGATQNIVCGIGGDKTRYIPSGEHGCENDEARSAKLVDVQAGTTIVVYDSPSGNTNDDYTVIQIKHNLSEYVIDSFESNVSNAAVNQWAFHNNGLDGKISYFEVFKPGDYEVTPEIMLYEGNNATQNIVCTLNVYDREFNFKNSGSCDNDETRSAKLVGVSAGTQFTVYDSPNGDTGDDYTQITVLQDILGTYDIDSYEDSYSDDYVRVNFHRHNGLDGKVSRIKISAP

SEQ ID NO: 44494 - protein, 127 aa, Prochlorococcus marinus str. MIT 9303
MLNATASRGMSKAPQRVERPWGWYEDLLEGEGYKVKRFLVFAGQQLSLQRHQHRSENWTVVSGQGQLFCKNTWHDAQAGTTLYIPLGVLHRARGGQSDLVVVEVQHGQLLQESDIERLEDDYGRVIS

SEQ ID NO: 44495 - protein, 327 aa, Oryza sativa Japonica Group
MGHVDASAAAAAARDAKKKRGNRSSAKLKQCKLDARREQWLSQVKDGKEAKASTSPTGTEPNAGSMTVPSPHPPLPRRRLDVRSKGGDPEEDREERGAARQELGSSYLDSPVHSPSSDNSGSVGGMHRKHYNNGGGLNLSSSSSVWSSSRSVSEAEDDDTGGPEEENGVLDDWEAVADADALTVDDCHSHQSSGHVAPPAAPNVCTAPANQTGRQDPIQRTKAWAPDDIFRPQSLPSISRQVSFPASIGNGWMGAAQQANLSTPLTCPICCEDLDLTDSSFCPCPCKFCLCLFCHNKILEADGRCPGCRKEYVAARLSRSCSMGPRY

SEQ ID NO: 44496 - protein, 250 aa, Arabidopsis thaliana
MVKIEIGSVGDSFSVASLKAYLSEFIATLLFVFAGVGSALAFAKLTSDAALDPAGLVAVAVAHAFALFVGVSIAANISGGHLNPAVTLGLAVGGNITVITGFFYWIAQCLGSIVACLLLVFVTNGESVPTHGVAAGLGAIEGVVMEIVVTFALVYTVYATAADPKKGSLGTIAPIAIGFIVGANILAAGPFSGGSMNPARSFGPAVVSGDFSQIWIYWVGPLVGGALAGLIYGDVFIGSYAPAPTTESYP

SEQ ID NO: 44497 - protein, 309 aa, Pisum sativum
WGIDKFRNVVEEYYGKKFEPFRSLPEWEFKSYLGWHQQGDGGLFCGLHVDNGRIAGKMKTALREVIEKYHLNVRLTPNQNLILTDIRAAWKRPITTILSQAGLLLPRYVDPLNITAMACPAFPLCPLAITEAERGIPSILKRIRDMFEKVGLKYNESVVVRITGCPNGCARPYMAELGLVGDGPNSYQIWLGGSSNQTSIARSFMDKVKLQDLEKVLEPLFYHWKQKRQSKESFGDFTVRLGFEKLKEFIEKWEGPAVPPTRHNLKLFTDKDTYEAMDGLAKLQNKNAHQLAMEVVRNYIASNLNGKGE

SEQ ID NO: 44498 - protein, 272 aa, Triticum aestivum
MAAAATAVRFHTAAARRAAPRRPARFAVRADAAQAATALTQDDLKRLAAVRAVEQVQSGMVLGLGTGSTAAFAVAEIGALLANGKLSGIVGVPTSKRTFEQAMSLGIPLSTLDDHPVIDLAIDGADEVDPDLNLVKGRGGALLREKMVEAASGKFVVVVDETKLVTGLGGSGLAMPVEVVQFCWKYNQVRLQGLFNEEGCEAKLRLNEDGKPYVTDNSNYIVDLYFKTPIKDALGAGKEIAALEGVVEHGLFLNMASSVIIAGSDGVSVKTK

SEQ ID NO: 44499 - protein, 482 aa, Oryza sativa
  misc_feature (288)..(288): Xaa can be any naturally occurring amino acid
  misc_feature (294)..(294): Xaa can be any naturally occurring amino acid
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASXLDSRFXLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 44500 - protein, 441 aa, Chlamydia trachomatis D/UW-3/CX
MAGRRTKEEQINRKRSHFYRDNVGVIVLCGGEGKRLSPLTCWRCKPTVSFGGRYKLIDVPISHAFASGFSKIFVIGQYLTYTLQQHLFKTYFYHGVMQDQIHLLVPERRDGSQVWYQGTADAIRQNLLYLQDSRVEYFLILSGDQLYNMDFRSIVDYAIDAQADMVIASQPVSDKDVSRFGVLKVDDESKLIDFYEKPQSEEILKHFRLSNTAMKKFGLDPQHGNFLGSMGIYLFRKDCLFQLLLEETGDDFGKELIHRQMHRGKTVAYLYDGYWTDIGTIESYYEANMALTQRPSHNIRGFNCYDDGGIIYSKNNHLPGAIISDSRISSSLLCEGAMIESGQVSNSVVGVRGVIGQGSVFDRSIMMGSDSYGSESFPLGIGKNCEIHKTIIDENCCIGNGVRLQNLQGHKDYDSPDGKLVVRDGIIIVPRGTQIPDNYVF

SEQ ID NO: 44501 - protein, 200 aa, Zea mays
MASHIDFRCLDEGLGGERGKRKRREDAEAAAADSMDLDADAHRPSKLRAMPSLSDPSKPASFGQPTYDGVIAGRLSGRRWKEARTRRASAVAVSRKPTPLEQRVREKSLKRAYQARKAELKEEIRQNKVAKRKAREEREKRKQENVLRTGTKLQRVTNPKTIQKIAKSKKRKQLKVVPDEFLGGKKSVANRRMQVPGLEN

SEQ ID NO: 44502 - protein, 463 aa, Frankia sp. EAN1pec
MDVYDHVTDLVGDTPLVRLTPVIADTVTPVLGKLEYLNPGGSVKDRIALSMVAAAERDGRLTPGGTIVEPTSGNTGVGLAMVAARRGYRCVFTMPDKISEEKRAVLRAYGSEVIVCPTAVAPDDPRSYYSVARRVLSETPGAWSPDQYSNPDNPAAHEASTGPEIWRATDGRVTHFVAGIGTGGTISGTGRHLKAVSGGTVQVIGADPEGSVYSGGSGRPYLVEGVGEDIWPTTYDKSVVDRVEAVSDRDSFLMTRELARRAGILVGGSCGLAVVAALRVARELDAAGTTDACVVVLLPDSGRGYLSKIFNDEWMYDNGFLDPPSDEPTVASVLAHKAAQTSGPPNLVHVHPDETVGAAISYLREYGVSQMPVVRHEPPVRAAEVAGAVLERELLDAVFADRGTVDAPVADHMSPPLPTVGAGEPVSVLVSALGENPAALVLDEGNPTGILTRADLLGFLAVR

SEQ ID NO: 44503 - protein, 503 aa, Coprinopsis cinerea okayama7#130
MANASPVTTRKRKRAHQYTVSYSEVKELDSDGKVREVIVIEDTPPPPTLSPATTHNGGYSASYQPPALAPIRTRARAAAEAQAMSSSSSSVLTAPAPKKRKRDHQDEVRAPPAKKAAAGGQQSNATNAANAWDNRTVAATDDSSKGAPPCDDKEGHYIIVPDDMIFKRYRTVRLLGQGTFGKVVEAIDTQTNNRVAIKIIRAIPKYRDASKIEVRVLQKLKERDPLNRNKCIHLLHWFDHRNHICLVSELLGMCVYDFLKENDFAPFPRHHIQDFARQLFGSVAFLHELRLIHTDLKPENILLVHNDYRTINVPIPGKRNGATKPKKILNSTEIRLIDFGSATFESEYHSTVVCTRHYRAPEIILGLGWSFPCDAYSLGCILVEFYTGLALYQTHDNLEHLAMMEMVMGKMPERFARAGARSKPEFFKEGAKLDWPKAKSTRQSKKDVKSTRPLADVIPPYDHINRQFLNLVQKLLAFDPAQRITVREALAHPYFSLTIPEEN

SEQ ID NO: 44504 - protein, 585 aa, Agrobacterium tumefaciens str. C58
MKMRFLSEAFLALMLSTAITSAQQASDTVAPEKATAVATARRVESRSFMVAAANPLAAEAGRDVIAAGGNAIDAMVAVQTVLGLVEPQSSGLGGGAFLVYYHAKNGKLTTLDGRETAPMDATPKLFLDDKGQPLKFMDAVVGGRSVGTPGTVRLLEEAHKRYGKADWASLLKPAETLATEGFKVSPRLASLIASEGDRLKKYPEARSYFFDTSGAALQTGALLKNPAYAETLATLAKSGADAFYKGRIAEAVVKTVREATDNPGVLSLSDLSNYRVIEREPVCFIYRALDVCGMGPPSSGGIAIGQMLGMAESFDLKSLGPKNVESWRLIGDAQRLAFADRERYVADTDFVPLPIKGLLDKTYLGERAKLLDGDRALAKDAVKAGEPEWDHALLFGRDAALELPSTSHFVIVDKEGNVVSMTTTIESGFGSRLMTNGFLLNNELTDFSFKTHDGGLPIANRVEPGKRPRSSMAPTIVMKDGKPLLAIGSPGGSQIIGYVAQALIAYIDWGMPVEAIVAQPHLINRFGTYDIEAGTSAEDLVEPLKALGYEVKPGELNSGLHAIEITAQGLAGSADPRREGAVMGE

SEQ ID NO: 44505 - protein, 1637 aa, Coprinopsis cinerea okayama7#130
MAQDDEERQYSQAPQGDPFAPQMIVPYIHIEPEPASPPPVKTKRKRKVKREEECGFCNGNDQFNVRTEQPEQMTHCIECGRSGHPTCMQLAHIGDVIRSYPWRCIECKICEVCSRKGDDEKMMFCDSCDRGWHMYCLNPPMDETPPGKWSCPQCSPLFPEQGIPMFVDGVLPGPYHIPSPHIPALPIPIPREASVASTSQSARQEAPEVPVEVAKPRRGRPPTATPKAQEPAPEMEVDEEEPIAVPKPTRAGKATGKRGRGAAPPPPVESSEEEPEPQSSPNHSPSKGKGKEREEEDDDEDSVYGMFDDILSPEDRDTSKTMISRHDKILFERSRSIAEEKLHPQTAPPASAEPEQHDFFGAGPSRPLRSAALHHLTTALPSASTPTAVSTSPVPSTPGGPLPPQLSANPHMLRIRTIRFGEWDIKTWYDAPFPEEYATIPDGRLWICEFCLKYMKSRFGAVRHRVKCKARNPPGDEIYRDGPISIFEVDGRRNKIYCQNLCLLSKMFLDHKSLFYDVEPFLFYVVTEVDDIGARFVGYFSKEKRSPKDYNLSCIMTLPVRQRQGWGNLLIDFSYLLSKKEGRLGSPEKPLSALGQIGYRRYWTLAVMRYLEHAPDQIRLEDIAKATSMTLEDICQTLIEQNMIFIREPTPPIIRPSPGQAIKLPKGRKSGVGRRQLQRMQTQDRYGDNGGPFVPPKHYEIHFDRERVAAFMRAYEAKGQLKLKPEKLQWTPYLLSRKNKEPPQGLVTETPAMATSLNGLSPTTPRRKKITVSSPNKEEEDGEEKPERPQLNLFGSPPPDEAEEEEELPKPKVEVKARRRASKKTPAKPKERDRSPAPELVISPTSSRRLRNRTNGASPETATVKTPHISDALRRGRPRGTGRPKDVEVSLPVHKEDYSPSVRNLRSSRSKNNMAGGFDEKVTPLPSRKRRRVESPSDEEEAEVTQALGNTTPSSSGTATKVEMADDQAPSINGTCINGRHEEPSKGAPSEAQSGDVEGDDCDKVQPSSAEADNPPDSVEAIDGPVTFGMDEDGVKSDNPPSPPPAVEDGRGYINGIEKLEARPLHAESDLRSTLDVGLAEEEYGDEDADGEYEEEGDEEYQSYAWRDSTMQYGHMTMQDRRDANIDSNGSTHQSLGQALGSHAHLAPPSYPRPHPDPYRHPSTSPPTHNQPNSAQAHGGPPSAVHSMTFVTNPANGQTSPAMKRKQMDNQMNTVQISKRRRDDDDNFDIDGAGQGAKHWTDEEKTRLFRWLMGPNNDDHWNALRATKNSCLRECALEVFEGKKTYQALKGCYERNFNVFKQIYAVEAFHGHPGPYQTPNESDRTREYERRLQLARKASTDVGNVTARIIEHWFARGWYELFFRRWNGDPATTKPASLRGSTVAPTQNPPDDPEEEDPPPPPPAQSTTATIDFSAEPHPTLLPNGLPNGLAHDRQQTHSHPGQVNFLNPHAMSNPSNREVHQQQQHLAHPPPPPQPPQPLMSVGASPSLVPGPAQTPTMPPPPPHAHPSHPHHPQPQPPTNGNQGDTSAMSIPLTPNMVNTLMQYIQVQTQASRLKMEYLRRREEREEKEHKARYEAEQLRLERERFELEKLKTTGMSRLRTEKVFDLVSRTDIDPSLKKTASDYVRRLLQEEAARQ

SEQ ID NO: 44506 - protein, 599 aa, Oryza sativa Japonica Group
MLLSLCLRLLPLLLVLVAASHGDASGDTYDTSMCLQKPTTCGNVSISYPFYFATKTKDINGSSNSYCGYPGLAIDCDDGKPILQLNGTEKYKVNYINYGSITNVSLADLEVVDDSSGCPRVDHNVTIPQISWLFFSGISVDYLVFFLRCSFTTFAPKPANFNPIACGSFINLTRPSFVFPDELVPPGNWSQLCEETFEVPVLKYQLMEMDSNGNAWNNSGYAQVLRQGFQLSVNESRRPPNCSQCEESQGRCGYSQAGEFIGCLCPNGRVRSLRGNLSDGRQVAVKMLKDSKGDGEEFINEVASISRTSHVNVVTLLGFCLHGSKRVLIYEYMPNGSLERYAFRNNSEGEHSLTWEKLFDVVVGIARGLEYLHRGCNTRIVHFDIKPHNILLDQEFCPKISDFGMAKLCSNKESIISIAGARGTIGYIAPEVYSKQFGAISSKSDVYSYGMMILEMVGARERNIDANSESSSHYFPQWIYEHLDEYCINSSEIDVLYNCKYYLAVTKYIHRENSICEKKNASRYSIPPSKFTWIRKQNRILPNTKMRKGQVDLGLYSSPSYGIIDTFCEDDVVVPYLVDNLKEFLDKLDCEVVPNICYC

SEQ ID NO: 44507 - protein, 726 aa, Coprinopsis cinerea okayama7#130
MSKLPISALPIPPPSRLLIHNLTPDTWTPNPTAFRTNVLTTTPSLQRRARLLSPPCHYSHVTPFPVSFPYDIQPPSPSDDPANQDKNAYIERWLASREAVNPQPPIPRFPNSTLVKYYGKHRDQPTELLGLSETALRDCLPHLDVGDAFATLGVPSLSDEFNDEGDGKPSEIAEAVEARQDLIDVLSGHATLMTPPEVIEGAFAPWSLRYSGHQFGSWAGQLGDGRAISILVTPHPSHPDLSYELQLKGSGRTPFSRSADGLAVVRSSIREYLCSEAMYALGIPTTRALSIVSLPALPVQRERVESASIVTRLAPSFIRIGNFEAFNGPTNMFFFGGGQQKPDYEGLRMLGEWVVGNVLNLSVEKGKPWGAELVYDVARRNAKMVAGWQAYGFMHGVINTDNVSILGLTIDYGPYAFMDVFDPLHICNHTDEGGRYAYKYQPNMIIYALRALLKALAPLIGAEIETGKAVSAGWAEDASPEKIKEWTAKGLEIKDEMERIIQQTCSTEYGDLLRKRLGLHRPDPTDESKIFRPLLDIMEGYGLDFHSTFRILSSFKASTLINAKNKGTPNAHSLAPEVEAFINRLLTVTPEPEKLNVNAAKQQWIEWLETYSQRIKDEHGDWKASGWQEDLEGTEIQRQQEMRGVNPRFVLRQWVLEEVIKRVERDVDSGKRVLAKVLHMACNPFEPWGGEDADELEALDKEEKEEKRFCGLGEKKMLGFQCSCSS

SEQ ID NO: 44508 - protein, 663 aa, Oryza sativa Japonica Group
LCLAAMAHLPLLLLSFLVLIGVHASVSHGSPPLPSTYDPSICSKSSECGGVNISYPFYLSNATDYYTRFSCGYTDLKISCSRDRDGRNETPTILLGGDNYTVLDIIYDSHTIVLADTDALRGGSCPRVRHNITFAQADEWLQYTGPRDNLTFFFGCKLNLPPPIDPGLVSLADKHQINCKDFSNWPDSGDSFVFTSAELEAPVESELARRCRQVIVVPVNGDILNSSNQSALPSGGYGQVLNKGFDLAWNSRKDEQCYQCEQSQGHCSYSQNRVFLDCLCSDGKVGNQDCRNSGASNSSTLRYSSLKGRMKLYIIAGISSVLLLCLLSFPCLFSLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSW

SEQ ID NO: 44509 - protein, 224 aa, Vibrio angustum S14
MNQPLNYRNTSFITSAPDIRHLPQDAGVEIAFAGRSNAGKSSALNRLTDQKGLARTSKTPGRTQLINMFEVVQGCNLIDLPGYGFAQVPLEMKLKWQKSLGEYLQRRECLQGLVVLMDIRHPMKDLDQQMINWALESRLPVLVLLTKADKLKSGARKAQVLKIRQMTKDLEGEVQVEAFSSLKGIGVDQVRRKLDEWYAPELERQRVLAGGDDAFPEQVEEDNE

SEQ ID NO: 44510 - protein, 440 aa, Oryza sativa Japonica Group
ATLFSLPIPRGLKEDTTLYSSRFVPEYLEQKKVQKLLLVGLEGSGSSTIFKQAKFLYGTEFSPEEILNLKLMIQSNVYKYLSTLLEWRECFEDEALEEEKELGMSNHKGDGEPKAVQSTSSLYSLNQRLMHFANWLLEIVALGNLDAFFPAATREYAPIVEEVWKDPAIQATYKRKNELHFLPDVASYFLDRVVEISSNEYEPTETDILYAEGVNQWNGLSTLEFSLDDRGPLSDSYADKAGNPAIQTKYQLIRMNSKGLTGGFKCLGMLEDIRAIIFCISLADYDQTWVQSSGEPCNKMIASRDLFEDVIRHPSFEDTPCVLLLNKYDAFEEKISRVPLTVCEWFADFSPVRPHHTSQTSLASHAYYYVAVKFKDLYSSVADGRKLFVFQTKALERRTVDDAFRYIREVLRWDDVKNSDAGYCSADESSYSVDMTTSPS

SEQ ID NO: 44511 - protein, 257 aa, Zea mays
MEWRDSFLDLALIPLSLLLPMAYHAWLWREVRLRPLRTAVGINAATRRLWAIGMMKDNAKNAVTVVQSVRNVIMGSTLMATTAILFCTGVAAVLSSTYTIKKPLSDTVFGAHGEYMMALKYVALMLLFLLAFLCHSLAICFLNQASFLINTSACLFSSSADSDAAVLGLPLPPTRDYIGDVLERGFTLNLVGNRLFYAGVPLLLWIFGPLLAFLSSMVMVPILYSLDVVNLMGHSGCVVVSGKSAEMNGGSECARAV

SEQ ID NO: 44512 - protein, 466 aa, Vibrio vulnificus CMCP6
MAHANHFDVIVIGSGPGGEGAAMGLTKAGLKVAVVEKESSVGGGCTHWGTIPSKALRHAVSRIIEFNSNPLFCKNNSSLHATFSTILGHAKSVIDKQTRLRQGFYDRNQCQLIFGTARFTDAHTISVTQNDGTEEVYTADKFVIATGSRPYQPADVDFNHERIYDSDSILSLKHDPRHIIIYGAGVIGCEYASIFRGLGVKTDLINTRDRLLAFLDNEVSDALSYHFWNSGVVIRNDETYERIEGTEDGVIVHLQSGKKMKADCLLYANGRTGNTDKLNLPAVGLQGDSRGQLKVDGNYQTEVEHVYAVGDVIGYPSLASAAYDQGRFVAQAITKGKADGYLIDDIPTGIYTIPEISSVGKTEQELTAAKVPYEVGRSSFKHLARAQIAGKDIGSLKILFHRETKEILGIHCFGERAAEIIHIGQAIMEQKGEANTIEYFVNTTFNYPTMAEAYRVAALNGLNRLF

SEQ ID NO: 44513 - protein, 533 aa, Agrobacterium rhizogenes
MARRRCKHAFLCGNGVTLRETEMADKIHDLFVIGGGINGCGIARDAVGRGYSVALAEMNDFASGTSSGATKLIHGGLRYLEHYEFRLVRESLMEREVLWAMAPHIIWPMRFVLPYQKGGIRPAWLIRLGLFLYDHLGGRKLLPPTAVLDMRRDEAAKPLKALFTKAFEYSDGWVDDARLVVLNARDAADKGALIMPRTKVVSARRENGLWTIETVDAISGIAAVHRARMLVNAAGPWVDHVIRGAFGKNEARNVRLVQGSHIVVKKKFDGPRAYFFQNPDNRIIFAIPYEDEFTLIGTTDRDFSGDPKDVRISQEETDYLCKAASEYFKEPVRQDDIVWTYAGIRPLFDDGATKAQEATRDYVLKLDGFVGSEVNRAPLLNVFGGKLTTYRRLAEHALEKIGEAIGTKGAPWTAKSHLPGGDFPVQGYEAEVTKLHKDYPFLAPSHARRLVRRYGTKASALLGTAEKIEDLGRLFGSDLYEAEVVYLMAHEWARTTNDILWRRSKKGLHLSHSEVALLDQFISEIIQRQVAAQ

SEQ ID NO: 44514 - protein, 337 aa, Prochlorococcus marinus str. MIT 9303
MLAVDVTSFLTAARTEQESISYDMQRLRLFSGTSNPALAREIAAYLGVPDGPRICKRFADGELYVQIQESIRGCDVFLIQPTCAPVNDNLMELLIMVDACQRASARQITAVVPYYGYARADRKTAGRESITAKLTANLLVKSGVNRVLAMDLHSAQIQGYFDIPCDHIYGSPVLVDYLAAQELNEVVVVSPDVGGVARARAFAKQMRDAPLAIIDKRRSGHNVAESLTVIGDVAGKTAILIDDMIDTGGTICSGARLLRQEGAKRVIACASHAVFSPPACERLSEEGLFEQVLVTNSIPIAAERRFPQLQVLSVANMLGEAIWRIHEESSVSSMFRG

SEQ ID NO: 44515 - protein, 794 aa, Pyrococcus furiosus
MAYRFIKWFEELSKNDVPLVGGKGANLGEMTNAGILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTPRATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVLETKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCQRYGVETSICGQAGSDPKMARILVRLGIDSISANPDAVQLIRQVVAQEERKLMLEAARKQLFEKRKKRSSSEVFPPFL

SEQ ID NO: 44516 - protein, 292 aa, Methylococcus capsulatus str. Bath
MAKVIRKAVFPVAGLGTRFLPATKASPKEMLPVVDKPLIQYAVEEAVAAGIDEMVFITGRSKNAIMDHFDKAYELETELAARGKDDILNIVRNIIPPHVTCIYIRQAEALGLGHAVNCAKAVIGNQPFAVLLADDLIDGNNHGGCLSQMVRVFDKWQCSVLGIERIDPGDTHSYGIVKTSPIEAGLDKVEAIVEKPRPENAPSNQAVVGRYILTPAIFDKLANVSRGAGGEIQLTDAIAMLLNEQTVLAYEFNGKRYDCGSKLGYLIATVEQGLQHPDLRAGFEAYLRSLQL

SEQ ID NO: 44517 - protein, 333 aa, Vibrio parahaemolyticus RIMD 2210633
MTIKVGINGFGRIGRLALRAAFDWPELEFVQINDVAGDAATLSHLLEFDSVQGRWHHEVQVEGNELVINGKRIATTQHRDIDAVNWSGCDVVIEATGVHRKTSYLDQYLDQGVKRVVVSAPVKEEGIANIVVGVNDHIFDPDKHRIVTAASCTTNCIAPVVKVIHEKLGIEQSSFTTIHDLTNTQTILDAPHKDLRRARACGMSLIPTTTGSATAIVEIFPDLKGKINGHAVRVPLANASLTDIIFDVKRDTTAEEVNALLKEASDGELKGILGFEERPLVSIDYKGDQRSTIVDALSTMVVGSRMVKIYAWYDNEMGYATRTAELVRNVGLA

SEQ ID NO: 44518 - protein, 337 aa, Triticum aestivum
  misc_feature (233)..(233): Xaa can be any naturally occurring amino acid
MGAGAGAAEEPSQTRRALVDTAAGAISGGISRTVTSPLDVIKIRFQVQLEPTAKWGVLRRDVYGPSKYTGLMQATKDILREEGLPGFWRGNVPALFMYMPYTAIQFTVLHKLKTFASGSSRTEDHLHLSPYLSYVSGAIAGSAATVGSYPFDLLRTILASQGEPKVYPNMRSALVDIVQTRGVRGLYAGLTPTLVEIIPYAGLQFGSYDTFKRSMMSWNRYRYGIEEDDFGIXAFQLFLCGFAAGTFSKAACHPLDVVKKRFQIEGLKRHPRYGARIESSTYKGMYHALTEIVVKEGFGGLYKGLFPSVVKSAPAGAVTFVAYEYISDWIGAKAGVE

SEQ ID NO: 44519 - protein, 393 aa, Methylococcus capsulatus str. Bath
MSIRLSDRVQSIKPSPTLAVTARAAAMRAAGKDIVGLGAGEPDFDTPDHIKQAAIQAIEKGFTKYTAVDGTPGLKQAIQAKFKRENGLDYALDQILVSCGGKQSFYNLAQALLNPGDEVVIPAPYWVSYPDMVLLAGAVPVIVEAGQQQAFKITPAQLEAALTARTRLFVINSPSNPTGMAYTAEELAGLGEVLRRFPEVVIATDDMYEHILWEGGFSNVLNVCPDLYERTVVLNGVSKAYSMTGWRIGYAAGPERLIEAMTNIQSQSTSNPTSISQVAAEAALNGEQGFIAGMVEAFKQRHDFVVGRLNAIPGVDCLKTHGTFYVLPNVEAAMARLHLADDVALSEYLIEQGGVAVVPGSAFGAPGHVRLSIATSMANLEKAMERLATTLSK

SEQ ID NO: 44520 - protein, 540 aa, Chlamydia trachomatis D/UW-3/CX
MSSEVKSFSKFRGYFFPIYRSEFSKFIPLFFLAFFVGVNYALLKTTKDSLVLVGSRAGAEVIPFLKVWGIVPGAVIVTMIYGWMSRRYSRGTVFISLVGGFLGFFALFATVIYPIGDALHLNKLAAKLQSILPPGGRGFVVMVQYWSYSLYYVMSELWSSIVLSTLFWGVANHITSVREAGRFYALINTGLNLSSVFAGEVSLWLGRNPVIAFPMAVDPWHEVLLNITLLIVLAGGVILYLYQKLDRLMDETSMLKEGLAAEMSVAQLKKEKKRSKAKAKSLFALLLRSRYLLGIAVVVLSYNLVIHLFEVVWKDQVCRIYASRVEFNSYMSRITTLTGIVSALTGIFAAGQTIRRWGWTIGALVPPLTMLITGALFFGAIYAVKGDAMIFGGILGISPLVLTAWLGGVQNVFSRAIKFTYFDQTKEMAFIPLEDDEKNYGKAAIDGVISRVGKSGGSLVYQGLLIIFSSVAASLNAITIVLLLALGSWIFVIAWLGREYTAKTEALFRVNVSEEDVLQEEREASSLVDAESREEPVTTL

SEQ ID NO: 44521 - protein, 191 aa, Frankia sp. EAN1pec
MSAEPRTAEPAAAGSRGAPLSLRAQLREDRDVHYGARLHPGYQALAVHRFGRWCRERGGLVGRFGTIAFKAVNNIVIRNLQGTEISVDASIGRRVLIGHHQAVMIPRHCVIGDDTIIRHGVTIGYASTDAPPDAVPKIGARVDIAPGAHLIGPITIGDDVKIGPGSIVTTDVPAGATVFAAPARIMRPPAG

SEQ ID NO: 44522 - protein, 382 aa, Oryza sativa Indica Group
MAHGGGGRAKVTPNLAMDEEGTRVLNITVLQRLDPAVEDILITAGHVTLYDFDTNLNQWSRKDVEGSLFVVKRNAQPRFQFVVMNRRNTDNLVEDLLGDFEYQLQVPYIMYRNAAQEVIGIWFYNSQECEEVANLFSRILNAFSKATPKPKAPSIKSEFEELEAAPTLVEGPLEPQTSNIIPATTHVQEDPLSAFFSGAINVGSASGLSVAGQLNQSFGSTPLSSHAPTCISISQPPAVHHLLPSQTSSVISPDVHGGTGAVVNRSASLLNPSLFSPLTSSQTTMARTNPVAPTAPPQHPRITQQPHSAPLLQPFPLPTASPSPPYGTPLLQPFPPPNPSPSLASAPVYSPVLSREKVRDALLRLVENDDFIDLVYREIVKG

SEQ ID NO: 44523 - protein, 467 aa, Klebsiella pneumoniae subsp. pneumoniae MGH 78578
MMGQLSQSQDLGAGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAIILHSWVPGVPVWLFSLVITLALTGSNLLSVKNYGEFEFWLALCKVIAILAFIVLGAVAITGFYPYAEVSGISRLWDHGGFMPNGFGAVLSAMLITMFSFMGAEIVTIAAAESDTPDKHIVRATNSVIWRISIFYLCSIFIVVALIPWNMPGLKSIGSYRSVLELLHIPYAKLIMDGVILLSVTSCLNSALYTASRMLYSLSRRGDAPAIMGRTNRSKTPYVAVLLSTGAAFLTVVVNYYAPAKVFKFLIDSSGAIALLVYLVIAVSQLRMRKILQAQGGEIRLRMWLYPYLTWLVIAFITFVLVVMLFRPAQQLEVISTGLLALGIICTVPIMSRWKKLVLWQKLPLQNTR

SEQ ID NO: 44524 - protein, 219 aa, Zea mays
MEDLSVEELASNLSTYKDQLREVRKFIKEKKDDAGISEYVDMEKELQEVITLTEELLATANPSESAQNDVGLSPPNYSAGVHSEALDDLSQSHEKFAVGTKVQAVYSEDGEWYNATIEGLTPIGYFVSYEGWGNKEEVDPANVRALDVEAADALGQAEKEAEATKMALKRKVEQAATSDYQIRSLPTKLKIDPNDPEDVKAAKRKKIHAFKSKARFEQL

SEQ ID NO: 44525 - protein, 448 aa, Vitis vinifera
METQRITEFPHKNMDKRPRKRPRLTWDMPPPLPPPKVVPGMYCSQEFVSNYPYSSLFYKGVTRNGSPPWRPDDKDGHYIFAIGENLTPRYRIISKMGEGTFGQVLECFDNDKKEVVAIKIVRSIHKYREAAMIEIDVLQKLARHDVGGTRCVQIRNWFDYRNHICIVFEKLGPSLYDFLRKNSYRSFPIDLVRELGRQLLESVAFMHDLRLIHTDLKPENILLVSSDYIKVPDYKFLSRTIKDGSYFKNLPKSSAIKLIDFGSTTFEHQDHNYVVSTRHYRAPEVILGLGWNYPCDLWSVGCILIELCSGEALFQTHENLEHLAMMERVLGPLPQHMVLRADRRAEKYFRRGARLDWPEGATSRESMRAVWKLPRLQNLVMQHVDHSAGDLIDLLQGLLRYDPAERLKAREALRHPFFTRDIDGYFYFSNIPTSFTEMSRVLEVCKIV

SEQ ID NO: 44526 - protein, 141 aa, Chlamydia trachomatis D/UW-3/CX
MEQTLSIIKPDSVGKAHIGEIIAIFEKSGLRIAAMKMVHLSVKEAEGFYVVHKERPFFQELVDFMISGPVVVMVLQGENAVDRNRELMGATNPKEAAEGSIRALFGESIGVNAVHGSDSLENAAIEVSYFFAKTEIVNSVA

SEQ ID NO: 44527 - protein, 427 aa, Klebsiella pneumoniae subsp. pneumoniae MGH 78578
MNSNKAMMARRSDAVPRGVGQIHPIFAERAENCRVWDVEGREYLDFAGGIAVLNTGHLHPQVVAAVEDQLKKLSHTCFQVLAYEPYLALCEKMNQKVPGDFAKKTLLVTTGSEAVENAVKIARAATGRSGAIAFTGAYHGRTHYTLSLTGKVNPYSAGMGLMPGHVYRALYPCALHGVSDDEAIASIHRIFKNDAAPEDIAAIIIEPVQGEGGFYAASPAFMQRLRALCDEHGIMLIADEVQSGAGRTGTLFAMEQMGVAADITTFAKSIAGGFPLAGVTGRAEVMDAIAPGGLGGTYAGNPIACAAALAVLQIFEQENLLEKANQLGDTLRQGLLAIAEDHPEIGDVRGLGAMIAIELFEEGDHSRPNARLTADIVARARDKGLILLSCGPYYNVLRILVPLTIEEAQIEQGLKIIADCFSEAKQA

SEQ ID NO: 44528 - protein, 350 aa, Lemna minor
ISIPARIGLYIGTANYVITVGFGTPKKNQTVIFDTGSNVNWIQCKPCVVSCYPQQEPLFDPTLSSTYRNISCTSAACTGLSSRGCSGSTCVYGVTYGDGSSTVGFLATETFTLAAGNVFNNFIFGCGQNNQGLFTGAAGLIGLGRSPYSLNSQLATSLGNIFSYCLPSTSSATGYLNIGNPLRTPGYTAMLTNSRAPTLYFIDLIGISVGGTRLALSSTVFQSVGTIIDSGTVITRLPPTAYGALRTAFRAAMTQYTRAAAASILDTCYDFSRTTTVTFPTIKLHYTGLDVTIPGAGVFYVISSSQVCLAFAGNSDSTQIGIIGNVQQRTMEVTYDNALKRIGFAAGACP

SEQ ID NO: 44529 - protein, 351 aa, Lemna minor
ISIPARIGLFIGSGNYVITVGFGTPTRTQTVVFDTGSDVNWLQCKPCAVRCYAQQEPLFDPSLSSTYRNVSCTEPACVGLSTRGCSSSTCLYGVFYGDGSSTIGFLAMDTFMLTPAQKFKNFIFGCGQNNTGLFQGTAGLVGLGRSSTYSLNSQVAPSLGNVFSYCLPSTSSATGYLNIGNPQNTPGYTAMLTDTRVPTLYFIDLIGISVGGTRLSLSSTVFQSVGTIIDSGTVITRLPPTAYSALKTAVRAAMTQYTLAPAVTILDTCYDFSRTTSVVYPVIVLHFAGLDVRIPATGVFFVFNSSQVCLAFAGNTDSTMIGIIGNVQQLTMEVTYDNELKRIGFSAGACP

SEQ ID NO: 44530 - protein, 274 aa, Coprinopsis cinerea okayama7#130
MAQVFKYPVNAQEPLITLTRPKDHLWVIELHNGQDNRLTATLVNEGLKPALDEVERQWREKWRAAAAAKDQPQGKGALIIVGRRDQDKFFSNGLDFANVVKDLNFFPVTFDPLLARLLTFPIPTIAAINGHCFAGGLMLSFACDYRVMTDGSKRNAWLCMNEVHFGARWPYSFASLLRAKFGDHRLVRKIALEGHRFTPPEALADGLLDHIVNGKTADVLAKAEEVAERVSMNASAGAWGLIKKDLYRDVLEDFRKETLTTNPFIEDAAAKARL

SEQ ID NO: 44531 - protein, 514 aa, Rickettsia conorii str. Malish 7
MNQSNIISPELLDERRNIARQGGGEARINAQHQKGKLTARERIEVLLDPNSFTETGMFVSHRCDNFGMQDKKFLGDGVVTGHGTINGRLVFIYSQDFTVLGGSLGEYHAKKICDIIDQAIETGAPVIGINDSGGARIQEGVDALAGYGELFQRNVLASGVIPQITLIMGPCAGGAVYSPALTDFIFMVKNSSYMFVTGPDVVKTVTGEEVSQEKLGGARMHTTKSGVADLAFNNDIEALLEIRKFFNFLPSSNRSPLPVRSTVDPADRVDMSLSTLIPNTPNKPYDMKELVERIVDEGEFFELQPDFAKNIIIGFGYMEGYPVGFVANQPLHLAGCLDINASRKAARFVRFCDAFNIPIVSLVDVPGFLPGTSQEHDGIIKHGAKLLYAYAEATVPKITVITRKAYGGAYIVMNSKHLRGDINYAWFNSEIAVMGAEGAAEIIFKEECKNPEAKKQKIDEYRQVVTSPFVAASRGYLDDIIRPQNTRWRICKALNFLRTKKVELPWKKHDNLPL

SEQ ID NO: 44532 - protein, 535 aa, Aspergillus nidulans FGSC A4
MSSKTTPTVPPVALDSITQHIGNTPLVRLNKLPQNLGINATVYAKLEYFNAGGSVKDRIALRMIEEAERSGRIKPGDTLIEPTSGNTGIGLALVAAVKGYKTIITLPEKMSAEKVSVLRALNATIIRTPNEAAYDSPESHIGVAKRLEKELPNAHILDQYGNENNPLAHELGTAQEIWSQTKGQIKAIVAGAGTGGTITGLSRGLKKHNSNVQVIAADPQGSILALPAALNEEHANEPYKVEGIGYDFIPQVLDQHAVDKWYKTDDKESFQYARRLIAEEGLLVGGSSGSAIAALVKAARDNMFKEGDVVVVILPDSIRSYLTKIQFADDDWLAANDLLPSLPTEVILQSSNKQTQGQDDAFAGSKVSSLRLKPVTTVHSNVPCETAIEVMRDKGFDQLPVLAPSGRKLVGLVTLGNVLSRLTHNRATGRSPVADVMFDFRTISEVVTDPRDMGLASLEPNQNGRDAPKPQTRSRKFVEITMDTSLSVLNRFFEWNSAAIVTERDEGGTLRPVAVVTKVDLLTWMLHHKKNGASE

SEQ ID NO: 44533 - protein, 481 aa, Aspergillus nidulans FGSC A4
MPRVASRPSSFQEGNESLLMTDLNRPAAHASNGNGSTLPIHDGPERHKFRRELFRVHTAGQSGRSGVHPLLFFKVCFRSTCTLSMIVNVLWPFVPAAVAIHFARPDLHVWIFALNYIAMVPSANLLGFAGGELAKKLPKVFGVLLETTLSSVVEIVLFMVLIHNDQGGNLIPVIQAAILGSILANLLLCLGLCFFFGGLGREDQVFHEAVSEVGSGLLLVAGFGLLIPSAFYATLVSGSTNTTAQRADIVRSTLEISRATAIILLAAFLMFLFYNLHSHHTIFDEILEHDENRDEDRDKEEKRAKLTLTECLIAIAIALTFVCMSAVFLVNEIEHIVLEQGVPDNFMGLILVPVVEKAAEHLTAIDEAWDNQINFALFHCLGPSIQTALLNAPLAVIVGWGLNKDVSLNYEIFMIVLVVLAILVVGNFLRDGRSNYLEGGLCVLVYIIIAVTTWYYPPVEPLGSEGGTEAAAEAVAHRLML

SEQ ID NO: 44534 - protein, 349 aa, Oryza sativa Japonica Group
MPPHADTRERLRGAEIRFRGEVQGPESVAFDPLGRGPYTGVADGRVVRWDGARWVYFAHSSPNWTAELCGHKASPLDYLKDEHICGRALGLRFDRRTGDLYIADAYFGLLKVGPDGGLATPLATEAEGVRFNFTNDLDLDDDGNVYFTDSSIHYQRRHFMQLVFSGDPSGRLLKYDPNTKKATVLHRNIQFPNGVSMSKDGLFFVFCEGSRGRLSRYWLKGEKAGTVDLFAILPGFPDNVRTNDKGEFWVAIHCRRSIYARMVSRNVRLRKFLLSLPIPAKYHYLMQIGGKLHALIIKYNPEGEVLDILEDTTGQVVRAVSEVEEKDGKLWIGSVLMPFIAVFDYANAS

SEQ ID NO: 44535 - protein, 335 aa, Agrobacterium rhizogenes
MTITPDIELGAYLLQRKIDPALASLIESIAASATVVADHLKEAAFQNHIGSAGTTNVQGEDQKLLDVLADRVFRETCGEAVSLAAYVSEEAEDVTWLKAPAAGDLILYVDPLDGSSNLEVNLSVGSIFAVSQVQADGDTNVLRKGRDYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADDSNRRAGGKLRLMYEANPMAFLIEAAGGAASTGTEDILRIQPQAHHQRVSVLLGSSNEIQRLVQFHQIHHSQEEIGS

SEQ ID NO: 44536 - protein, 250 aa, Agrobacterium rhizogenes
MINTPRRLIVGNWKMNGLTADLAEIEKLAWNIGDLSADVAICPPATLLQSAVRITAGSRLLLGAQDCSAQEAGAYTGDISARMIADCRARVVILGHSERRQYQGETDAIVRRKAEIALSAGLTPVICVGETEAEHLRQETLAVLKNQLQGCLPAEMNEIALVIAYEPVWSIGTGRLPDQGEILAAHACIRSSLIDAYGPVGAQMRILYGGSVKPENSIEILALENVDGVLVGGASLRAESFLQICEATRT

SEQ ID NO: 44537 - protein, 401 aa, Oryza sativa Japonica Group
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 44538 - protein, 455 aa, Bacillus thuringiensis serovar konkukian str. 97-27
MSVSSIVNKQKAYFYNGHTRSVEVRKNNLKKLYEGIQRFEEEIFQALKLDLNKSVHESFTTEVGYVLKEISFQLKHISSWSKPKRVRTALTHFGSKGKVVPEPYGVTLIIAPWNYPFQLAIAPLVGALAAGNTIVLKPSELTPNVSKVITRMLAELFQEELVAVVEGGVEESTALLKEPFDYIFFTGSVGVGKVVMEAAAKQLTPLTLELGGKSPCIVHKDAKVDVTARRIVWGKFLNAGQTCVAPDYLYVHASVKEQLIEALQHEIAEQYGNEPLQNDNYVRIVSERHFERLCRFLQDGQVAIGGNYKRDTLHIEPTVVTDITWQNAVMEDEIFGPILPIIEYENIEEVIDTIQQHPKPLALYVFSEDKEVQKKVTSNISYGGGCVNDVVYHLATPYLPFGGVGSSGLGSYHGEESFRTFSHYKSILAQSTAFDMKIRYSSTKSALKFIRKLLK

SEQ ID NO: 44539 - protein, 497 aa, symbiont bacterium of Paederus fuscipes
MTTPTRADWEIRAKDLNIEGRAFVNGEYRNAASGETFDCLSPVDGRFLAKVASCDQADAEQAVKAARAAFDSGVWSRLAPAKRKRTMIRFADLLLKNAEELALLETLDMGKPISDSLHIDVSSAANSIYWNAEAIDKIYDEVAATPHEELGLVTREPVGVVTAIVPWNFPLLMACWKLGPALATGNSVILKPSEKSPLTAIRIACLATDAGIPTGVFNVLPGYGHTVGKALALHMDVDTLVFTGSTRIAKQLMIYAGESNMKRIWLEAGGKSPNIVFADAPDLKAAAEAAASAIAFNQGEVCTAGSRLLVERSIKDRFLPLVVEALKGWKPSNPLDPDTNVGALVDTQQLHTVLSYIEAGHKDGARLMVGGKRILEETGGVYVEPTLFDGVDNAMKIAREEIFGPVLSVITFENAEEAVRIANNTQYGLAAAVWTSDLSKAHLTAKALRAGSVWINQYDGGDMTAPFGGFKQSGNGRDKSLHAFDKYTELKATWIKL

SEQ ID NO: 44540 - protein, 639 aa, Xanthomonas axonopodis pv. citri str. 306
MISLRNFSMRRGERLLLSNVDLTMHAGYRVGVVGRNGTGKSSLFAAVKGELEADKGDVDLPGKVRTASVSQETPSLPDPALSFVLGGDIEVSAVLQEEAAATAREDWEAVANAHQKMAEIGAYDAEARAGKLLHGLGFPADTHHRAVSSFSGGWRVRLNLARALMMPSDLLLLDEPTNHLDMDAVLWLEQWLLKYPGTLLLISHDREFLDNVATHTLHLHGGTAKLYVGGYTDFERQRIEHLRQQQIAHDKEQAERAHLQSFIDRFKAQASKATQAQSRMKRLAKMAGTEAVRAEREFRIQFAQPNRLPFSLIRLNHVEAGYPAPATLPPRAGEGARRADGGDAATVILHDVGFGLEAGDRIGLLGPNGAGKSTLVKTLVGELAPLAGERSAHPDLRIGYFAQHTVESLHEGQSPMDHFRELSPDGANQAFRDFLGKWNFAGDRAFEVVDGFSGGERARLALALIAWQQPNVLLLDEPTNHLDLEMREALAEALSDFEGAIVMVSHDRHLIGLVCDSFWRVADGVVEPFAGDLDEYAAWLRSRPAAQGTKQKMAEVAPTPPPPTKPLPPKKAVNPHKLASAEKRVGELEAALAALDRELANPGNYADSEKMAVLGRDREATAQQLAEAETAWMELIDGA

SEQ ID NO: 44541 - protein, 482 aa, Klebsiella pneumoniae subsp. pneumoniae MGH 78578
MQLNDMTLFRQQALIDGQWRDAPNGDVIAVTNPANGEQLGSVPKMGADETREAIEAANRALPAWRALTAKERANILRRWFDLMMENQDDLARLMTLEQGKPLAEAKGEISYAASFIEWFAEEGKRIYGDTIPGHQADKRLLVIKQPIGVTAAITPWNFPAAMITRKAGPALAAGCTMVLKPASQTPFSALALAELANRAGIPAGVFNVVTGSAGAVGGELTSNPLVRKLSFTGSTEIGRQLMEQCAKDIKKVSLELGGNAPFIVFDDADLDKAVEGALASKFRNAGQTCVCANRLYVQDGVYDRFAEKLQQAVEKLRIGDGLQDGVTTGPLIDEKAVAKVEEHIADAIAKGAKVVTGGKPHALGGNFFQPTILVNVPDSAKVAKEETFGPLAPLFRFKDEADVIAQANDTEFGLAAYFYARDLSRVFRVGEALEYGIIGINTGIISTEVAPFGGVKASGLGREGSKYGIEDYLEIKYMCIGL

SEQ ID NO: 44542 - protein, 315 aa, Corynebacterium glutamicum ATCC 13032
MSLPIDEHVNAVKTVVVPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPDDLVLPTGVMERMAQVRAEFGGSVLCAVEVSEADVSKYGIFEIEADTKDSDVKKVKGMVEKPAIEDAPSRLAATGRYLLDRKIFDALRRITPGAGGELQLTDAIDLLIDEGHPVHIVIHQGKRHDLGNPGGYIPACVDFGLSHPVYGAQLKDAIKQILAEHEAAERIADDSQVK

SEQ ID NO: 44543 - protein, 122 aa, Triticum aestivum
MAARLAQLRTKAAQATEFASKHGGAYYKEAMEKNKQYVVQPPSVEKCQELSKQLFYTRLASLPGRYEALWKEVDGVKQLWKNRKELRVEDLGIVTLFGVELYAWFCIGEIAGRGFTLTGYKV

SEQ ID NO: 44544 - protein, 334 aa, Chlamydia trachomatis D/UW-3/CX
MRIVINGFGRIGRLVLRQILKRNSPIEVVAINDLVAGDLLTYLFKYDSTHGSFAPQATFSDGCLVMGERKVHFLAEKDVQKLPWKDLDVDVVVESTGLFVNRDDVAKHLDSGAKRVLITAPAKGDVPTFVMGVNHQQFDPADVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAICEAVKHAANTSMKNIMYYTEEAVVSSDFIGCEYSSVFDAQAGVALNDRFFKLVAWYDNEIGYATRIVDLLEYVQENSK

SEQ ID NO: 44545 - protein, 352 aa, Aspergillus nidulans FGSC A4
MSVPEVQWAQVVEKAGTPPVYKQVPVPKPGPDEILVKMRYSGVCHTDLHAMKGDWPLPSKMPLIGGHEGAGVVVAKGELVKDEDFKIGDRAGIKWLNGSCLSCEMCMQADEPLCPHASLSGYTVDGTFQQYTIGKAALASKIPDNVPLDAAAPILCAGITVYKGLKESGARPGQTVAIVGAGGGLGSLAQQYAKAMGLRTIAIDSGDEKKAMCEQLGAEVFIDFSKSADVVADVKAATPGGLGAHAVILLAVAEKPFQQATEYVRSHGSVVAIGLPANAFLKAPVFTTVVRMINIKGSYVGNRQDGVEALDFFARGLIKAPFKKAPLQDLPQIFELMGQGKIAGRYVLEIPE

SEQ ID NO: 44546 - protein, 66 aa, Glycine max
  misc_feature (11)..(11): Xaa can be any naturally occurring amino acid
  misc_feature (16)..(17): Xaa can be any naturally occurring amino acid
  misc_feature (57)..(57): Xaa can be any naturally occurring amino acid
SQKLIEIDDDXKLRIXXDKRMSAEVAGDALGDEFKGYVFKITGGNDKQGFPLKQGVXVQGRVRLLL

SEQ ID NO: 44547 - protein, 490 aa, Escallonia calcottiae
GSGVSTLEKKNSGRIAQIIGPVLDVAFPPGKMPNIYNALVVKGRDTGGQPINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIGESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 44548 - protein, 503 aa, Escherichia coli
  misc_feature (350)..(350): Xaa can be any naturally occurring amino acid
METKDLIVIGGGINGAGIAADAGGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLNVYNTHFKKQLSRDDIVWTYSGVRPLCDDESDSPHVLPVITPLIFMMKMAKHRCCRXSAAKLTTYRKLAEHALEKLTPYYQGIGPAWTKESVLPGGAIEGDRDDYAARLRRRYPFLTESLARHYARTYGSNSELLLGNAGTVSDLGEDFGHEFYEAELKYLVDHEWVRRAARRPVASHKTRHVAKCGSTISCESVAGGVYAAEVIAGVVN

SEQ ID NO: 44549 - protein, 635 aa, Aspergillus nidulans FGSC A4
MAATDRAVNETSPLVGARTTDDADVDSMTFVNGSGNEAPHDMPETKTSWYLFILTLSIGGLQVVWSVELSSGSPYLLSLGMSKALLAFVWIAGPITGTLVQPYIGIRSDNCRISWGKRKPFMIVGGAVTIATLLGLAWVKEFVGGFLVLFGGDPKSEGANIVIGIVATMMMWCLDFAINTVQAGIRCFIVDNAPAHQQESANAWASRMTGVGNIIGYIFGYINLPKLFPYLGNTRFQILCALASISLAVTLLISCSYIQERDPRLDGPPPSGSMGVVGFFKQVFKSIKHLPPQAAKVCEVQIAAWIAWFPFLFYATTYIGQLYVNPIFEKNPGLSDSDIDKAWEDATRVGTLALLIYALVSFVANITLPIFVVPTYKPVLSSDSSEVDIRQEAEPCLRVERQSSSDIEVGLVAELHPEVLRDKARGSAESKSWSSKLQIPGLTLRRTWLLSQILFALCMFSTFFITSVTAATVVVGLIGIPWALSLWAPFALISAEVATLEEQRRSRRQRSELTTFDEQMSPQIDRDAADDNDDDDDDDDNDDNDAETGSSRSPKTPGDENSAQAGIVLGLHNVAVSAPQVLSSLICSAIFRASQKPRGEPYDESVGWVLRFGGCAALLAAWLTSRLSEGTPRKR

SEQ ID NO: 44550 - protein, 574 aa, Vibrio angustum S14
MISGILASPGIAFAKALLLQEEEVVLNKAPISADQIDNEIQRFFDARKKSSEQLEVIKEKARVTFGEEKEAIFEGHIMLLEDEELEEEIIALIKDKMSADFAIYSVIEEQAQTLESLDDEYLKERASDIRDIGSRFVKNALGINVINLSAISEEVILVANDLTPSETAQINLDYVRGFITDIGGRTSHTSIMARSLEIPAIVGTNDITSKVKSGDMLVLDAINNQVVINPTDDELNKFKAISDAHKAEQEELAKLKDLPAITLDGKQVEVCGNVGTVKDCDGVNRNGGEGVGLYRTEFLFMDRDSLPTEEEQYQAYKEVAEAMHGEPVIIRTMDIGGDKDLPYLDLPKEMNPFLGWRAIRISLDRREILRDQFRAILRASAHGKIRIMFPMIISVEEVRTLKAAIEEFKVELTAEGLAFDADIEIGVMVETPAAAAIAHHLAKEVSFFSIGTNDLTQYTLAVDRGNELISHLYNPLSPAVLTVIKQVIDASHVEGKWTGMCGELAGDERATLLLLGMGLDEFSMSAISIPRIKKVIRNANFADVKAMAEYALTLPTAAEIEEHVEKFIAEKTIC

SEQ ID NO: 44551 - protein, 550 aa, Zea mays
MKRVSSHVSLASEAEINLDLSRLVIDKPRFTLERKRSFDEQSWSELSHRQNDGFDSVLQSPAFPSGGFDSPFSVGTHFGGPHPLVNEAWEALRKSVVYFREQPVGTIAAVDHASEEVLNYDQVFVRDFVPSALAFLMNNETDIVKNFLLKTLHLQSSEKMVDRFKLGAGAMPASFKVDRNKNRNTETLVADFGESAIGRVAPVDSGFWWIILLRAYTKYTGDVSLSESPECQKCMRLILNLCLSEGFDTFPTLLCTDGCSMIDRRMGIYGYPIEIQALFYMALRCALQMLKPEGEGKDFIEKIGQRLHALTYHMRNYFWLDFHQLNNIYRYKTEEYSHTAVNKFNVIPDSIPDWVFDFMPCRGGYFLGNVSPAMMDFRWFALGNCIAIVSSLATPEQSVAIMDLIEEKWDELVGEMPLKICYPALENHEWRIITGCDPKNTRWSYHNGGSWPVLLWLLTAACIKTGRPQMAKRAIELAESRLLKDGWPEYYDGKLGRFVGKQARKFQTWSIAGYLVARMMLEDPSTLMMISMEEDRPVKPTMRRSASWNA

SEQ ID NO: 44552 - protein, 454 aa, Bacillus subtilis
MTSLIKIHAHGRRFEIFRSRGNPTVEVDLYTAKDLFRAAGARRCVHCHLRGPRTPRCCCLDPASYEMGLKGCYAHQYNYKTCSGSQETGCCEAGEDCPADDADGRHSSQLYDLIKKHPASVPGCLQGCCRGEGGALYRHIADFAGNPEVTLPVPAFIVINGGSHPANKFAQEFILLPVGASSFRTAGPAEVYHNLKNVIKEKYGKDATNVGDEGGFAPNILENKEALELLKSAIAKAGYTDQVVIGDVAASEFYRAGKYDLDFKSPDDASRYITPDQLADQLKSFTTCISSLLLTLPDASLQSRFGYYPDGDQPQAHRAGSGGEGLQLPPLEVTESLQACKLAQSNACGVIVSIDLRRLRTLFIADLFFGRVRADQDFSPCPICACQVECSFESRGLGRANKAKFAGRSFGPPLAKFPNLTAGHACTKYTPEQVSSRRGGGKTTTPNNPPSFCC

SEQ ID NO: 44553 - protein, 322 aa, Vibrio angustum S14
MSKIYEDNSLTIGNTPLVRLNRVSNGKVLAKVEARNPSFSVKCRIGANMIWDAEKKGLLKEGVELVEPTSGNTGVALAFVAAARGYKLTLTMPESMSLERRKLLKALGANLVLTEAPKGMKGAIDKAEEIVNSDPSKYLLLQQFNNPANPEIHEKTTGPEIWDATDGEVDVFVSGVGTGGTLTGVSRFIKQQKGKAITTIAVEPLESPVITQTLNGDTVQPAPHKIQGIGAGFIPGNLDLSLIDEVQKVSSDDAIEMARRLMDEEGILAGISSGAAVVAANNIAARPEFADKNIVVILPSSGERYLSTALFAGIFTEKETQQ

SEQ ID NO: 44554 - protein, 198 aa, Klebsiella pneumoniae subsp. pneumoniae MGH 78578
MPIYQIDGLTPVVPEESYVHPTAVLIGDVILGKGVYVGPNASLRGDFGRIVVKDGANIQDNCVMHGFPGQDTVVEEEGHIGHGAILHGCVIGRNALVGMSAVIIDGAVIGENSIVGASAFVKANAEMPANHLIIGSPAKAIRTLSEQELAWKKQGTREYQALVERCKQTLHQVEPLREVEAGRKRLAFDENLRPKAAT

SEQ ID NO: 44555 - protein, 467 aa, Escallonia resinosa
GSGVSTLEKKNSGRIAQIIGPVLDVAFPPGKMPNIYNALVVKGRDTDRQPINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIGESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQRVKQTLQRYKELQDIIAILGLDELSEEDRLTVARARKIERFLSQPFFVAEVFTGSPGKYVGLAETIRGFQLILSGELDGLPEQAFY

SEQ ID NO: 44556 - protein, 252 aa, Coprinopsis cinerea okayama7#130
MSGSLDKTVRVWDLRSPTCRGLLALPEAPVVAYDTTGMVFAVGVNRFSKIMLYDQANFDKAPFLTINLIDPYLTQASFPPRPIFMTSLAFSTNGKYILVGCSGSVHYVVDSYEGHVLARLEGHVGLERRSVNAPPDIEPAKGISGEEVSWTPDSKYVVSGSLDGKIHMWSIKRMEEILGETPSLPEGSRKPIKIQSFVQLEADASSPTRCLRFNPRLGMFATAGTELAFWLPDTSDNPDDVAKALLKKKLGT

SEQ ID NO: 44557 - protein, 135 aa, Klebsiella pneumoniae subsp. pneumoniae MGH 78578
MAEKLSAHCHCGAVAFTVELSDGFNTVRRCNCSYCRMRGAVAVSSPRSGIEVVRGGDKLTEYRFNTGEAVHFFCSVCGIYTFHQRRSNPQQYGVNVACIDGVSPFDFPCVEVNDGVNHPKDGGGGVVGYLRYEKK

SEQ ID NO: 44558 - protein, 500 aa, Oryza sativa Indica Group
MGDAGGNAGQGRLAMRATIGRNGESAMLVAAPVGGGWREGRGGVVMAERRWREGAASAELDQIAAMERDTSSSDVSASHVGRARQRRRPTEATADGNRTNGPALLVNDQNKYKSMLIRTYSTVWMIGGFVLIVYMGHLYIWAMVVVIQIFMAKELFNLLRKSSEEKQLPGFRLLNWHFFFTAMLFTYGRFLSRQLVNTVTSDHLLYKVVSGLIKYQMFICYFLYIAGFVWFILTLKKKTYKYQFKQYAWTHMILLTVFAQSSFTVANIFEGMFWFLLPASLIVINDIAAYLFGFFLGRTPLIKLSPKKTWEGFIGASVTTIISAFVLANVMGRFQWLTCPRKVRYHFLWNVIDLSTGWLCCDPGPMFKPEHYSLGEWVPKGFPWKEVVLLPVQWHALALGLFASIIAPFGGFFASGFKRAFKIKDFGDSIPGHGGITDRMDCQMVMAVFAYIYHQSFISPQNYSVELILEQILRNLTFEEQKFLYQQLGEIYRERQLMQS

SEQ ID NO: 44559 - protein, 493 aa, Glycine max
MVFPKPSSESDLFLCSNFASHYARDSLPRFSMPENSMPKEAAYQNIHDELQLDAIPKLNLASFVTTSMEEECNKLIMESINKNYVDMDEYPATTDLHNRCVNMIARMFHAEIGENENATGAGTVGSSEAIMLAGLAFKKKWQNKRKAEGKPYDKPNLVTGSNVQVCWEKFARYFEVELREVEVREGYYVMDPAKAVELVDENTICVAAILGSTYNGEFEDVKLLNDLLLEKNKQTGWDTPIHVDAASGGFIAPFLYPELEWDFRLPLVKSINVSGHKYGLVYAGIGWVIWRTKDDLPEDLVFHINYLGADQPTFTLNFSKGSSQIIAQYYQLIRLGHEGYRSIMENCRDNAMVLKESLEKSGHFNILSKDNGVPVVAFSLKDRSQYDEYKISEMLRRHGWIVPAYPMPPAAQHINVLRVVIRAEFSRTLAERLVFDIYNVLHELEKLHPPKVTNFIKEENKALVETGVKKTALDAHREIIAQESNKRQKIMAA

SEQ ID NO: 44560 - protein, 224 aa, Cryptococcus neoformans var. neoformans JEC21
MSKAIISPSVLASDLSDLSNECRRMMANGCDWLHMDVMDGHFVPNITMGAPILEHVYKNVPNIFMDCHMMVSNPSQWVPEVAKAGGKLYTFHYEATEEPEKVIELVHSHNMLAGLAISPETPASAITDSLGKAADLLLVMTVRPGRGGQRFMPECLEKVKELRERFPGKNIQVDGGVGSGNACQCAQAGSNVLVAGTAIFGAKDPKQTIQEMRTAVDGAIAQQK

SEQ ID NO: 44561 - protein, 625 aa, Zea mays
MGNTCVGPSAAGRNGFLANVTLWRPRGDDPTPAPALPPPSSPASDKAPDPVTIPESKPSSHHSSRSTDLPPAPASQPQAQAQDNTPAKQPAPKVKRVQSAGLLADSVLKRDVNTARLKDLYTIGKKLGQGQFGTTYLCVEKATGREFACKSIAKRKLITEEDVEDVRREIQIMHHLAGHANVVSIVGAYEDAVAVQLVMELCAGGELFDRIIKRGHYSEKAAAQLARVIVGVVESCHSLGVMHRDLKPENFLFVNQKEDSPLMTIDFGLSIFFKPGEMFTDVVGSPYYVAPEVLLKYYGREVDVWSAGVIIYILLSGVPPFWDGEAESEQGIFEQVLRGDLDFSSEPWPSISESAKDLVRKMLIRDPKKRLTAHEALCHPWVCVDGVAPDKPLDSAVLSRLKQFSAMNKLKKMALRVIAESLSEEEIAGLKEMFKMIDTDNSGHITLEELKTGLQRVGANLMDSEINALMEAADIDNSGTIDYGEFIAATLHINKVEKEDKLFAAFSYFDKDGSGYITQDELQKACEEFGIGDTRLEDIIGDIDQDNDGRIDYNEFVAMMQKGDNPLGRKGYQSNGADVSRYSKRSIQQLRNLDQTTAPKACTMPVHWSPRFNDALSKSGVAEAI

SEQ ID NO: 44562 - protein, 399 aa, Geobacter sulfurreducens PCA
MKLADRVNKIQPSPTLSIDAKAKALKAQGIDVVGFGAGEPDFDTPANIKEAGKKAIDAGFTKYMPVGGADDLKDAIIAKMKRDHGLEYTRDEISVACGAKHTLYNISQALIQEGDEVIIPGPYWVSYPDQIVLAGGTPVFIMTDESTGFKITAEQLEKAITPRTVYVILNSPCNPTGSTYTKDELKALAAVLLKHPHVYVVSDDIYEKLLYDGLEFCNIPMACPELKDRTIIVNGVSKAYSMTGWRIGYACGPKALMAAMTKMQSQSTSNATSIAQKASVEALNGPQEPVAEMVKEFEKRRTYIVDRLNAIPGVTCFKSTGAFYAFPNFSGVYGKTTPAGKKIENSSDFAAYLLEDAKVALVPGIAFGDDRYARLSYATSLETIKKGLDRIEEAIGNLK

SEQ ID NO: 44563 - protein, 224 aa, Oryza sativa Japonica Group
MSFIFGKRKTPAELLRENKRMLDKSIREIERERQGLQAQEKKLIAEIKKVAKQGQMGAVKIMAKDLIRTRHQITKFYALKSQLQGVSLRIQTLKSTQAMGEAMKGVTKAMRQMNRQMNLPALQKIMREFEIQNEKMEIVSSTMNDAIDDALEGDEEEEETEELVNQVLDEIGIDVNSELVGAPSTAVAAPVGAGKVAAQAEAAGGGDGGIDDDLQARLDNLRKM

SEQ ID NO: 44564 - protein, 367 aa, Streptomyces coelicolor A3(2)
MRSYVRQEQPPGGRTGLRLCGGHVAPSAHGRGTQATSAPHATTRRSAPDHPALREPPCHLPLSDHLRVGSGGTLNGRGRVRTMAQEVRGVIAPGKDEPVRIETIVVPDPGPGEAVVKIQACGVCHTDLHYKQGGINDEFPFLLGHEAAGVVESVGAGVTDVAPGDFVILNWRAVCGKCRACRRGRPWYCFDTHNAEQRMTLASTGQELSPALGIGAFAEKTLVAAGQCTKVDPAVPAEVAGLLGCGVMAGIGAAINTGNVGRGDTVAVIGCGGVGDAAIAGSYLAGASKVIAVDIDDRKLETARTMGATHTVNSRGTDPVEAIRELTGGFGADVVIEPSAARRPTARPSTPATWPAPSSWSACPLPR

SEQ ID NO: 44565 - protein, 543 aa, Rhodopseudomonas palustris CGA009
MPTLATALLDALKDHGAREIFGIPGDFVLPFFKVIEESGTLPYFTMSHEPAVGFAADAASRYRGSIGVAVVTYGAGAFNLVNSIAGAYAERSPVVVIAGAPGARERTSGYLLHHQVRTVDSQLAVFKEVTCDQAVLSDPATAPAEIARVLRSALELSLPVYIEFPRDMVDAKVDPVPKLPRREADIGARDECAEEILDRIARAKSPVMVVDVEIRRYGVEQQVAALARKLGLPVVTTFMGRGLLEGDDDVVAGTYLGAAGDPDLSALVEGADLVLMFGVILSDTNFALSSNMTDPRRTVLATGREVQIGHHVYRDLPLADLIAGLDAHASQHPPRPRNVGKGMAYPRGLTLDASPIAPSDIATAINDLFDRHGKMPMTADIGDCLFTAMEIDNTALAAPGYYAGMGFGVPAGVGVAATGLRPLVLVGDGAFQMTGWELGNCKRYGLDPIVVLFNNCSWEMLRVFQPESKFNDLDDWHFADIAHSIGGFGERVTTRAELAAALQRAVERRGVFSLIEVMLPRGVTSHTLARFVTGFKAARERMK

SEQ ID NO: 44566 - protein, 343 aa, Arabidopsis thaliana
MERYEIVKDIGSGNFGVAKLVRDKFSKELFAVKFIERGQKIDEHVQREIMNHRSLIHPNIIRFKEVLLTATHLALVMEYAAGGELFGRICSAGRFSEDEARFFFQQLISGVNYCHSLQICHRDLKLENTLLDGSEAPRVKICDFGYSKSGVLHSQPKTTVGTPAYIAPEVLSTKEYDGKIADVWSCGVTLYVMLVGAYPFEDPSDPKDFRKTIGRILKAQYAIPDYVRVSDKCRHLLSRIFVANPEKRITIEEIKNHSWFLKNLPVEMYEGSLMMNGPSTQTVEEIVWIIEEARKPITVATGLAGAGGSGGSSNGAIGSSSMDLDDLDTDFDDIDTADLLSPL

SEQ ID NO: 44567 - protein, 611 aa, Mycobacterium leprae
MRATQLYAASFRPGFDSPPQLVPVALRGSAPDTTTVASAGELAVGTTDPCPAPVAQIGVADVYVPAPTSPEPEGLPQVAPVFSRGNVPDTTAVPAAAGTTVGVADPYLPPGVGHLSGFAVPSHGIVPTVPGVLAGGPPTAPVAPRNSAPVLRPEWPYHVPSVSDLDWFDAVPAGVPGGDEHNYNFLIAAPQVPRLADEHEMVDVFDIQAVRADFPILQETVNGKPLIWFDNAATTQKPQVVIDRLSYFYAHENSNIHRAAHELAARATDAYEEARETARRFIGAAKAQEIIFVRGTTEAINLVAYAWGGKHLQPGDEVVITHLEHHANIVPWQLLSSQTGAILKVAPVDDAGNLLMSEFEDLLGPRTKLVAATQVSNALGTVTQGEKIVELGHRYGARVLIDGAQSIPHLPINVSELGADFFVFSGHKIYGPTGIGVLYGCEDVLTEMPPWQGGGNMIVDVTLERSLYQGPPNKFEAGTGNIADAVGLGEALRYVERVGVQRIASHEQALLDYATPRLADIPGVRLVGTATEKASVLSFVLAGHEPLEVGKALNAEGIAVRAGHHCAQPVLRRLGLEATVRPSFAFYNTYEEIDVFINVVRRIAEGGTNIG

SEQ ID NO: 44568 - protein, 186 aa, Aspergillus nidulans FGSC A4
MSKFRPCIDLHSGQVKQIVGGTLSNVESDLKTNYVSKLPASHFAGLYKQHNLRGGHVVKLGPGNDDAAKEALRTWPGGLQIAGGITDENAQYWIEQGAEKVIITSFLFPEGRFSLERLQSVLTALGGDKSKLVLDLSCRRKGDTWFVAMNRWQTITEMEINQGSALDIFGGSGVTFDECVKWNNEH

SEQ ID NO: 44569 - protein, 460 aa, Enterobacter aerogenes
MATGKIVQVIGAVVDVEFPQDAVPRVYDALEVQNGNESLVLEVQQQLGGGVVRAIAMGSSDGLRRGLEVKDLEHPTEVPVGKAILGRIMNVLGEPIDMKGDIGEEERWAIHRAAPSYEELSSSQELLETGIKVIDLMCPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSLLQRYQELKDIIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 44570 - protein, 624 aa, Vitis vinifera
MEMRSRVIAFWFVPFLWFWTSANGLLSPKGVNFEVQALMGIKAFLVDPHGVLDNWDGDAVDPCSWTMVTCSTDSLVVGLGTPSQNLSGTLSPSIGNLTNLQIVLLQNNNITGPIPQELGRLSKLHTLDLSNNFFTDEVPSSLGHLTSLQYLRLNNNSLSGPFPVSLANMTQLAFLDLSFNNLSGPVPRFPAKTFNIVGNPLICATGSEQECYGTTLMPMSMTLNSSQTALPTRRSKNHKLALAFGTSLGCICLLIFGGGLLLWWRQRHNQQMFFDVNDRHHEEVSLGNLKRFQFRELQIATDNFSSKNILGKGGFGNVYKGYLQDGTIVAVKRLKDGNAVGGEIQFQTEVEMISLAVHRNLLRLYGFCITTSERLLVYPYMSNGSVASRLKGKPVLDWGTRKRIALGAARGLLYLHEQCDPKIIHRDVKAANILLDDYCEAVVGDFGLAKLLDHQDSHVTTAVRGTVGHIAPEYLSTGQSSEKTDVFGFGILLLELITGQRALEFGKAANQKGAMLDWVKKIHQEKRLEILVDKDLKHFYDRVELEEMVQVALLCTQYLPGHRPKMSEVVQMLEGDGLAERWEASQRGEVTKCKPHELSSSERYSDLTDDSSLLVQAMELSGPR

SEQ ID NO: 44571 - protein, 302 aa, Pseudomonas syringae pv. tomato str. DC3000
MHDLLNEILDEVRPLLGQGKVADYIPALGGVRPDQLGIAVYGNDGQVFSAGDAETLFSIQSISKVFSLVQAIGHSGEDIWQRLGHEPSGQPFNSLVQLEFEQGRPRNPFINAGALVICDINQARFAAPSLSMRDFVRRLCGNRSITSDSKVAESEYQHRSRNAAAAYLMKSFDNFHGDVEDVLRSYFHHCALSMNCIDLAKAFGFLANQGFCAHSGVQILTARQATQVNSIMATSGLYDEAGNFAYRVGLPGKSGVGGGIVAIVPERASVCVWSPALNAAGNSLVGMAALEKLSARVDWSVF

SEQ ID NO: 44572 - protein, 98 aa, Synechococcus sp.
ASYKVTLVNESEGLNKTIEVPDDQYILDAAEEQGIDLPYSCRAGACSTCAGKLTSGTVDQSDQSFLDDDQIEAGFVLTCVAYPTSDCTIKTHTEEELY

SEQ ID NO: 44573 - protein, 125 aa, Triticum aestivum
  misc_feature (61)..(61): Xaa can be any naturally occurring amino acid
  misc_feature (83)..(83): Xaa can be any naturally occurring amino acid
  misc_feature (106)..(106): Xaa can be any naturally occurring amino acid
DSAPCDGNAYISFHNLEGWQHNIAVGEVVAMLDIKPEKEIAVHVQSIPLEHPGWRSRGILXVQIEVQGWEKHVVSGATEMLSXRLTLVDDYLMHGEGESFLWSSNXSNSNEIRDFLSSGWVYMCQ

SEQ ID NO: 44574 - protein, 334 aa, Aspergillus nidulans FGSC A4
MAENETYKHADKDGHFRRKDSVFRSWVSASPDADFPAEKDRYVLYLNYGCPWAHRTNIVRSLKGLEDIIQLVVCDFELGSQGWFFSESGRNGSAKKDPLYGFTTISQLYFKADPEYKGRYTIPVLWDKKKETIVNNESSEIIRMFYTEFDHLLPEERREVNQPGGGLYPPHLRGEIEAMNEWVYDRINNGVYKTGFAATQEAYEASLHPLFEALDRIEGHLAQPGHQPYLFGEHITEADVRLYTTIARFDVAYYLIFKCNLKMIRHDYPLIDAWYRRLYYDESEKTRGGAFGKTTFLGLYKFGYLAALGKKQSVDSSQLIVPAGPKPDILPRDA

SEQ ID NO: 44575 - protein, 424 aa, Klebsiella pneumoniae subsp. pneumoniae MGH 78578
MEKLSYASESSTSPWTTYLRQIDRVAPYLGDLAYWVETLRHPKRALIVDIPVQMDDGTIRHFEGYRVQHNLSRGPGKGGVRYHPDVDLNEVMALSAWMTIKCAAVNIPYGGAKGGIRVDPFSLSEGELERLTRRYTSEIGIIIGPQKDIPAPDVGTNGKVMAWMMDTYSMNHGTTITGVVTGKPIHLGGSLGREKATGRGVFVTGREVARRAGIEIEGAKVALQGFGNVGSEAARLFAGVGARIVVIQDHTATLYNEGGIDMAALTAWQAEKKQIAGFPGAQEIDKDAFWTTPMDILIPAALEGQITRERAEKLTCKLVLEGANGPTYPEADDVLAERGVIVVPDVICNAGGVTVSYFEWVQDMASFFWSEEEINAKMDRIMTDAIVHVWDKAAEKECTLRTAAYIVACERILMARKDRGIYPG

SEQ ID NO: 44576 - protein, 542 aa, Physcomitrella patens
MEAGGRPMGPATAEYYLPNYKLGKTLGIGSFGKVKVAEHSPTGHKVAIKILNRRKVKMMDMEEKVRREIKILRLFMHPHIIRLYEVIETPADIFVVMEYVKSGELFDYIVEKGRLGEHEARRFFQQIVSGVEYCHRNMVVHRDLKPENLLLDSKSNVKIADFGLSNVMRDGHFLKTSCGSPNYAAPEVISGKLYAGPEVDVWSCGVILYALLCGSLPFDDENIPNLFKKIKGGIYTLPSHLSPGARDLIPRMLLVDPMKRVTIPEIRQHPWFLNHLPRYLAVPPPDTTQQAKRIDEEILERVVALNFDRDLLIDSLLNRVQNKATVAYYLMLDNRRRLSNGYLCSEFNEGKEHLMSPMDAFNGTPRSGYPRTLTHMSSMDRRSASPSGLQHRVVAERKWVLGLQLRSHPKEIMNDVLKTLRDLGINWKKTGAYNLKCRWVAPGQNSNDTTAENHSLPDSPMAGSMPRASSCRWSSEQHGVSGSVAAGNRDNESGVESNVLKFELQLFKLREEKYLLDLQRVVGPTYLFLDLCAAFLAELRVL

SEQ ID NO: 44577 - protein, 336 aa, Sinorhizobium fredii
MLHTTVTQLIGQTPVMSIDVPGRNATLVLKIEKNNPGGSMKDRMARSMVVAALEDGRLAPGGTIVESSSGNTGTGLALAALEFGLRFIAVVDHHAAPEKIRMMRALGAEIRYVEGDFRDDEVAVVERQRLAAQLGAQLPGALFMNQSDNPANPEGYAGLVDELVAQLPGGIDAFVGCVGTGGSMTGISQRLKRHNPAVRTIAVEPAGSIVFGKPGHPYYQSGTGTPAGDEVGKVLDYGCIDEGVQVTDTQAFETARYIARRKGLLVGGSTGGAIYKPPEFIAAGTLTGTVVTTVADGGEKYLGTIFDEEWMAKRRLLDPAIAAQLDGWLFGKARAA

SEQ ID NO: 44578 - protein, 506 aa, Cryptococcus neoformans var. neoformans JEC21
MEGRYNPFEDPDTIPVYQIFLLFITFVGPPTFLFVLFVRRTATRPHLHHTATVLVLGDIGRSPRMMYHSESLARHNWRTFMVGYAETPPTSALLENPMVHLLGLKEPPKMVGLLPWILRAPIRIIYQVFSVIHTCIWRVPCNTEILLVQNPPSIPTLALAQFICLATKTKLIIDWHNTGYSILGLRVGEGSRLVRIAKWFESTFGQTAYAHLFVTKALQEFLIREWDLKGRTSVLHDRPPTHFHRTVPMIQHELFSRLLPELKPSLPPSHLDTNDPTHTAFTEISSEGLAVLKHTRPALIISSTSWTADEDFSLLITALDLYQSAVDSGSALPKLVVLITGKGALRAPFENIVKSREISKWKDITVRCVFVPAQEYPPLLGCADLGVSLHTSSSGKDLPMKVVDMFGCGVPVLAKDFQCISELVKDGENGKVFGTGEELGEQMIDILSSFPSSEKLDDLKGYFDRMNTPRRRATLPTADVGEDEWSNWDDNWDNVVYNGILNKIRR

SEQ ID NO: 44579 - protein, 454 aa, Oryza sativa Indica Group
MVHLVKREIDVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYKGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKSGMQHLVHQMLPAPNGTPVIEKVERSSSLQAPLTLKLIGTEGSMS

SEQ ID NO: 44580 - protein, 545 aa, Physcomitrella patens
MDSGGRPVAPVAVEYYLPNYKMGKTLGIGSFGKVKVAEHTPTGHKVAIKILNRRKVKSMDMEEKVRREIKILRLFMHPHIIRLYEVIETPTDIFVVMEYVKSGELFDYIVEKQRLGEDEARRFFQQIVSGVEYCHRNMVVHRDLKPENLLLDSKWNVKIADFGLSNIMRDGHFLKTSCGSPNYAAPEVISGKLYAGPEVDVWSCGVILYALLCGSLPFDDENIPNLFRKIKGGIYTLPSHLSPGARDLIPRMLLVDPMKRVTIPEIRQHPWFLNHLPRYLAVPPPDTLQQAKRIDEEILERVVALNFDRVHLIESLLNRVQNKATVAYYLMLDNRRRLSNGYLGSEFDEGKEQSLSPMSPYGAHGGTPRSTYPRSLIRTPSMDRRGSSSSVLQHRVVAERKWALGVQLRSHPKEIMSDVLDTLRKCDINWKKTGAYNLKCRWVAPNQHLNDRASEHRGIPDSPMAGTTPRVSSGRWSSEQQGISGSVASGNKDDESGVESNVLKFELQLFKMREEKYLLDLQRVEGPTYLFLDLFSAFLIELRVA

SEQ ID NO: 44581 - protein, 2082 aa, Geobacter sulfurreducens PCA
MNVTTLWGGWFKALLAAAFILATLGAPAAGWSAVPHVAAGGNHVLTLRSDGTLWAAGSNQFGQLGDGTGINRTSPVQVPGTWKTVAAGTTHSLGIKADGSLWAWGSNLFGQLGQPLVNGQLATNKFSPIRIGTGNDWVAVSAGELTSFGLKGDGTLWSWGNNLFGELGDGTTVSRPQPVQVVADPLSNGRYVAVAAGGEHALALQADGTLWAWGANLTGQLGTGGTGILPNPTPLKIGTDRDWTAISAGEMHSVALKADGSLWSWGQNLFGELGNGVALPGANVTTPTRVGTGSDWVAIAAGALHTVALHRNGTVSAWGNNAQGAVGDGTVANRSTPTLIVAPVTLVNNVAIAAGTGVSFSVLANGTVFGWGGNGAGQLGNGTFGAVTAPTVLSAGASAWLGVEPGGAFSLGLRSNGTLWAWGGNASGQLGDGTTTPSAIPVPVVGGAGNWRTTATGTAHSVAVRADGTLWAWGDNSSGQLGIGSTVAASTPQQITVTNPASAGNDWTAVAGGGAHSLGLKADGTLWSWGDNTFGQLGDGTGTSNRTTPVQIVTGNPGNFDRNWVAVAAGGVFSLALQADGTIWTWGDNSLLQLGTDPAMLTPATQRNVPAQLAVASPPSTAFNSSWVAIAAGQDHGLSLQADGTLWAWGANSVGQLGNGVTTATFTPVQVINAEGVPYVSLAAGTSHSLAGRSDGTLWAWGNNTSGQLGTGPHPGDADPLNPQPHTVPARILTSNPVSAADDWLVATAGGSHSAALKSNGTLWTWGQNTSGQLGNGTTTEADIPTALLEPRISVSPASLAFGPAPIGIPPSPTRTLTITNLGSAPLSAAIASNNAAFTVNPAACNNLPPAGFCEITVTFVPALPVGVKSATLTITSNDPVTPLVSVGATGTAANPFFITASVDPASPVGSGTISPAGVQAVAAGGGATYTITAASGYAIVDVIVNGVSRGPIGSYTFVNVQQDQSIIALFAASVTISASSGPGGIISPTGTVSLPLGGSQKFTITPNPGYAIAGVNVIEMVEQLDVNGNGTGIFNPVPRALGPVSSFTFFSVRANGSSISATFVPRELHEWSWQNPKPQGQAISRIATDGNGTYVAVGEFGTILTSTDSVNWTVRTFGSVNLNSVAYGGNHTFVAVGSYGRILLSTDDGATWTVQSSGVTASLRGVAHSGTVFAAVGVTENNPNFPYEPRTAILTSPDGVTWTSRFLDQPFNGTLNLFDVAYGGGRFVAVGMEGHVVISEDNGGSWTALPSDPVTRPTNLNGVAFGAGTFVAAGDFGQIVTSTDGSNWVNRPLMSVAELKGVGFGTISDPLFAGNLLQVFTVVGTDGEILTSEDAGTTWTFRTSGLAAGGAGPMLQAAMVGLNRGVTPFVPTVIVAGSEGNLLASSDTIDWTNLFTTITRYPLRSIAWGNGTFVAVGDGDPGTTLHPPISAPTVLTSTNTGLTWTRRYLSPGHNIRGIAYGNGVFVAVGASGYDLDQNASRQAIILTSTNGITWTPRNSGTFLNLNAVTFANGRFVAVSDYNATGDVADEGALILVSTNGITWNTIRKITSTAGNLRSVIAGTNGTTPALVAVGDFGTVLRSIDNGQNWTEVTSGTINFAELNGIAFNNTSNTYAAIGITSEVFTSTDNGATWSMRSLPVDDTLLVRMEGITYAYGSFVAVGNDNHILTSPDGASWTINIGAEYINSSLYGVAAGNGSYIAVGSDGTILQSNRLLDNPPIIGVDPTSLTFDITPEGTLSAGQVITISNLGINDLTIGALGFDGSDAGEFTVSEDFCSQAVIPATGSCTVVVTFAPTGAGVKSAELKIPSNDPDSNDIEVPVSGTAIPRYLLTVTNAGNGTGSIASSPAGISITNSAAGANSSALFVVDTAVTLTATPAVGSIFEGWSGAGAGACSGTTTPCTLTMSQARNVTATFTRKFIITATAGANGSISPAGQVLVNPGANQAFTITPAPGYSVFGVLVNGLSVGAVTSHTFTAVNADQTISATFTGVPPVRLTLQSGNNVFSTIGQAVAATPVNTAATIDAQAVQTADNGLTLNRGITLTFRGGYGAGFSGIVGMTTVTGPVTVTNGSLTVSDMVIK

SEQ ID NO: 44582 - protein, 151 aa, Zea mays
  misc_feature (135)..(135): Xaa can be any naturally occurring amino acid
KSLMEKAKAKGVSLLLPADVVIADKFAPDANSKIVPATAILDGWMGLDIGPDSIKTFSEALDTTKAIIWNGPMGVFEFDKFAAGTEAVAKQLAELIGKGVTPIIGGGDSVAAVEKVGLADKMSHISTGGGASLEXINKGKPLPGVLAFDEA

SEQ ID NO: 44583 - protein, 277 aa, Vibrio angustum S14
MAYSHLLPDVVEIARASGQLILDIYQRGQFEKQIKDDNTPVTSADLAAHKLVMERLTQLTPDIPVLSEEDASVPLTERSQWKRYWLVDPLDGTQEFIAGSGDFATIIALVEDNRPIMGVVYAPVSGVSYYAYAGKGAYKITAEGESVKIATHHHEENTKSVVVAISRRQDISSITSRLDPSYNYELVPLGSAALKSCLVAEGAVDCYLRLGPTGEWDTAATQCIVEEAGGRILNTHLTPLSYNERNTLENPNFITLGDEGLPWADILEPDDRMMNAD

SEQ ID NO: 44584 - protein, 471 aa, Vibrio angustum S14
MTDTQCSNNSHFDVIIIGSGPGGEGAAMGLTKAGFNVAIIEREDSVGGGCTHWGTIPSKALRHAVSRIIEFNQNPLYCKNNSTLHSTFSQILGHAEVVVNKQTRMRQGFYDRNQCQIIHGEARFIASHDVEVKSTDSSVERYSADKFIIATGSRPYHPDGVDFDHSRVYDSDSILRLEHDPRHIIIYGAGVIGCEYASIFRGLGVKVDLINTRQRLLEFLDNEISDSLSYHLWNNGVMIRNDEIFEEIEGTDDGVILHLQSGKKMRADCILYANGRTGNTDKLALEHVGLTPDSRGQLNVNRSYQTEVDHVYAVGDVIGYPSLASAAYDQGRFAAQAISKGKAQGQLIDHIPTGIYTIPEISSVGKTEQQLTAEKVPYEVGRSQFKHLARAQIAGTEVGSLKILFHRETKEILGIHCFGERAAEIIHIGQAIMEQKGEGNSIDYFVNTTFNYPTMAEAYRVAALNGLNRLF

SEQ ID NO: 44585 - protein, 451 aa, Gibberella zeae PH-1
MSHLPHEPEFEQAYGELASALENSSLFNEHPEYRTALAVAAIPERVIQFRIVWEDDKGNLQVNRGYRVQFNSALGPYKGGLRFHPSVNLSILKFLGFEQIFKNALTGLSMGGGKGGADFDPKGKSDAEIRRFCQSFMTELSKHIGAETDVPAGDIGVGGREIGYLFGAYRKLRNRWEGVLTGKGLSWGGSLIRPEATGYGLVYYVDYMLKHANRGSFEGKRVALSGSGNVAQYAALKIIELGGSVVSLSDSKGALVAKEGSSFTPEQIHNIAALKIKHQSLTAFEHQDKFTWIEGARPWVHVGKVDIALPSATQNEVSKEEAQALLEAGAFIVAEGSNMGCTADAIDVFEAHRKENGAQALWYAPGKASNCGGVAVSGLEMAQNSQRIQWSEKEVDDRLKAIMKDAFVAGLETAQKYVEAKEGELPSLVAGSNIAGFIKVAEAMHNQGDWY

SEQ ID NO: 44586 - protein, 98 aa, Zea mays
  misc_feature (8)..(8): Xaa can be any naturally occurring amino acid
KGVGQLVXLSSKRGPQAWPYFKVGLFGEPGGEPSSVAFFPQTGVDYVSCSPFRVPIARLTSAPVLVLGAAPSLAPPCWGLWWFIILLWPSPFLFLKFL

SEQ ID NO: 44587 - protein, 303 aa, Burkholderia mallei ATCC 23344
MRPAAHCVQALVERAAHDRRIWLLDGDLADSYGADRFAAAYPQRFLMAGIAEQSMVSTAAGMAACGLRPWVFSFAAFLCYRAYDQIRVGLAQTGMPVTLVGSHSGGCGGPNGKSHLALNDIAVMASLPNVDVWAPACDRDTRFVVEAVMLTDRPAYVRYPREPWGELPGEPAECRWIGARRRIALVSCGLFSHVAHDAAEQLRALGVDAGALHLARLAPFPVEAFGALVDGVDGIWVVDDHTRFGGLADLLRANGYAVREPVFSWPANWSGDVGPTAELLRRYGLCAADVAARIAAELERRGR

SEQ ID NO: 44588 - protein, 421 aa, Neptuniibacter caesariensis
MDACGGAAVSCLGHNHPDIKAALKSQVDQLSYAHSAFFTSQAAEQLAEKLTRLAPGNLNHAYFVSGGSEAVESALKLARQYFVEKGELSRKRFVARRQSYHGNTLGALAVGGNEWRKEPFTPLLMEHLYISPCYPYRDQRDGETLYEYGQRVANELEEIILQEGADSIIGFIAEPVVGATSGVLTPVDGYFKRIREICDQYGILLILDEVMCGMGRTGTLFAHEQEGITADIVTVAKGLGAGYQPIGAMLASDEIYNTVSEGSGFFQHGHTYMAHSAATATALEVLNVFERERLIPKAWATGNDLGRKLKEAFSDSPFIGDIRGRGLFWGLEIVQDRTTKAPFPVTSAIHKKIKQAAMGHGLMCYPMGGTIDGKNGHHILLAPPYIISAEQVDELVLKLKKAVNSVLPSEYTAIMPQAGSN

SEQ ID NO: 44589 - protein, 364 aa, delta proteobacterium MLMS-1
MGFRCGIVGLPNVGKSTIFNALTAAGIESANYPFCTIEPNVGMVPVPDHRLDALAAMARTRNKVNAKMEFVDIAGLVSGASRGEGLGNQFLGHIRQVDAIAHVVRCFTDDNIVHVDSGIDPLRDREVINTELILADLETIRKRIQKTANQAKSGDKTSKQQLAILEAMEKHLDQGQPARTLELDDGGRELLREIFLLSAKPVLYVANVLESEINGGNPWVAKLQEAAATEQASVVVISGAIEEELSNLETDERQAFLADMGLTEPGLNRLIRTGYQLLGLVTFFTVGEKETRAWTIAAGSKAPQAAGVIHSDFERGFIRAEVISCDDLLACGSEAKAKEKGLLRLEGKEYVVKDGDCINFRFNV

SEQ ID NO: 44590 - protein, 318 aa, Listeria monocytogenes EGD-e
MSNEYFDPKLKIFSLNSNRELAEEIAKEVGIELGKSSVTHFSDGEIQINIEESIRGCHVYVIQSTSNPVNQNLMELLIMIDALKRASAATINIVMPYYGYARQDRKARSREPITAKLVANLIETAGATRMITLDMHAPQIQGFFDIPIDHLNAVRLLSDYFSERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEESPIEKLVVTNSIALPEEKWIDKMEQLSVAALLGEAIVRVHENASVSSLFE

SEQ ID NO: 44591 - protein, 476 aa, Klebsiella pneumoniae subsp. pneumoniae MGH 78578
MTEHQHQASPAAGGEGASQLKRGLSARHIQMIALGGAIGTGLFMGAGRNIAVAGTSILVIYVLVGFFTYMVMRAMGELLLTRHDYRSFADFVGEYLGPQASFYLGWTYWLSWVVTCIADVVVCGSYMQYWFPELSAWMPALSMLAILFLLNLLSVKMFGEAEFWFALIKVITIIALIGTGGWMIATGWTSPDGVTASLSHLTDPTAFMPHGITGFFAGFQIAIFSFTGIELLGTMTAETRDPQRILPKAINALPLRIIIFYLLSMVVIIAVASWPGVSAETSPFVTLFAKAGLPAAAAVINFVALTSAMSSANSGVFSSTRMLYGLSVEKHAHWQFRILSRSTRIPVRSLLFSCFCMLIGTLLLFLVPNVMTLFTIVSTLAAIMVVFSWGMILVAYLVYRRQRPDLHAGSIFKMPAGVVMSWVSLLFFAFAIFIMIFDPDTLLALLASPLWFIALWGFWKLKQRREGQLQLDNQSA

SEQ ID NO: 44592 - protein, 410 aa, Pseudomonas syringae pv. tomato str. DC3000
MLRKMMLFVGPGLLVSIGYMDPGNWATAIEAGSRFGYSLLFVVVLASLSGMVLQNLCSRLGIATGRDLAQLSAARYSRNVAKGQWLLAELSIIATDLAEVLGAALAFHLLLGVSITTGVALTAFDTLIVLALQGANFRRLEAIVLGLIVTIASCFAVELILIKPFWPDVVAGLRPSWDVLSSQEPLYIAIGILGATVMPHNLYLHSSVVQTRVNGMDVASKASAIRYARLDTIGSLSLALLINAAILILAAAAFHKTGHTDVVEIQDAYHLLDPLVGGAIASVLFGVALLAAGQSSTFSGTIAGQVVLEGFLQAKIPCWQRRFITRALALIPALIGVIWLGDSSVGKMLVLSQVVLSLQLPFALWPLIRFTSDPQLMGPFVNSRLVKTAAWCLFGLISAANLTLLWFWVS

SEQ ID NO: 44593 - protein, 450 aa, Bacillus anthracis str. Ames
MMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 44594 - protein, 471 aa, Klebsiella pneumoniae subsp. pneumoniae MGH 78578
MYIDGQFVSGRGDGWIDVLNPATEALLSRIPDGTAEEAGLAIDAAERAQPGWEALPAIERAGWLRKIAAGIRQRADEIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQVGLPKGVFNLVLGRGETVGQELAGNPKVAMVSMTGSVAAGEKIMAAAAKNITKVCLELGGKAPAIVMDDADLELAVKAVVDSRVINTGQVCNCVERVYVQQGIYDRFVNRLGEAMKAVQFGDPATRDDIAMGPLINAAARDQVAGKVAKAVAQGARVALGGQPLEGKGYFYPPTLLLDVRQGMDIIHEETFGPVLPVVAFSTLDEALAMANDSDYGLTSSIYTRDLNVAMKAIKGLKFGETYINRENFEAMQGFHAGWRKSGIGGADGRHGLNEYLQTQVVYLQA

SEQ ID NO: 44595 - protein, 332 aa, Klebsiella pneumoniae subsp. pneumoniae MGH 78578
MSKLGINGFGRIGRLVLRRLLEVDSSLEVVAINDLTSPKVLAYLLKHDSNYGPFPWSVDFTEDALIVNGKTITVYAEKEAQHIPWQAAGAEVIVECTGFYTSAEKSQAHLQAGARKVLISAPAGEMKTIVYNVNDDTLTPDDTIISVASCTTNCLAPMAKVLQDAFGITVGTMTTIHAYTGTQSLVDGPRGKDLRASRAAAENVIPHTTGAAKAIGLVIPALSGKLKGHAQRVPTKTGSVTELVSVLEKKVTADEVNQAMRQAAEGNESFGYTEEEIVSSDIIGSHFGSIYDATQLEIVEAGGVQLVKTVAWYDNEYGFVTQLIRVLEKFAR

SEQ ID NO: 44596 - protein, 387 aa, Bacillus anthracis str. Ames
MEFEFFFQIALILLSTKLAGDLSVRLGQPSVLGKLIVGIVIGPAVLGWIENSELLTQLSNVGVILLMFMAGLETDLEELNANRNSSLAVALGGIILPFVGGYVSGLVMGMEQGNAVFLGLLLCATSVSISVQTLRDLGKMKTRESTTMLGAAVFDDILVVILLAFAMSFLGTDDVNLTMVILKKVVFFASIILIGWKGVPAIMRWLSPLRVSESIVSAALIICFSFAYFGELLGIAGIIGAFAAGIAISQTNYKHEVEKKVEPIAYAMFVPVFFVSIGMNITFDGIGDQIGFILALTVIAVLTKLIGCGVGARMTGFDAKSSAIIGSGMVSRGEVALIIAGTGLSSGLLAQDYFTAIVIVVILTTMITPPMLKYTFGAKDKAMKASK

SEQ ID NO: 44597 - protein, 320 aa, Ustilago maydis 521
MKFLQVASAVTAAALSASSIVATPLNVDALNYPAGVQRSIQARDTERLAERGSTAAPSPLSNYQQYTFPAQLAQAAYCGQPVGAKVGDATLLWTAGDGRSTPMVFVAYSPSQGVIVSHQGTNTSSFSSILNDADFGQDPINSRLSYLGNVEVHGGFQDTWLRTADSVLAQVKSALASHPGSRVLTVGHSLGAAISLLDALYLKKQLPSNSVRSIVFGQPRTGDQAFANAVDANLPGFVHINNGHDPVPRLPPALDYKHSQGEIWINPSNSNTAVTCPGQENQNCIDSVSPFHYELDDHTGTYFNVHIAGRGENCPAVINS

SEQ ID NO: 44598 - protein, 444 aa, Bacillus pumilus SAFR-032
MLKKIAVIGTGYVGLVSGTCFADIGNRVICCDIDESKINSLKSGVVPIYEPGLKELIEKNTEEGRLFFTTNIPAAIRESDIIYIAVGTPMTAQGEADLTYVKAVAQTIGEHLNGYKIIVNKSTVPVGTGRLVQAIVEKASRSKYPFDVVSNPEFLREGSAIKDTMNMERVVIGSTSSHASEIIKTLHEPFQTVVVETNLESAEMIKYAANAMLATKISFINDIANICDRVGADVEKVSEGVGLDSRIGQKFLKAGVGFGGSCFPKDTKALLKIAETVGYRFKLIESVVETNTHQRAYLVKKLMDVYGDIKGKTISVLGLAFKPNTNDLRSSPALDIIPMLQDLGAYVKAYDPIAHLEAKKILGNQTIFSDNLYQTIEHSDACFILTEWEEVLKMDMEKVRRLLQRPVIIDGRNIFEPEQMRKNGFIYHSIGRPHVQDVKMLLEA

SEQ ID NO: 44599 - protein, 330 aa, Oryza sativa Japonica Group
MAQPQRPLQVPDITKSTHSGGNTVLAYASSAMQGYRSTMEDAHATIENLDALTNTSFFGVYDGHGGSAVARMDEMLRNQAASKELTEYGSGNEYWRTAGRSWLRCAPCVLGPVYCGPLAEGCTACVVLIRNTQIVVGNAGDARCVISRNGQAIALSNDHKPNFPEETQRIVAAGGSVSFSRGSHRVNNGIAVSRAIGIAYMFVGGDLSYKNNKKLRPEQQLLTCSPEIRADQLTDDTEFLVIACDGVWDVLANQAVVDFVRLHLNNGVELSVICESLLQEAITRDPPSTDNMSVILVRFLHPEGNRGARAATSSTSTGTVPSRHSKSISL

SEQ ID NO: 44600 - protein, 247 aa, Brassica napus
  misc_feature (220)..(220): Xaa can be any naturally occurring amino acid
  misc_feature (230)..(230): Xaa can be any naturally occurring amino acid
MEKLSYNSYPDSTDSSPRSREIDFDNPPPWDDHNHQSYKVRFMCSYGGKIQPRPHDNQLTYVNGETKILSVDRGIRFPVLASKLSAVCGGDGDVLFKYQLPGEDLDALISVTNDDDLEHMMHEYDRLLRVSSKPARMRLFLFPVSSGGFGSEGSSHSHSDRDRFVEALNTVRNRSEPEKTVTGPVNSADFLFGTEKVAAPPPQPPPPEVKLPVPVVLEPXVHGVTPAEMXNQMLEFQRMQVRDQEQL

SEQ ID NO: 44601 - protein, 368 aa, Zea mays
MAASAAAQRRSAGSRTTYERAELEALRDAPSKEAHARLWADVRATLVASGFSGEYDGLLVAEEDVRSRRGNRGMKAMSVRKWPEEAAAAARFLGVAEIGAHRNGDLAVCHEHRFVSAHDHAGTSGVVEESFHQGEDVECEDDSDDDYNGILKPAFAVDGDPDFESGEPLDGFEYLRRVRWEANQIPRVKVAKIYSSAARNEQTPYMPEIPDIPKCLPDLRASKQWEDRFIVDFEETRMVLSELDNSDEPSVSSGTKISTKPGSGTEPQTDPTLTMIRSMDAVSRAATLRNYIDMIQSLDALSRNNCMWLFALCVAVHTPLDAETCASLRSLLRKCASILATKTEMDDEVVMLNILMTISGRYFGQDES

SEQ ID NO: 44602 - protein, 316 aa, Thermoplasma volcanium GSS1
MEELLNSETKPPGRTPTIKAYALGKELRLNNLFLKFEGANATGTQKDRISEAHVLNAIRDGYNGIAVGTCGNYGASIAYYANLYGIKSYIGMPSAYTHDREDFMLSSNAEILYYNGKYEETVSFIHDYATDNSLYDASPGSDHSYIDTKMYAGIAFEIYEAILKVPDYVIVPVGNGTTLSGIYEGFHLMYLNGTIDRMPRMVGVSTRGGNPIVSSWKRGYKKVVDLDPARIRETAVNEPLVSYRSFDGDKALAAIRETHGKALYVSDDEMVRFSELMYREEGLNPLPASASAVAALVHLHLNPDDYVVSVITGRRM

SEQ ID NO: 44603 - protein, 379 aa, Oryza sativa
PRTVVLLVQSGRAVDATIDALVPYLDAGDAIVDGGNEWYQNTERRIEEAAARGILYLGMGVSGGEEGARNGPSLMPGGHIDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGNDERVAAAGVLEAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGLNSVL

SEQ ID NO: 44604 - protein, 445 aa, Geobacter sulfurreducens PCA
MMLQRSSGQHQTNDNGSDSRHGFVSSTDLNRIRDLECRLADLLGENERLRAVEQELRTAATAAEAATTAKSELLAHVSHEIRSQLQLISGAVDLFRQTRLDEIQRHYLEGFQHANELLLCLVNDILDTSRLEAGHLRLESLPFDLAGLVAATGTQLLWQAQRKGLELSWQVSPDVPSRLLGDQARVQQVIVNLAGNAIKFTREGAVTIRVERVPDPLTASSLAMIRFVIEDTGIGIPVDRLGGIFERYDRGSPETSKLFGGTGLGLAIAKGLIEAMDGDITVESYEGRGSRFIVTIPFCLTITGDRQAPADGQEKESESVAPLRVLVAEDAEDIRLLIAAFLRGASHQVCSAGNGQEALDMFMAEDFDLVLMDIQMPVMDGYTATRALREWERQRGRTPVPVVALTACAEKSDSLKTIEAGCTSHLSKPIRKDTLLRTVAELARQ

SEQ ID NO: 44605 - protein, 292 aa, Sporosarcina psychrophila
MQHLVSMKHLTEEEIMAILDRADTFKKRGVRELPGKYSVSNLFFEPSTRTKMSFEMAQRKLGLDVLPFESSFSSTLKGETLYDTVKTLEAIGVDALVIRHPEDGYYEQLIGRTSVSIINGGDGSGQHPTQSLLDLFTIKEEFGSFQGLNVLITGDITHSRVARSNADALTKLGANVTFLCPAEWAGEFNSVDSWDEVIKNSDVVMLLRVQHERHEAEINFAGESYHERYGLTEAREQLMKENAIIMHPGPFNRGVEIADTLIECPKSRIFKQMENGVYIRMAVLEAVLKGRN

SEQ ID NO: 44606 - protein, 261 aa, Thermoplasma volcanium GSS1
MEEFTDKVAIVTGGSSGIGLAVVDALVRYGAKVVSVSLDEKSDVNVSDHFKIDVTNEEEVKEAVEKTTKKYGRIDILVNNAGIEQYSPLHLTPTEIWRRIIDVNVNGSYLMAKYTIPVMLAIGHGSIINIASVQSYAATKNAAAYVTSKHALLGLTRSVAIDYAPKIRCNAVCPGTIMTPMVIKAAKMEVGEDENAVERKIEEWGRQHPMGRIGRPEEVAEVVAFLASDRSSFITGACLTVDGGLLSKLPISTPNADNSHH

SEQ ID NO: 44607 - protein, 202 aa, Brassica napus
  misc_feature (6)..(6): Xaa can be any naturally occurring amino acid
  misc_feature (14)..(14): Xaa can be any naturally occurring amino acid
  misc_feature (17)..(17): Xaa can be any naturally occurring amino acid
  misc_feature (36)..(37): Xaa can be any naturally occurring amino acid
  misc_feature (93)..(93): Xaa can be any naturally occurring amino acid
  misc_feature (95)..(95): Xaa can be any naturally occurring amino acid
  misc_feature (97)..(97): Xaa can be any naturally occurring amino acid
  misc_feature (155)..(155): Xaa can be any naturally occurring amino acid
LNKNRXPHMSKEQXEEXLKRYLGVQTIIWLPRGLYXXDDTNGHIDNMCCFAKPGVVLLSWTDDETDPQYERSVEALSVFSNSVDARGRKIQVXKXHXPGPLYMTEEESSGIIQEGEAKPRLAGTRLAASYVNFYLANGGVIVPQFGDAKRDEEAXRALSETYPHHSVVGIENAREIVLAGGNIHCITQQQPAEPISVAVNGD

SEQ ID NO: 44608 - protein, 586 aa, Vibrio parahaemolyticus RIMD 2210633
MQWTFNRLVSTGLFLSASITHTAFANQATDAIAPEQSTGLEHKQLVKAKDYMVTAANPMATQAGADVLEQGGNAIDAMVAVQLMLGLVEPQSSGIGGGAFLVYWDGEQQKLTTYDGRETAPLAATPTLFLDDQGQPLQFYDAVVGGRSVATPGTVKLLWDTHQKYGKLEWKKIIQPVINLAEEGFAVSPRLASLIANDAERLSRFPTTKAYFFNADGSPKSEGTRLKNPEYAQTLKAIARQGAQAFYQGDIAKDIIATVQTAVGNPGVLAQRDFDTYRIKQREPVCAAYQSYDICGMGPPSSGALTVGQILAITEQYDLKGWGPDSTKSWQVIADASGLAFADRGKYMADQDYVPMPTEGLLDKDYLKQRAELIQVGKALTKVEAGNPPWSHAMNLSMDESIELPSTSHFNIVDKQGNVVSMTTTIENAFGSRLMVRGFLLNNELTDFSFRTHQNGVPIANRLEPGKRPRSSMAPTIIMKDNQPYMAIGSPGGSRIIGYVAQAIIAHTQWDMDIQQAINQPRVLNRFGTVDLEQDSAATQLQPALEKMGFKTEIRDLNSGLHAIRITVNGLEGAADPRREGAAIGK

SEQ ID NO: 44609 - protein, 480 aa, Arabidopsis thaliana
MVKICCIGAGYVGGPTMAVIALKCPDVEVAVVDISVPRINAWNSDTLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIKDLFNPDRVLIGGRETPEGFKAVQTLKDVYAHWVPEGQIITTNLWSAELSKLAANAFLAQRISSVNAMSALCEATGADVTQVSYAVGTDSRIGPKFLNSSVGFGGSCFQKDILNLVYICECNGLPEVAEYWKQVIKINDYQKSRFVNRVVSSMFNSVSNKKIAVLGFAFKKDTGDTRETPAIDVCKGLLEDKARLSIYDPQVTEDQIQRDLSMNKFDWDHPLHLQPMSPTTVKQVTVTWDAYEATKDAHGICIMTEWDEFKNLDFQKIFDNMQKPAFVFDGRNIMNLQKLREIGFIVYSIGKPLDDWLKDMPAVA

SEQ ID NO: 44610 - protein, 516 aa, Glycine max
LVLLSLLSIVISIVLFITHTHKRNNTPRGPPGPPPLPLIGNLHQLHNSSPHLCLWQLAKLHGPLMSFRLGAVQTVVVSSARIAEQILKTHDLNFASRPLFVGPRKLSYDGLDMGFAPYGPYWREMKKLCIVHLFSAQRVRSFRPIRENEVAKMVRKLSEHEASGTVVNLTETLMSFTNSLICRIALGKSYGCEYEEVVVDEVLGNRRSRLQVLLNEAQALLSEFFFSDYFPPIGKWVDRVTGILSRLDKTFKELDACYERFIYDHMDSAKSGKKDNDNKEVKDIIDILLQLLDDRSFTFDLTLDHIKAVLMNIFIAGTDPSSATIVWAMNALLKNPNVMSKVQGEVRNLFGDKDFINEDDVESLPYLKAVVKETLRLFPPSPLLLPRVTMETCNIEGYEIQAKTIVHVNAWAIARDPENWEEPEKFFPERFLESSMELKGNDEFKVIPFGSGRRMCPAKHMGIMNVELSLANLIHTFDWEVAKGFDKEEMLDTQMKPGITMHKKSDLYLVAKKPTT

SEQ ID NO: 44611 - protein, 494 aa, Neptuniibacter caesariensis
MKSYSEWQALSETLSFQGQAYINGEFQSAASGETFPCINPSTEKVLTDIASCDEADVNAAVANSREVFKSGVWSEMHPRQRKQIMLKWADLIEQHKDEFALLDTLDMGKSINEMVNIDVPDAIDCFRWTAECIDKVYGEIAPTGTDTLALISHNPVGVVGAITPWNYPLLMVSWKIAPAIAAGNSVVLKPSEKASLSALRLAELAVEAGIPKGVLNVLPGYGHTAGKALALHMDVNVLAFTGSTRVAGMLMGYAGQSNMKRVWLEAGGKSPNLVFADCDIKKAAAGTANAIFANQGEVCIACSRLYVEKSIKEEFMAALMEEAKRFQTGDPLDPATTMGPMVDGMQLETVERYIRSAVEEGGNIVTGGLPEYTDGQGFFARPTIIDNANNDMTFVKEEIFGPVLAVCDFETEDEAIELANDSQYGLGAAVWTENLSRAHRVSGKIESGMVWVNTWGEGDTTVPFGGVKASGNGRDKSLHALEKYTDIKNVLIRL

SEQ ID NO: 44612 - protein, 363 aa, Neptuniibacter caesariensis
MGFKCGIVGLPNVGKSTLFNALTKNGIAAENFPFCTIEPNAGTVAMPDPRLDNLAAIVSPERVVPTAMEFVDIAGLVAGASKGEGLGNKFLANIRETDAIAHVVRCFEDDNVIHVANKIDPLSDIETINLELALADLDSAEKQLQRIQKLAKGGDKEAVAQKAMLERLIPYLEEGKPVRGMGLNDDEMKIVKGFHLLTVKPTMYIANVDEDGFEDNPHLDQVKELAASENAGVVVVCNKLEAEISELDDEERDEFLADLGMEEPGLDRVIRAGYELLGLQTYFTAGVQEVRAWTVKVGATAPQAAGVIHTDFEKGFIRAEVVSYDDFVEHNGENGAKDAGRWRLEGKDYIVQDGDVVHFRFNV

SEQ ID NO: 44613 - protein, 102 aa, Chlamydia trachomatis D/UW-3/CX
MVQVVSQENFADSIASGLVLIDFFAEWCGPCKMLTPVLEALAAELPHVTILKVDIDSSPRPAEQYSVSSIPTLILFKDGKEVERSVGLKDKDSLIKLISKHQ

SEQ ID NO: 44614 - protein, 413 aa, Bradyrhizobium sp. ORS278
MKSSDNLTTERPTFVTHLECAMVGDHYPADQVHNLSKAGKPLLVRYDLAGVKQALTKDALAQRPADMWRYRELLPVRKCQDIVSLGEVMTPLINLPKLAKTLGGGEIIVKDEGRLPTGSFKARGLVMAVSMGKALGITHMAMPTNGNAGAALAAYATSCGIKTTIFCPADTPEVNVSEIELQGATVYRVNGLIDDCGKIVGEGKAKVGWFDTSTLKEPYRIEGKKTMGLELAEQLGWDVPDVIFYPTGGGTGLIGMWKGFDELEKIGFIGSKRPRMVAVQASGCAPMVRAYEAGVEHATRWEDAHTIASGIRVPQAVGDFLILRAVRESGGFAIAVDDDAISAGLNEVAREEGLLLCPEGAATYAAYKQSLADGRVTKTDRVMLFNCATGLKYPLPKVERTLDRHQPIDYTQF

SEQ ID NO: 44615 - protein, 473 aa, Bradyrhizobium sp. ORS278
MADTSFDVIIIGSGPGGYVTAIRAAQLGFKTAIIEKTHLGGICLNWGCIPTKALLRSAEIYHYMQHAKDYGLSAEKISYDPKAVVQRSRGVSKRLADGVGFLMKKNKVQVIWGRANIDAPGKISVTKADVEAPKGALGEGSYQAKHIIVATGARPRVLPGLEPDKKLVWTYFEAMVPDRMPKSLLVVGSGAIGIEFASFFRTMGSEVTVVEVLPQILPVEDAEIAGIARKQLEKQGLKIMTGAKVTKLDKKSDSVVATIDDGKGKIETTEFDRVISAVGVVGNIENLGLEKLGVKTDRGCIVIDGYGKTNVPGLYAIGDVAGPPMLAHKAEHEGVVCIEAIKGLHPHPMDKSLIPGCTYCHPQVASVGLTEAKAKEQGRDIRVGRFPFVGNGKAIALGEDQGLVKVIFDKKTGQLIGAHMVGAEVTELIQGYVVAMNLETTEEELMHTIFPHPTLSEMMKEAVLDAYGRVLNM

SEQ ID NO: 44616 - protein, 328 aa, Vitis vinifera
MAGLIAWAADVVGGGGQSNDEDDANSIPIVFSPDQLNYVRELDGKAASLRRTIQDLRLRIPPSDISQRLPHLHAHSLASNADLALQLNSHSATRQQAQLRAETLQEENAAYDKAILNCENKIQEKLQEAEFLKMKLKEMDENENNLRIELESAQPTLNTSQSRKSGDVVTTIEAQADTDASKSSILDKLESKRKELSSMEETVQDLEKKWSKVQDNALKQPSPVQREKILDKQLHSLIEQLAAKQAQAEGLVSEIHLKEQELERLNGLWRRFQTSNTDVNTARNRFGRNKPHNIGGRTEIQKRLMLLRSAFVLYILALHILVFIKISF

SEQ ID NO: 44617 - protein, 55 aa, Arabidopsis thaliana
MRLFDPWPVFFKREWKRCWPFLTGFAVTGVLITKLTAGLTEEDAKNSKFVQQHRR

SEQ ID NO: 44618 - protein, 293 aa, Bacillus pumilus SAFR-032
MKKVRKAIIPAAGLGTRFLPATKAMPKEMLPIVDKPTIQYIIEEAVESGIEDIIIVTGKGKRAIEDHFDFAPELERNLEEKGKKELLEKVRKSSNIADIHYIRQKEPKGLGHAVWCARNFIGDEPFAVLLGDDIVQAETPGLRQLMDEYEKTLSSVIGVQQVADHDTHRYGIIDPLTQEGRRYQVKNFVEKPPQGTAPSNLAILGRYIFTPEIFMYLEQQEIGAGGEIQLTDAIQKLNDIQRVFAYDFEGKRYDVGEKQGFIETTLEFALQDEDLKKKLIPFMKQLLEKEEVN

SEQ ID NO: 44619 - protein, 383 aa, Abies grandis
MAYSCMAASCHGLHFMNIASQECNLKRGIIPSKRLHGISSSLWASNGFQGHLERDLSAYRHLVSSSRCLNTIAMLSNLSEQAKEKATEFDFKEYLHSKAISVNEALERAVPLRYPEKIHEAMRYSLLAGGKRIRPILTIAACELVGGSEELAMPTACAMEMIHTMSLIHDDLPSMDNDDLRRGKLTNHKVFGEGTAVLAGDALLSFAFEHIAVSTRKTVASHRVLRVVSELGKAIGSQGVAGGQVADITSEGDPSVGLETLEWIHIHKTAVLLECAVVSGAIIGGASENEIERTGRYARCVGLLFQVVDDILDVTRSSEELGKTAGKDLVSDKATYPKLMGLEKAKEFADELLDRAKEELSCFNPAKAAPLLGLADYIALRQN

SEQ ID NO: 44620 - protein, 176 aa, Triticum aestivum
  misc_feature (155)..(155): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRXQVQCVSFIAFKPPGCEESGKA

SEQ ID NO: 44621 - protein, 381 aa, Abies grandis
MAYSAMATMGYNGMAASCHTLHPTSPLKPFHGASTSLEAFNGEHMGLLRGYSKRKLSSYKNPASRSSNATVAQLLNPPQKGKKAVEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 44622 - protein, 374 aa, Geobacter sulfurreducens PCA
MKAVLALADGRVFEGKSFGATGEAVGEVVFNTAMTGYQEVLTDPSYRGQMVTMTYTQIGNTGINPEDIESKQLYLSGFIVKEYHDCYSNWRATMSLDAYLKENGVVGIQGLDTRALTRHLRDKGAQNGVISTVDSDHESLVKKARAVPSMAGLDLATGVSCDKPYHWTEKLWDLEAGYTAATPDELKYKVVAYDFGIKYNILRCLVSAGCDVTVVPATFPADEALAMNPDGIFLSNGPGDPEPMTAVIENIRKFVGKKPIFGICLGHQLLGLALGGQTMKLKFGNHGSNLPVMDLDTRRVEITAQNHGFSVDIVSLGHACELAHENLNDQTVEGMKHKDLPIFSVQHHPEASPGPHDSHYLFGRFVELMEKEKA

SEQ ID NO: 44623 - protein, 216 aa, Pseudoalteromonas tunicata D2
MKTLLKVFLPLTLTLTLSGCFGPDQAIKETNQFISSQQVDKENKDWKTTLKQPPLLTFTEGKKYFWDLATNQGEISIELFHTSAPMHVSSTIYLTELGFYDGLIFHRIIPEFMAQGGDPLGSGRGNPGYKYAGEFDAKLSHDKPGILSMANAGPNTDGSQFFITFKPTPFLDGRHTIFGQVVKGLDETLAKLETLGSRSGKTSTEVVINKATIRIE

SEQ ID NO: 44624 - protein, 509 aa, Sesamum indicum
MALPLLILSFLTIFIAYKLFQRLRYKLPPGPRPLPVVGNLYDIKPLLVRCFTEWSQVYGPIFSVYLGSHLSVVVNSAELAKEVLKDNDQQLANRNRTRQIAKFSKNGADLIWSDYGPHYVKVRKLCTLELFSMKRLEGLRPIREDEVTAMVESIFKDCNKPENKGKALVLREYLGMMAFLHIARLTFGKRFMDSNGVVDGQGEELKAILHNGIKLGTKKSWAEFLPWFRFLFKTENQLLAEHDALADSFTKKIMQEHTLARQKTGNTKNHFVDALLTLQKEYDLSDDTVIGLLWDMISAGMVTTTITVEWAMAELVRNPRVQQKVQEELDRVVGSDRVMTEADIPNLPYLQCVTKECFRMHPPTPLMLPHKASTNVKIGGYDIPKGATVSVNVWALARDPAVWKNPLEFRPERFQEEDIDMKGTDYRLLPFGSGRRICPGAQLAIYLVTSMLGHMLHHFTWTPPAGTKPEDMDMMEQPGTVTYMRTPLQAVPTPRLPADLFKRVASGNV

SEQ ID NO: 44625 - protein, 460 aa, Desulfovibrio desulfuricans G20
MTHEQYDLVIIGAGPGGSRAALDAAAAGMRTALVEKADAGGTCLNWGCIPTKFLLGGTAAVPLLQIQKKYKAAGGDVHLSLAALHQRKDRFIKGTRQNLVKQLTQAGVNFITGAASFAGPRTVVVEKEDGSSLLEFENLILAAGSEPASFPGLIPDGNCVLHSSHILQLETPPQSLIIVGGGAIGLEMGDLFARFGTQITIVEALPHLVPAEDGDIADALTKALKREGWTVHTGRRVRSLVTDEEGALLTFEDGTAIRADKALMAAGRSPATAALHPEKAGIMTDGRGWISTDNFLQAAENIYAVGDVNGRTLLAHAAEHQARYVVSRLRGLTAAEYPAPVMPSCVYGHMEVMRTGATAKELTAQGISVSVSRAPLASNAIAQSCGATQGFVKAVWAAGNGTPELRGIAATGHGVSHLVGLATVMVQQRWRRENIHDIIYAHPTLDEALEAALSAPLENA

SEQ ID NO: 44626 - protein, 350 aa, Physcomitrella patens
MAATPAREWTGLQQFPVATQTALHNILGTLRQQNKESLTVLVVGKGGVGKSSTVNSIVGERVTIVSAFQSETLRPLQCARSRAGFTLNIIDTPGLVEGGCINDQALDIIKRFLLSKTIDVVLYVDRLDGYRVDNLDRQVIRGLARSFGPNFWRLAVIVLTHAQFSPSDGVNYTEFVEKRSAALQAAIRQEAGLKKDEKEVPYALVENSGRCNTNDGGEKILPNGTVWLPALVERIVEVATGTTDSVFVDKKLIDGPNANEWGKWWIPVLAVAQYFLVVMPIRKAIEKDLAEEKNQRPQWEIRAEEFRRNTSLYDDDQVDEQAISQALEQDDGLSGQPSSFVDEDDDDDEF

SEQ ID NO: 44627 - protein, 260 aa, Vibrio parahaemolyticus RIMD 2210633
MLTDQEFIRYQRQVSLPEIGESGQARLGQSHVLLIGCGGLGSAASLYLAAAGVGKLVVIDDDHVDSSNLQRQVIYREGDIELAKTEAMAQQLRHLNSMIQVRTITKRLDQAQLQLEVMLADVVLDCSDNLPTRQLINQVCYEQNTPLISAAAIGWQGQFAVFDYSDKPSNSGCYRCLYPFDELQQTMKCSETGIIGPVVGTLGNYQALAAIQKLAIDRFHVECGQLHLFDGLRMNWQTMSITKDKQCQVCGDNNLAPMSS

SEQ ID NO: 44628 - protein, 220 aa, Oryza sativa Japonica Group
MDAMAVLARTSRPAPTLLAATSPAVSRRPAAVSFAAAASPGSRGRVALSAAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 44629 - protein, 427 aa, Bradyrhizobium sp. ORS278
MTAIVDIIGREILDSRGNPTVEVDVVLEDGSVGRAAVPSGASTGAHEAVELRDGDKRRYLGKGVQKAVEAINDEIYEALSDMSVQDQVQIDQILIELDGTENKSRLGANAILGVSLACAKAAAISYDMPLYRYVGGTSARTLPVPMMNIVNGGVHADNPIDFQEFMIMPVGAPSFAEALRCGSEIFHTLKGELKKAGHNTNVGDEGGFAPNLPSADAALDFVMAAIGKAGYTAGEDVMLALDCAATEFFKDGKYVYEGENKSRSRSEQAKYLADLVARYPICSIEDGMSEDDMDGWKELTDLIGHKCQLVGDDLFVTNVTRLEDGIRNGRANSILIKVNQIGTLTETLAAVEMAYKAGYTAVMSHRSGETEDSTIADLAVATNCGQIKTGSLARSDRTAKYNQLLRIEQELDAQAKYAGRAALKALA

SEQ ID NO: 44630 - protein, 232 aa, Exiguobacterium sibiricum 255-15
MYEQEKKMLAEAAIKQVKNGMILGLGTGSTTRSFIDALGEWVKAGGEVQGVATSNETVEQAKRLNIPLLSLEEATHIDLVIDGIDQIDPRFRVLKGGGGALFREKVVALMSREILYLADASKFVHHLTGPLPVEIDAFARPYVERYLRDKQLDVTLREHDGQPFVTDGGHLILDVDLERVQDVRHFAQELKSLTGVLETGYFERQPDHVLTVEQGKVRQLAHPNLRDGGGLV

SEQ ID NO: 44631 - protein, 308 aa, Listeria monocytogenes EGD-e
MTIANSITDLIGKTPIVKLNRLPEAGSADVYVKLEFQNPGGSVKDRIANAMIESAEKSGALKPGDTIIEPTSGNTGIGLAMVAAAKGYQAIFVMPETMSLERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATIKAALDLAKELGAGKKVLAIVASNGERYLSTPLYNFED

SEQ ID NO: 44632 - protein, 387 aa, Abies grandis
MAYSGMVRSFQGVYFMAVALDRNRNLKRIDIPSKRFDGVSTSFVACNGEHLGLPVNLKKEFLSCIQRASSSRSSNTIVQFANLPEQGKKVVEFDFNKYMLSKAMAVTEALDKAIPHSYPQKIHESMRYSLLAGGKRVRPVLCIAACELVGGREELAMPTACAMEMIHTMSLIHDDLPCMDNDDLRRGKPTNHKVFGQDTALLAGDALHAFAFEHIVAFTSKSVGSDGILRAVTELARATGPQGIMGGQIVDIASERDAFVDLQTLEWIHIHKTAVLFECATVCGAIIGGASGDEIERIRRFARYLGLLFQVVDDILDVTKSSEDLGKTAGKDLVSDKATYPKLMGLEKAKGFSLELLNKAKEELSCFDPMKAAPLFGLADYMALRQN

SEQ ID NO: 44633 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLDHQGRTLDTQFQVFKEITVAQARLDDPAKAPAEIARVLGAARSLSRPVYLEIPRNMVNAEVEPVGDDPAWPVDRDALAACADEVLAAMRSATSPVLMVCVRSAATGLEAKVADVAHGLGVPVVTTFMGRGLLADAPTPPLGTYIGVAGDAEITRLVEESDGLFLLGAILSDTNFAVSQRKIDLRKTIHAFDRAVTLGYHTYADIPLDGLVDALLERLPPSDRTTRGKEPHAYPTGLQADDGPIAPMDIARAVNDRVRAGQEPLLIAADMGDCLFTAMDMIDRGLMAPGYYAGMGFGVPAGIGAQCVSGGKRILTVVGDGAFQMTGWELGNCRRLGIDPIVILFNNASWEIVRTFQPESAFNDLDDWRFAEMAAGMGGDGVRVRTRAELKAALDKAFATRGRFQLIEAMIPRGVLSDTLARFVQGQKRLHAAPRE

SEQ ID NO: 44634 - protein, 544 aa, Xanthobacter autotrophicus Py2
MAMSGRRRELAGWSRLAVALAFGWTTSVYPALAQSPPPPDAGQPAVAAPPPPAVAPTPEPPSPAPPMPAAPMPAPDAGAAAPPPAAGQDAQLRYTLAELETLLAPYALYPDSLLAQLLPATVYPLDLVQAQRWIERNKSAVKKGDFSGADTQKWDPSVKAMVRFPSVVAKLNEDLESTQSIGFAFVTQPEDVSVAIQALRAKAEAVGSLKTNDKQVVTRREEGGRSVVYITSADPTVLYVPEYDYSTIYTAAGVGLLAFGAGVLVGNAWNNSWNWGRGWVYPPVWPGYPGWRPPPPPPPGGWPGGPGGWPGGPGGPGGPGGPGGPGGPGGPGGPGHWGGPGPGGGQPWKPNPGKPLPGKPGGPGGPGKPGGPGGIGGPGGPGKPGGPGGIGGPGGPGKPGGPGGPGFTGGPGGPGKPGGPGGAGGVGKPGGPGGPGGAGKPGSAGQYGGSGKPGGSAKTGSSGKAGGAGTKRGSSGVKKGSSGGGSQMKRSGGGGRPPSVHPQQMRSGGGGHPGRAPQMRSGGGPKGGGAVRPRGGGGGRGGRR

SEQ ID NO: 44635 - protein, 347 aa, Glycine max
MSNFLSNTNPNPNKSFEVNQPPTDSVSSLSFSPKANFLVATSWDNQVRCWEVARNGVNVATVPKASITHDHPVLCSTWKDDGTTVFSGGCDKQVKMWPLLSGGQPMTVAMHDAPIKELAWIPEMNLLVTGSWDKTMKYWDTRQSNPVHTQQLPERCYAMTVRHPLMVVGTADRNLIVYNLQNPQVEFKRIVSPLKYQTRCLAAFPDQQGFLVGSIEGRVGVHHLDDSQHGKNFTFKCHREGNEIYSVNSLNFHPVHHTFATSGSDGAFNFWDKDSKQRLKAMLRCSQPIPCSTFNNDGSIFAYSVCYDWSKGAENSNPAAAKTYIFLHLPQESEVKGKPRIGATGRK

SEQ ID NO: 44636 - protein, 409 aa, Adonis aestivalis var. palaestina
MASVSMAPPSGLRDPTGNAGGADRLPEEMNDMKIRDDKEMEATVVDGNGTETGHIIVTTIGGRNGQPKQTISYMAERVVGHGSFGIVFQAKCLETGETVAIKKVLQDKRYKNRELQTMRLLDHPNVVSLKHCFFSTTEKDELYLNLVLEYVPETAHRVIKHYNKMNQRMPLIYVKLYTYQICRALAYIHGTIGVCHRDIKPQNLLVNPHTHQLKLCDFGSAKVLVKGEPNISYICSRYYRAPELIFGATEYTTAIDIWSAGCVLAELLLGQPLFPGESGVDQLVEIIKVLGTPTREEIKCMNPNYTEFKFPQIKAHPWHKIFHKRMPPEAVDLVSRLLQYSPNLRSTALDALIHPFFDELRDPTTRLPNGRFLPPLFNFKPHELKGVPVEILGKLIPEHARKQCAFLGL

SEQ ID NO: 44637 - protein, 700 aa, Pseudoalteromonas tunicata D2
MTDSVFSLELHDNAIGVVTIDVPGEKMNTLRASFVDELNAILQQALSERVKGLVFISGKKDNFIAGADIKMLDDAKTRDDALYLSKTCHSVFAEMAKMPFTTVAALHGATLGGGLEFALACDYRVCSDADITKLGLPEVQLGLLPGGGGTQRLPKLVGIQKALEWTLTGKQVRAKQALKAGLVNQCVPHSILLATAISQATKGKAKAAKPKLDKISQLLEGNPFGRNIIFKKAAENVTKKTGGHYPAPYAIIKAIRASVEMDTAGAYQVEADGFADLCMSSQSKALRGIFFATTEMKKEWQTPEKTPVTHVAVLGGGLMGAGIAHVSACKANARVRIKDVAAEGITKAMNYSYKILSKKQQRRILTQAQLQLQMNRITGGTDYVGFKHTQIAIEAVFEDLTLKQAMVADIEANTNEHTIFASNTSSLPIHQIAANASRPENVIGLHYFSPVEKMPLVEVIPHAGTSEAVIAKVVSFARKQGKTPIVVKDKAGFYVNRILAPYINEAANLLLAGEPIEKIDQALVEFGFPVGPLTLLDEVGIDIGSKIAPILEVELGERFKAPDAFSRLISAKRLGRKTGQGFYLYGKKDKKVDESIYELLGVQVSPKLNLEEIAERCVSQMLNEAARCLDEGIVASARDGDIGAIFGIGFPPFLGGPFSYIDKLGASHLASRLATFAEQNPAFTPAEALVTMAENKTCYR

SEQ ID NO: 44638 - protein, 366 aa, Desulfovibrio desulfuricans G20
MALSIGIVGLPNVGKSTLFNALTKAQNAESANYPFCTIEPNKATVPVPDARIDKLTAMARPQKTINATVDFIDIAGLVRGASKGEGLGNQFLANIRESAAILQVVRCFDDENITHVDGTVDPLRDIETIETELLLADVQSAERKLDRTRRQSKGDKSMTATVSAMERLVDHLNAGNPASTFAEKDSDAISALYKELGLLTAKKIIYCANVDEEGLAEDNRHVVTVREFAASRSCDVVKICAKVEEELQGLDEAEQLDFLASFGIPESGLTKVIHTGYHTLGLISYFTVGEKEVRAWTIKEGWKAPAAAGVIHSDFERGFIRAEVIGYDDYVKHGSEAACRTAGVLRVEGKEYVVSDGDIIHFLFNV

SEQ ID NO: 44639 - protein, 296 aa, Physcomitrella patens
MATVSEKEWTGFQGLPAATQIILHTLLAKLRKQKVDKITIVLLGKGGVGKSSIVNSLFSERVAAVSAFRSETLRPRQYSRSKDGFKLTVIDTPGFVEAGRVDAALNSIRRYLLGKTINVVLYVDRLDGPREDKVDVKISRAISQAFGPQIWPHVIVVFTHAEIHLEDVTYSEFVSRRSAALRNIILKESRFKTVNTKVPFVLVENCSRCSENGEHEKILPDGTVWLPVLFEALVDLVLGSKKPILIDEKMIGIPKGNPLGSIWMPLVLLAQFVLIWRPIRKAIDRDLVEEAQRHSP

SEQ ID NO: 44640 - protein, 872 aa, Desulfovibrio desulfuricans G20
MKKQRILAFFIGAALMFFSFQAAHAASVTRLANGLTVLIQQDDRFPLASLRLYVHAGSAYETPQQAGISHLLEHMVFKGTEKRPEGGVAGAIEQIGGNINAATSFDYTVYLTDVPSEHWRLGMDVLKDMTFGAKISPEALAPEKEVVLAELERGEDTPGSLLFKRLTAKVLARTPYERPIIGYRETVSAITSKDIHDYIDRLYQPQSMLLVVCGAVNEQEVLAEAEKLFGNLANTRTCVPPQPVTPPVSPAAPALTAEPGKWNKVYAGFALPIPNFHDARIPAVEVLAQMLGGDKTSLLYREFKYDKQLVDDISVSAYSFERTGLLLITAILDPQKTEKFTRELSAALARLSADSFTDNALARAKLNLEDELFRSKETLSGLASKLGHFYFFENGEQSELNYLQSLRQVEKTSVQDILDTFFTPERLNGVLLTPQNAGLNSDDLTELFRDGWPAKGSGHAAPAEKGDNGQQQEVIELGDGRTVVLIPDETLPYTAVDLVFRGGDALLDEDRQGLAALAARVLTKGTQQMDNAALEAFKADRAASLAASAGRSSFTISARYPERFSADITGLFRNVVTAPALAAEETAREKDNQIASIKAREDQPLGLAFRRLFPFLFHNSAYGYLHLGEEQRLAAYTAEDVAGFWKVQRTQPWVLAVCGQFDREEILGLARSLPAPSGPVAVPAVPLWSAETQLDISLEDRNQAHMLMIFKTVPITHEDTPALELLQTVLAGQSGLLFTDLRDKQGLGYTVTAFPWQSEHAGLLAFYIGTDPEKLAQADAGFKKVIRDLQEAPLPEEAIRRGKNMLRGDYYRGRQSLGSRSNEAARLAGSGLPLDFEKGLIEKAEKVDATALQEVARRYLIPQDAYIIRVLP

SEQ ID NO: 44641 - protein, 211 aa, Arabidopsis thaliana
MVSPFRSPCSSPKKSRKASKNPYSNRGLDKFSELLSELDEKRQSIYSKKLDSGGPPLVRFVFTSSGECVPVVIRSSYLHKKNKKTKDVVADKVKTEVKEAKTEEIKNTEPETEQKQSCVINENLKKIARPDHFLPVTVILVLVFLAFFGRSVAIMCTCIAWYLVPTIQEQSGNRGSSPSYAMKKKDFARKLSIENRTSFNPRTVRDHSPRK

SEQ ID NO: 44642 - protein, 350 aa, Physcomitrella patens
MAATQAREWTGLLQFPVATQTALHNILGKLRQQKKESLTVLVVGKGGVGKSSTVNSIIGERVTVVSAFQSETLRPLQCARTRAGFTLNVIDTPGLIEGGCINDQALDIIKRFLLNKTIDVVLYVDRLDGYRVDNLDKQVIRALARSFGPNFWRIAIIALTHAQLSPPDGVDYTEFVNNRSAALRAAIRQEAGFKKSEGEISYMLVENSGRCNTNSEGEKVLPNGSVWLPALVDRIAEVATGATPSIHVDQKLIDGPNANGKGKWWIPLIILAQYFLIVRPIRSAIEKDLIEEEKQRPQWQIRAEEFVRPIASLYEDDQVDEQAIRQALKQGALNDQMDSFVEDDEDDDEY

SEQ ID NO: 44643 - protein, 413 aa, Coccidioides immitis RS
MPFAAPRSLLSASIASRRIFKIPLGFVLQNTKAIPIPQAPKRFPPLTLPSAVPYRGLATQSTGPTDKMKALVYAGNGKVALEERPKPTLSSPTDAIVKLKYGTICGTDLHIIKGDVPTATPGRILGHEGVGIIEEVGSNVTGLSKGDTVLIACITACGSCSFCRKGMSSHCSHGGWILGNTIDGTQAEYVRIPCAMSSLYKLPPTVDLAEAVMLSDALPTGFECGTLNSKVRPGSSVAIVGAGPVGLAAMKTAQLYSPAKLVLVDLDDSRLQVGQKLGATHGVNPKGQDGIKRLLDLTPNGQGFDAVMEAVGIPATFQLCQEIVGPGGVIANIGVHGTKVDLHLEKLWSQNISITTRLVDATTIPELLTLFEAKTLNVSDFITHRYKFADCVKAYDTFKAAAQHQALKVSLEF

SEQ ID NO: 44644 - protein, 208 aa, Zea mays
MSPSPPPSSGCSLAVLVGGTSTAGSSNMSLRERRDAVRHAADAALAAARGAAPRWSRALAAELSSQSQSQQHGRWHWHDDDAPHLLVAGADARPSGHQTCLPCGTAAAVAAAGCRKTVPRRRRLRVRARPKSGATTAWSAGAVARVVARRRARAGALRRMVPGGRGMADECTLLGETLDYAVSLRAQVDAMQLLLRTLQPPGHANNNP

SEQ ID NO: 44645 - protein, 312 aa, Pseudomonas syringae pv. phaseolicola 1448A
MFLVCGEALFDIFTRADDSGSLNRLGFDAIAGGSPFNVAIGLRRLGVEAGFFAGLSTDYLGRRLRAVLEKETVNTDHLIEFDAPTTLAMVAVGSDGSPTYSFRGDGCADRQLRLEHLPELDAQVRGIHVGSFSLVVQPIADTLLALVARESATRLISLDPNVRLNPAPDIQRWRSQVAAFAEHAHLIKVSDEDLHLLYPDSDPQKIAEGWLGKRTQLVIVTRGTQGASVFTRQHGTWSVPAKTVVTADTVGAGDTFQAALLTFLSERQLDTPQGLSTLSRETLDEMLNFAVGAAALTCTKVGPDLPYRHQLG

SEQ ID NO: 44646 - protein, 813 aa, Oryza sativa
MEQREDHTKSSEPAFIPSKRTHQMRNIWAWGGPSSTTVNGSSDAVLFSSSLPSVLQFGKLPGKEREYNAQPKDDMFPMMKQPGTNARVADPMDDVAQHLIGNLLPDDEELLAGVIEDFDHVKLRTQVEESEEYDVFRNSGGMELDIDPLESITFGTAKASLVNGTGSSTNQYSIQNGAGTVTGEHPYGEHPSRTLFVRNINSNVEDSELRSLFEPFGDIRSMYTATKHRGFVMISYYDIRHARNAKTALQSKPLRRRKLDIHYSIPKENPSDKDMNQGTLVIFNLEPAVSNEELLQIFGAFGEVREIRETPHKRHHRFIEFYDVRAAESALRSLNKSDIAGKRVKLEPSRPGGARRSFIQHFNHEFEQDETKHNSFQIGSPSANSPPSLWSQLGSPTDENKLNALNETAFNGGMSPLGSNHLSGFSSGYPPMKSPVGKSSYWNNRADNIFHGSPTLHNSHSFPEHHGGIISASPLVSSAASSASTASGFTALTGTSFLWGNNNNLRDHGQPSSIQSQALSNSLFPNNQPQRQSNLYQNLRGSFGASEHFSQFNVGSAPSVFPFESNFGYFSDSPDTSYMRQGKFGGTGPTRVSGSLMTNFGAYPRINVASMQNGSVGFEGLLDRGRNQTVGNSGCQEDSRVQYQLDLEKIIAGKDTRTTLMIKNIPNKYTSNMLLEVIDETHEGTYDFFYLPIDFKNKCNVGYAFINMASPGYIVSFFKAFAGRKWEKFNSEKVVSLAYARIQGKAALVNHFQNSSLMNEDKRCRPMLFDPKHTENNNQVKILLNGIFISMAQQDATQERHDLPENPREDNFS

SEQ ID NO: 44647 - protein, 469 aa, Klebsiella pneumoniae subsp. pneumoniae MGH 78578
MQSTTQQQGGQLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWIWCVVFCAVIFGLNIISTRFFAEGEFWFSLVKVITIVAFIILGGAAIFGIIPMQDGSPAPGLRNITAEGWFPHGGLPILMTMVAVNFAFSGTELIGIAAGETENPHKVIPVAIRTTIARLIIFFIGTVFVLAALIPMQQAGVEKSPFVLVFEKVGIPYAADMFNFVILTAILSAANSGLYASGRMLWSLSNEKTLPACFAKVNKRGVPVTALSVSMLGGVLALFSSVVAPDTVFVALSAISGFAVVAVWLSICASHFMFRRRHLQQGKALSDLQYRAPWYPVVPVLGFVLCLVACVGLAFDPSQRIALWCGIPFVALCYGAWYLTRSRNMTQEPQHVAD

SEQ ID NO: 44648 - protein, 195 aa, Zea mays
  misc_feature (91)..(91): Xaa can be any naturally occurring amino acid
RNPARRETVKTYAEKMHDVIVGVAGELATSLGLGLEEHSFQDWPCQFRINRYNYTQETVGSSGVQTHTDSGFLTVLQEDECVGGLEVLDPXAAGEFVPVDPVAGSFLVNIGDVGTAWSNGRLHNVKHRVRCVAPVPRISIAMFLLAPKDDRVSAPEALVDAGHPRRYKPFNYDDYRRLRLSPGERAGEALARMAA

SEQ ID NO: 44649 - protein, 242 aa, Vitis vinifera
  misc_feature (19)..(19): Xaa can be any naturally occurring amino acid
MSFSHSQSTQLLSRLAQLXCRLSWVFHWQPNAGTTVNSQMINEVSQCVESINGVKEGRWKATLTFYKPMFRADQAVPAEYPRDFLGISLPEQPNRYYFIIRSQKIVLEADSSIQMIMEKLQSYKSRVSLTFEGFQYQLGDFQLRVGKVAPSASENLRGIVFEVEYLPLSSMEKSRQILDGFVEIWQEAMSKRSLPGHFMHIEPNFAEFGLSDHYTSQHTAVQYATVMAQLISAVQTAQGVRN

SEQ ID NO: 44650 - protein, 124 aa, Listeria monocytogenes EGD-e
MDKIYLNELVFYGYHGVLKEETKLGQTFRVSLILGLSTKKAGISDSVEDTVSYADVYETVKEIVEGKPFKLIEALAEKIASEVLTGYPLLEEVTVKLIKPNPPIPGHYDSVAVEIERKRSDLNG

SEQ ID NO: 44651 - protein, 465 aa, Chlamydia trachomatis D/UW-3/CX
MNEAFDCVVIGAGPGGYVAAITAAQAGLKTALIEKREAGGTCLNRGCIPSKALLAGAEVVTQIRHADQFGIHVEGFSINYPAMVQRKDSVVRSIRDGLNGLIRSNKITVFSGRGSLISSTEVKILGENPSVIKAHSIILATGSEPRAFPGIPFSAESPRILCSTGVLNLKEIPQKMAIIGGGVIGCEFASLFHTLGSEVSVIEASSQILALNNPDISKTMFDKFTRQGLRFVLEASVSNIEDIGDRVRLTINGNVEEYDYVLVSIGRRLNTENIGLDKAGVICDERGVIPTDATMRTNVPNIYAIGDITGKWQLAHVASHQGIIAARNIAGHKEEIDYSAVPSVIFTFPEVASVGLSPTAAQQQKIPVKVTKFPFRAIGKAVAMGEADGFAAIISHETTQQILGAYVIGPHASSLISEITLAVRNELTLPCIYETIHAHPTLAEVWAESALLAVDTPLHMPPAKK

SEQ ID NO: 44652 - protein, 267 aa, Vibrio fischeri ES114
MHPMLNIAVRAARKAGDFVAKSFEQTDKIETTKKGNNEFITNIEADAQYILVDMIKKSYPDHSIISEESGLIEGKDTDIQWIIDPLDGTTNFVKGIPHFSVSIAVRIKGRTEVACVYDPIRNELFTAQRGAGAQRNNQRMRVKELKDLSEAIISTGFPYRHKQHTESFMKVVGALFIEGSDVRRSGCASLDLCYLASARMDGFVELGLKPWEMTAADLIAREAGVICTDFVGGTDYLKSGNLVAGSPRVVKAMLKKVRENGNEAMMK

SEQ ID NO: 44653 - protein, 251 aa, Bradyrhizobium sp. ORS278
MTDRIRPLIAGNWKMNGLKASAAEFEAMLAGAAEVTGKADLLVCPPATLLAAFAEKTRGGKAVAVGAQDCHAKASGAHTGDISAEMLADAGASAVIVGHSERRADHGESDVVVHQKAEAAWRAGLVAIVCVGETQQQRDAGLTLEILRGQLTLSLPEGSRADNLIVAYEPVWAIGTGLTPTAGDVEQIHSFIRQLLIVRFKEQGARMRILYGGSVKPSNAAELMAVANVNGALVGGASLKAADFLAIAKGC

SEQ ID NO: 44654 - protein, 140 aa, Novosphingobium aromaticivorans DSM 12444
MAVTRTFSIIKPDATRRNLTGAVTKMLEEAGLRVVASKRIHMSREQAEGFYAVHKERPFFGELVEFMISGPVVVQVLEGEDAVKRNRDIMGATNPKDAAPGTIRKELAESIEANSVHGSDSEENAAIEIAYFFKPEEIVG

SEQ ID NO: 44655 - protein, 127 aa, Vibrio fischeri ES114
MAYSEKVIDHYENPRNVGSFEKDDPSVGSGMVGAPACGDVMKLQIKVSPEGVIEDAKFKTYGCGSAIASSSLVTEWVKGKTLDEAAALKNAEIAEELELPPVKVHCSILAEDAIKAAVSDYRNKHQD

SEQ ID NO: 44656 - protein, 357 aa, Nicotiana tabacum
MKKGSLAPNLKLSLPPPDEVNLSKFLTESGTFKDGDLLVNRDGVRIVSQSEVEAPSVIQPSDNQLCLADFEAVKVIGKGNGGIVRLVQHKWTGQFFALKAIQMNIEESMRKHIAQELRINQSSQVPYVVISYQSFFDNGAISIILEYMDGGSLADFLKKVKTIPERYLAAICKQVLKGLWYLHHEKHIIHRDLKPSNLLINHIGDVKITDFGVSAVLASTSGLANTFVGTYNYMSPERILGGAYGYRSDIWSLGLVLLECATGVFPYSPPQADEGWVNVYELMETIVDQPAPSAPPDQFSPQFCSFISACVQKDQKDRLSANELMRHPFITMYDDLDIDLGSYFTSAGPPLATLTEL

SEQ ID NO: 44657 - protein, 206 aa, Glycine max
  misc_feature (105)..(105): Xaa can be any naturally occurring amino acid
RRRQKGIYASKKKIREKEKERESEASLFWKIAPVENTEKKAMRPSHFRYFHRGQGTKPSEGDFLVMKPKKKKWAEHDMLLNKFEHGEALVSVLQTMNPGHVVAVXEELVARKKFLKCVSNLDVKNLELLLEFLHKYCTMPRYSSLLMGFAKKVLEMRADDIRASDSEAIKSHIINLKRAVAQEIQIQQSLQEIQGIISPLLKIAGR

SEQ ID NO: 44658 - protein, 709 aa, Oryza sativa Japonica Group
MAFLGWAVDIARDSGASSSVVLTCDGYGSALYFSPWDSVPLPATASPDDGFLLPRFPDVCVQRSQFTNHLAPANGTGGGGSRTGVKEEASEVLSWPPTSKQSVRRLEVAEHWYRLYKTDNQRLSPDSQQVSVLAESHCDLASGNWKEISIHHKKMPSSTTTKTTTPSRDAWIVSARSDPFHLLLEAQAPLGIKADALSQIAAVHQSHRNTSHIRELSLAMDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGELKRRLFEVSLSVLMETIAHTKATRPETDPDTDMSLEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 44659 - protein, 527 aa, Oryza sativa Japonica Group
MDKAYIAVFSIAILFLLVDYFRCRRRRGSGSNNGENKGMLQLPPSPPAIPFFGHLHLIDKPLHAALSRLAERHGPVFSLRLGSRNAVVVSSPECARECFTDNDVCFANRPQFPSQMPATFYGAGFGFANYGAHWRNLRRIATVHLLSAHRVRGMAGVVSGEIRPHGAEDVPRRAAAGVGVARVQLKRRLFELSLSVLMEAIAQTKTTRPEADDADTDMSVEAQEFKNVLDELNPLLGAANLWDYLPALRVFDVLGVKRKIATLANRRDAFVRRLIDAERQRMDNGVDGGDDGEKKSVISVLLSLQKTEPEVYKDIVIVNLCAALFAAGTETTAMTIEWAMSLLLNHPKILKKAKAEIDASVGNSRLINGDDMPHLSYLQCIINETLRLYPVAPLLIPHESSADCKVNGYHIPSGTMLLVNVIAIQRDPMVWKEPNEFKPERFENGESEGLFMIPFGMGRRKCPGETMALQTIGLVLGALIQCFDWDRVDGAEVDMTQGSGLTNPRAVPLEAMCKPREAMSDVFRELL

SEQ ID NO: 44660 - protein, 614 aa, Xanthobacter autotrophicus Py2
MHGDEHALFGAALAFLAAAVVSVPIAKRLGFSPVVGYLLVGIAIGPVGFNVADPGVVSTVAELGVVMLLFLVGLELKPSSLLSMGHFIFGLGTAQLMLTALAFALLAYFGLGFGAAAAVVSGLALSISGTAIALQLLGERGDLASPYGQRTFSILLFQDIAVVPLLALVPLLAPGGEAEVARDPKATLLAAAIAVAAIAVIVVSGRYLLNPLFRVLARSGAREAMTAAALLVVMGAAGLMEAAGLSAALGAFLAGLLLSESTFRHELEANVDAFRGLLLAVFFMSIGMSLNITVVLGHIPSLLVGTLAVAVVKSVIVYLVFRADNIAPQDSMRAAVALMSAGEFAFVLFPLGLDNRILKSEQADLLIALAALTMILGPLLFAALSRLLPRFARPAAEPPADDFADADGSVLVIGFGRFGQIVSQCLLAQEVTVTIIDKDVEMIQSAGRFGVHIYYGDGTRLDVLRAAGAETVEVICVCVDNKEDANRIVEIVRASIPNARLFVRSFDRVHSMELARLGVDFELRETLESALSFGARTLEALGVPQNAAAARIADVRVRDRARLERQLEEGIFAGGEVFSGHKVEPEPLTQPEKPARPLNPEAQDILSHETEFSG

SEQ ID NO: 44661 - protein, 338 aa, Bacillus pumilus SAFR-032
MKALDAVTFGESMAMFYAKEAGELHQVHTFQKALAGAESNVAVGLARLGFDVGWMSKVGADSLGTFILEELQKEGVDTSAVIRSNDGAKTGILLKSKVMDGDPDVTYYRKGSAASTMSPSDFPADYFQQAGHLHMTGIPPALSSEMRAFSFHALQKMKEAGKTISFDPNLRLQLWEEEEDMIHTVNQIAYQVDWFFPGLAEGQRLTGCHEPEEIADVYLQKGVKLVVIKLGAEGAYYKSAANQGMVSGFYVPNVVDTVGAGDGFAVGVISGLLDGLSCEKSVRRGNAVGALAVMSPGDKDGLPTREELQSFIKEAKRYHRREYMKGDEGYGEVSKFER

SEQ ID NO: 44662 - protein, 436 aa, Thermoplasma volcanium GSS1
MYDAVVLGAGPGGYAAAIRLGQRKKKVAIIEKDKIGGECLNYGCIPSKAIIELANSINYLKEMPGVSINYNVDMKKWQEWKWSMINKLTGGVELLLKAYGVDIFRGTGYIQDKNHVKVNDKVLETDSLVIATGSKPVSINGINDVMYNREVLDLDHIPSSIVIIGGGYIGVEIGIALAKLGSKVTIVEMMPSILPGTDNELVRHVVRRMSQLGINVITGRKVLSTAKNGEVTVKLDDGQELRAEKVLMTVGRIPNTEGFGLENLKLAMDGRFIKTDSRKMTSVKGVYAIGDVSGQPMLAHKAYYEADIAADNICGIDSEVDYRAMPYVIYSDPEIAYTGVKGAKSTRFPVAANGRSLTMNENIGTFNIYYDEKGIVTGAGIAAPHASELISEISLAVESGLMAMDIGLTIHPHPTVSEGVKESAEEVYGKPLHFKL

SEQ ID NO: 44663 - protein, 402 aa, Thermoplasma volcanium GSS1
MFLYEFKLPDIGEGVTEGEIVKWDVAEGDEVKKDQDLVEVMTDKVTVKIPSPVNGKISKILYKEGQVVPVGSTLVQIDTGEETSQQTMAEEHAELKPQTTAAQQIAIETVPAGKVLASPAVRRIARENGIDLAKVKGTGDNGRVTLDDLDAYMRGETKAKAPEKPIEAAKPAEVPPVQRSPGREEILEMHGLRRIIFDKMTKAKQIMPHFTVVEKVDVTGMISIIESAKSSGKKVTITGYIARIVPIVLKQYPYLNAIYDEANRRYLIKKYYNIGIAVDTPDGLNVFVVKDADRKSMYEITAEITDKAERARNNQLKIDEVQDSTFTITNVGTIGGVLSTPIINYPEVAILGVHRVMDENGKKIMYLSLSCDHRLIDGAVATRFIMDLKKIIEDPNSLIYEM

SEQ ID NO: 44664 - protein, 184 aa, Adonis aestivalis var. palaestina
MGVFMSKFWFMLFPAKEYKICVVGLDNAGKTTTLYKLHLGEVVTTHPTVGSNVEELVYKNIRFEVWDLGGQERLRTSWATYYRGTHAVIVVIDSTDRARISIMKDELLRLLQHEDLEHAVVLVFANKQDLKDAMPPAEITDALSLHSIKNHDWHIQSCCALTGDGLHDGLGWIAQRVTTGKATS

SEQ ID NO: 44665 - protein, 359 aa, Agrobacterium rhizogenes
MFVRSDALSRIKPSATIVVSQKFRELKAEGRDVVRLNIGEPDFDTPDNIKTAAIDAINRGETKYTPVSGIPELRKAIASKFKRENGLEYSWEQTIVGTGGKQILFNAFMATLNPGDEVVIPAPYWVSYPEMVALCGGTPVFVSATQEHDFKLQPADLEKAITPKTKWFIFNSPSNPTGAAYTHAELKALTNVLMQHPHVWVLTDDMYEHLTYSDFKFVTPVEVEPSLYDRTLTMNGVSKAYAMTGWRRLCRRPAPAHQGHGHDPGAADLGCDVDRPVGGCRSAERHPGLHPGEQEDLRRPPRPRRLHAEPGQGHRLPGAGRRLLRLSVLRRPDRQDGAVGQGHRDGRGFRFRASGIGRR

SEQ ID NO: 44666 - protein, 291 aa, Thermoplasma volcanium GSS1
MDEDVKRKYIEAGRIGREALELARTLIEPGTKLLDVAEAMEKFVIEQGAKPAFPVNLSINNDAAHYTPASGDKKVFKTGDVVKVDFGAHIDGYMSDTAITLEVGESGKHSDLIDATREALDAAISLVRPMRSVNEIGGRIADVIGSFGFKPVRNLGGHGVERYDLHATLFIPNYDDGNVVRLQPDHAIAIEPFASTGIGMIHSGPPGNIYILDAPKVREDEVIYKNFRTLPFAERWLAGLVEDHKTYLKSMVSSREVSPFPILREHNNTLISQAEHTILVLNDEIIVTTRK

SEQ ID NO: 44667 - protein, 138 aa, Agrobacterium rhizogenes
MIQGQQTSGATSIAQWAAVEALNGTQDFIPANKKIFEGRRDLVVSMLNQAKGIVCPVPEGAFYVYPSCAGLIGKTAPSGKVIETDEDFVSELLESEGVDVVHGSAFGLGPNFRISYATSEALLEEACRRIQQFCSNCS

SEQ ID NO: 44668 - protein, 78 aa, Escherichia coli
MSTIEERVKKIIGEQLGVKQEEVTNNASFVEDLGADSLDTVELVMALEEEFDTEIPDEEAEKITTVQAAIVYINGNQA

SEQ ID NO: 44669 - protein, 176 aa, Streptococcus equi subsp. zooepidemicus
MIKKENIPNLLTLARIVMIPLFLLITSLSKTVGAAIIFAVASLTDYLDGYLARQWHVVTNFGKFADPLADKMLVMSAFIMLVGLELVPAWVSAVIICRELAVTGLRLLLVETGGEVLAAAMPGKIKTVAQMLSIIFLLCHWTVLGTVLLYIALLFTIYSGYDYFKGASFLFKDTFK

SEQ ID NO: 44670 - protein, 233 aa, Bradyrhizobium sp. ORS278
MTQSFTPRPLVIAPSILASDFAKLGEEVRAVDAAGADWIHLDVMDGHFVPNISYGPDVIKALRPHTTKIFDAHLMITPCDPYLEAFAKAGCDHITVHAEAGPHLHRSLQAIRALGKKAGVSLNPSTPLNVIEYVLDLVDLVLIMSVNPGFGGQAFIASAIGKVQDLRAMTAGRPIDIEVDGGVGRDNAGALAAAGANAFVAGSAVFKGGTMEAYRSNIAAIRDAAATARGEAI

SEQ ID NO: 44671 - protein, 271 aa, Nicotiana tabacum
MEFCSGGNLHTLRQKQPNKHFTEEASRFYASEVLLALEYLHMLGIVYRDLKPENVLVRDEGHIMLSDFDLSLRCSVNPTLVKSSSVHGGGGGGNPSNGSGILDNDSAVQGCIQPSTFFPRNILPTKKNRKSKSDFGLFVGGSLPELMAEPTNVRSMSFVGTHEYLAPEIIRGEGHGSAVDWWTFGIFLYELLHGTTPFKGAGNRATLFNVVGQPLRFPETPQVSAIARDLIRGLLVKEPHKRIAYKRGATEIKQHPFFEGVNWALVRSAEG

SEQ ID NO: 44672 - protein, 262 aa, Oryza sativa
  misc_feature (202)..(202): Xaa can be any naturally occurring amino acid
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPXLLANKDFEGAVVSRTPLRRVGEPEEVSSLVAFLCMPGSSYITGQTISVDGGMTINGLYPS

SEQ ID NO: 44673 - protein, 261 aa, Physcomitrella patens subsp. patens
MEALLGEWSSVGTPVLWCGSVLLGIVFCKLVYDISQALSPVIFPIYNKLTKSEKVEWDNRAFSTAHALISSGISFYLLYICDLFRESAPYGPIMFRGSILSQFGLGFSCGYFIADMGIMIVFYPMLGGYEFLLHHLVSTLACILGVHSGHCHFYMYIVLLSECTTPFINLRWYLTMTGLKDSDAYFYNGAFTAFLWLLARVINFLHCFYHLYSHFDQAMQVHTVGFIFLLISPTSLGMMNFFWFYKIMQAMVRTLSRKQAP

SEQ ID NO: 44674 - protein, 325 aa, Corynebacterium glutamicum ATCC 13032
MTAHWKQNQKNLMLFSGRAHPELAEAVAKELDVNVTPMTARDFANGEIYVRFEESVRGSDCFVLQSHTQPLNKWLMEQLLMIDALKRGSAKRITAILPFYPYARQDKKHRGREPISARLIADLMLTAGADRIVSVDLHTDQIQGFFDGPVDHMHAMPILTDHIKENYNLDNICVVSPDAGRVKVAEKWANTLGDAPMAFVHKTRSTEVANQVVANRVVGDVDGKDCVLLDDMIDTGGTIAGAVGVLKKAGAKSVVIACTHGVFSDPARERLSACGAEEVITTDTLPQSTEGWSNLTVLSIAPLLARTINEIFENGSVTTLFEGEA

SEQ ID NO: 44675 - protein, 742 aa, Oryza sativa Japonica Group
MGVHAEGHHQAEEHPRGQARATVQLRGLHDALHVRPPPPPPPPPGTIYNMCTQKPPHDYSQQLYDKYRESFEEYITSMVLPSLRDKHDEFMLRELVKRWSNHKIMVRWLSRFFFYLDRYFISRRSLIPLEQVGLTCFRDLIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 44676 - protein, 197 aa, Nocardia farcinica IFM 10152
MPMTKLTRAAAVLALALLTFLAPGPLTAPQAHADALPRVYLDLTIGGAPAGRVVIELRSDVVPRTAENFRALATGEQGFGYRGSTLHRVIPGFMAQGGDFTHGDGTGGHSIYGPVFADENFQLPHAGPGVVSMANRGPGTNGSQFFITLDATPWLDGKHVVFGTVVEGMDVVQAVAATGSDTGATTQPVVVADSGQL

SEQ ID NO: 44677 - protein, 447 aa, Magnaporthe grisea 70-15
MASSSSNVVGVHYRVGKKIGEGSFGVIFEGTNLLNNQQVAIKFEPRKSDAPQLRDEYRTYKILVGCPGIPNVYYFGQEGLHNILVIDLLGPSLEDLFDHCNRRFTIKTVVMVAKQMLSRVQTIHEKNLIYRDIKPDNFLIGRPGTKTANVIHVVDFGMAKQYRDPKSKQHIPYRERKSLSGTARYMSINTHLGREQSRRDDLEALGHVFMYFLRGGLPWQGLKAATNKQKYEKIGEKKQTTAIKELCEGFPIQFEKYLTYVRNLGFEDTPDYDYLRELFTQALKESGGVEDGEYDWMKVSKDKKNDWDRQAMHNPSQRPGASNMELHGASRGAHASDLRDPRARLTVDRLNAAQPPPPSPIKANQGKDRRNAPGAIMASRGTAGGLRDMATPTGSTQAQFQNSTQNLPQRPMHQQSNMTQPQLNNGRPAEPEPTGFQKFMKVLCCGK

SEQ ID NO: 44678 - protein, 157 aa, Listeria monocytogenes EGD-e
MIRIGQGYDVHKLAYDRDLIIGGVKIPYEKGLLGHSDADVLLHAITDAIIGAIGAGDIGHFFPDTDMVFKDADSAELLAEIWQKVEADGFRLGNLDATIIAEKPKMAPYVEQMKLRIAELLHADSAQVNVKATTTEKLGFTGREEGIASLAVVLLEK

SEQ ID NO: 44679 - protein, 204 aa, Listeria monocytogenes EGD-e
MPTRLKEDIATIIKNDPATKSFFDAFLTNPGLHALWWHRVANFFYRHKMVLFGKVLSQNARFWTNIEIHPGATIGRRLFIDHGAGIVIGETAEIGDDVTIFHGVTLGGTGKDCGKRHPTVGDGALVSAGAKVLGPVEIGAGARIGAGAVVLKDVPPGATVVGIPAKVVRLNGRTVGHAVPKMDELTLRIAELENIVEKLLKEKE

SEQ ID NO: 44680 - protein, 222 aa, Nocardia farcinica IFM 10152
MIEGRHADTAMSRPGPDQVPGRPGFVAAPSEAAVPVLNVANVLTMARIAIVPVFVLALFAGGGHDTGWRIGAAALFGLAAITDRFDGQLARKYGLVTDFGKLADPIADKALIGASLIGLSALGDLPWWITLVIIARELGVTLLRLVVVRRGVIPAGRGGKLKTLVQSVAIAVLLLPLAGGFATAGMILMYVALVLTVVTGLDYVGQAARVWFAGGTHRTRGA

SEQ ID NO: 44681 - protein, 240 aa, Novosphingobium aromaticivorans DSM 12444
MFNGLIAYLDSIRSRDPAPRSRWEILLYPGLWAVGFHRVAHWLFEAELYFLARAINHFSRFLTAIDIHPGAKIGKHLFIEHGFTVIGETAEIGDNVTIYQCVTLGGTNPTNGIPGKRHPTLCDEAIIGSGAQILGPITVGARARVGANAVVTDDVPEGATMIGLKARSTLVPAETWLKQFIPYGTPCKEPCEPNGGTRVDDLEAEVAALKAQVAALMAARDGGDDLTPAPTPSRARRTRS

SEQ ID NO: 44682 - protein, 850 aa, Brassica oleracea
MRIFRKTLVSFPLFIFLFLYESSTAQDTIRRGGFLRDGSTHKPLVSPQKTFELGFFSPGSSPGRYLGIWYGNIEDKAVVWVANRENPISDRSGVLTISNDGNLVLLNGQNITVWSSNITSTNNDNNRVGSILDTGNFELIEVSSERVIWESFNHPTDTFLPHMRVRVNPQTGDNLAFVSWRSENDPSPGNFSLGVDPSGAPEIVLWGRNNTRRWRSGQWNSAIFTGIPNMALLTNYLYGFKLSSPPDETGSVYFTYVPSDPSVLLRFKVLHNGTEEELRWNETSKRWTKFQAAPESECDKYNRCGSFGICDMRGDNGICSCVKGYEPVSLGNWSRGCRRRTPLRCERNVSNVGEDEFLTLKSVKLPDFETPEHSLADPEDCKDRCLKNCSCTAFTFVNGIGCMIWNQDLVDLQQFEAGGSSLHVRLADSEIGESKKTKIVVIVAVLVGVLLLGIFALLLWRFKRKKDVSGTYCGHDADTSVVVVDMTKAKDTTTAFTGSVDIMIEGKAVNTSELPVFCLKVIVKATNDFSRENELGRGGFGPVYKGVLEDGQEIAVKRLSGKSGQGVDEFKNEIILIAKLQHRNLVRLLGCCFEGEEKMLVYEYMPNKSLDFFIFDEMKQELVDWKLRFAIIEGIARGLLYLHRDSRLRIIHRDLKVSNVLLDGEMNPKISDFGMARIFGGNQNEANTVRVVGTYGYMSPEYAMEGLFSVKSDVYSFGVLLLEIISGKRNTSLRASEHGSLIGYAWFLYTHGRSEELVDPKIRATCNKREALRCIHVAMLCVQDSAAERPNMAAVLLMLESDTATLPVPRQPTFTTSTRRNSMDVNFALDSSQQYIVSSNEITSTVVLGR

SEQ ID NO: 44683 - protein, 144 aa, Vibrio fischeri ES114
MTIERTFSIVKPDAVKRNLIGAIYRRIEKTGMQIVAAKMLRLTKEQAEGFYAEHEGKEFFDELVAYMMSGPVMVQVLEGENAVVRYRELMGKTNPEEAACGSLRADYAISMRYNSVHGADSPESAAREIAYFFAEDEICPRPAE

SEQ ID NO: 44684 - protein, 287 aa, Rhizobium leguminosarum
MTGMVCGRATAGARRVANGKRTMLRTFEKAALEAGRAIITVLREGFPVAMKADASPVTVADEEAERIILAHLARDYPEIPVVAEESVAAGKVPDIAGRGFFLVDPLDGTREFVDGRQEFTVNIAYIENGAPVAGIVYAPALGLAFSGERGHAERLVVMDDFTVGARSAITVREQPDDRLALASLRHNSPETGSFLADHAIFKCTNIGSSLKFCLLAEGKADVYPRFTRTMEWDTAAGDAVLRAAGGSTVTLDGTPLTYGKTGTAADFDFANPNFISWGGRKRVLELA

SEQ ID NO: 44685 - protein, 434 aa, Bacillus anthracis str. Ames
MNRLLMNENQKWNTFIETPFYTKVGKVHSVQEQFFVAKGPKAKIGDVCFVGEHNVLCEVIAIEKENNMLLPFEQTEKVCYGDSVTLIAEDVVIPRGNHLLGKVLSANGEVLNEDAENIPLQKIKLDAPPIHAFEREEITDVFETGIKSIDSMLTIGIGQKIGIFAGSGVGKSTLLGMIAKNAKADINVISLVGERGREVKDFIRKELGEEGMRKSVVVVATSDESHLMQLRAAKLATSIAEYFRDQGNNVLLMMDSVTRFADARRSVDIAVKELPIGGKTLLMESYMKKLLERSGKTQKGSITGIYTVLVDGDDLNGPVPDLARGILDGHIVLKRELATLSHYPAISVLDSVSRIMEEIVSSNHWQLANEMRKILSVYKENELYFKLGTIQENAENAYIFECKNKVEGINTFLKQGRSDRFQFDDIVEAMHHIV

SEQ ID NO: 44686 - protein, 2192 aa, Phaseolus vulgaris
MSSSISFPTVRTPSARTLPCKTEKSLFNSRCPVRVTKFLGTRLRSSGKWLGSERLHVWKSEGPLRRPKLRVVVRSGMSTVPKKPLGLYDPAMDKDSCGVGFVAELSGEGNRNTVTDALEMLVRMTHRGACGCEPNTGDGAGIMVGLPHQFYKEVVDFELPPPGKYAIGMFFLPTSNSLREESKSVFQKVAESLGHSVPGWRSVPTNNSELGKSALLTEPVIEQVFLTPSTLSKVDLERQMYILRKLCMVAITSTLNLHNDGTTDFYICSLSSRTVVYKGQLTPAQLKDYYFADLGNERFTSYMALVHSRFSTNTFPSWDRAQPMRVLGHNGEINTLRGNVNWMKAREGLLKCKELGLSENELKKLLPIVDANSSDSGAFDGVLEFLIQSGKSLPEAVMMMIPEAWQNDKNMDPQRKAFYEYFSALMEPWDGPALIAFTDGHYLGATLDRNGLRPGRFYVTHSGRVVMASEVGVVDIPLEDVSRKGRLNPGMMLLVDFEKHIVVNDDALKEQYSLARPYGEWLKEQKLELKDIVDSVQQSERMPPTIAGVVPAYGDDVDMENMGIHGLLAPLKAFGYTVESLEMLLLPMAKDATEALGSMGNDTPLAVMSNREKLTFEYFKQMFAQVTNPPIDPIREKIVTSMECMVGPEGDLTEITEAQCHRLSLKGPLLSIEEMEAIKKMNHRGWQSKVIDITYSKGRGKKGLEEALDRICAEAHDAIGDGYTTLVLSDRAFSRKRVAVSSLLAVGAVHQHLVKTLERTRVALVIESAEPREVHHFSTLVGFGADAVCPYLAVEAIWRLQVDGKIPPKASGEFYSKDELIKKYFKASNYGMMKVLAKMGISTLASYKGAQIFEALGLSSEVIERCFAGTPSRVEGATFEMLARDALQLHELAFPSRVFSPGSAEAIALPNPGDYHWRKGGEIHLNDPLAISKLQEAARTNSVDAYKQYSKLIHELNKACNLRGLLKFKEAAVKVPLDEVEPASEIVKRFCTGAMSYGSISLEAHTALATAMNKMGGKSNTGEGGEQPSRMEPLSDGSMNPKRSAIKQVASGRFGVTSYYLTNADELQIKMAQGAKPGEGGELPGHKVVGDIAVTRNSTPGVGLISPPPHHDIYSIEDLAQLIHDLKNANPAARISVKLVSEAGVGVVASGVVKGHADHILISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMIAEEMREIMSQIGFRTVKEMVGRSDMLEVDKEVIKSNEKLENIDLSLLLRPAAELRPEAAQYCVEKQDHGLDMALDNKLIALSKAALEKGLQVYIESPILNVNRAVGTMLSHEVTKRYHLNGLPTDTIHIRFKGSAGQSFGAFLCHGITLELEGDGNDYVGKGLSGGKIVVYPSKVSTFDPKQNIVIGNVALYGATSGEAYFNGMAAERFCVRNSGVKAVVEGVGDHGCEYMTGGIVVVLGNTGRNFAAGMSGGIAYVLDIDGGFPSRCNRELVDLDKIEEEDDIATLKMLIQQHQRHTNSVLASEVLADFDSILPKFIKVFPREYKRVLASMKLKEASKDAAESASKHGEEQVEMELVEKDAFKELKELATASPNGKPNEAESFKRPSQVIDPVKHRGFVAYEREGVQYRDPNVRLNDWKEVMKETQPGPLLKTQSARCMDCGTPFCHQENSGCPLGNKIPEFNELVYQNRWREALERLLETNNFPEFTGRVCPAPCEGSCVLGIIENPVSIKSIESAIIDKAFEEGWMVPRPPVNRTGKRVAIVGSGPSGLAAADQLNKMGHTVTVYERADRVGGLMMYGVPNMKADKENIVQRRVNLMAEEGINFVVNASVGHDPLYSLDRLREENDAVVLAVGATKPRDLPAPGRELSGIHFAMEFLHANTKSLLDSNLHDGNFISAKGKKVVVIGGGDTGTDCIGTSIRHGCSSIVNLELLPEPPQTRAPGNPWPQWPRIYRVDYGHQESAAKFGKDPRSYEVLTKRFVGDENGVVKGLEIVRVRWEKDATGRFQFKEIEGSEEIIEADLILLAMGFLGPEPTIAEKLGMERDNRSNFKAEYGRFSTSVSGVFAAGDCRRGQSLVVWAISEGRQAAAQVDNYLSNEDIEHIAGNPDELIKHQQDLTKRGTVAVANTQ

SEQ ID NO: 44687 - protein, 93 aa, Vitis vinifera
MGYFQEAKENQMKKKVEEALRSKMKQKALKECNEYASKYAQCAAGKTISVVWHCRKQAKELNECLHQYTNDTIFEEMKKEYMAQQEGKGPVIV

SEQ ID NO: 44688 - protein, 2196 aa, Phaseolus vulgaris
MSNALSFTLPALNNPQISAFNSPNKARLHLRSRVARCPASTVEKKRLFGAQVRSSGFDRIRLLQSGRLPKWRVAVRSAFSAVPEKPLGLYDPAMDKDSCGVGFVAELSGECNRRTVTDALEMLVRMTHRGACGCEANTGDGAGILVALPHVFYQEVVDFELPPQGKYAVGMFFLPKSENRRKESKKLFSKVAESLGHTVLGWRSVPTDNTGLGKSALQTEPVIEQVFLTPSAESKVDLERQMYILRKLSMAAITSALNLQNDGITDFYICSLSSRTVVYKGQLTPAQLRDYYFADLGNERFTSYHGPDTFTVFYKYFSIAGIVLNLCVYIGHNGEINTLRGNVNWMKAREGLLKCKELGLSENKLKKLLPIVDANSSDSGAFDGVLEFLLHSGKSLPEAVMMMIPEAWQNDKNMDSQRKAFYEYFSALMEPWDGPALISFTDGHYLGATLDRNGLRPGRFYVTHSGRVIMASEVGVVDIPPEDICRKGRLNPGMMLLVDFEKHAVVNDDALKEQYSLARPYEDWLKNQKIELKDIVDSVPKSGRVPPPIAGVAPPSNDDEDMVNMGIHGLLAPLKAFGYSVESLEMLLLPMAKDGVEALGSMGNDTPLAVMSNREKLTFEYFKQMFAQVTNPPIDPIREKIVTSMQCMVGPEGDLTEITEEQCHRLSLKGPLLYTEEMEAIKKMNYRGWHSKVIDITYSKERGKGGLEEALDRICAEAHDAISEGYTTLVLSDRAFSRKRVAVSSLLAVGAVHQHLVKTLERTRVALIVESAEPREVHHFCTLVGFGADAICPYLAIETIWRLQVDGKIPPKSSGEFHSKEELVKKYFKASNYGMMKVLAKMGISTLASYKGAQIFEALGLSSKVIEKCFAGTPSRVEGATFETLARDAFQLHELAFPSRVFSPGSAEAVTLPNPGDYHWRKGGEVHLNDPLAIAKLQEAARTNSVDSYKQYAKFIHELNKACNLRGLLKFKETAVKIPIDEVEPASEIVKRFCTGAMSYGSISLEAHTALAMAMNKIGGKSNTGEGGEQSSRMEPLPNGTMNPKRSAIKQVASGRFGVSSYYLTNADELQIKMAQGAKPGEGGELPGHKVIGDIAVTRNSTAGVGLISPPPHHDIYSIEDLAQLIHDLKNANPTARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRTVNEMVGRSDMLEVDKEVIKSNEKLENIDLSLLLRPAAELRPEAAQYCVQKQDHGLENALDNKLISLSNAALEKGLPVYIETPIYNVNRAVGTMLSHEVTKRYHLAGLPSDTIHIRFTGSAGQSFGAFLCPGITLELEGDSNDYVGKGLSGGKIVVYPPKGSNFDPKENIVIGNVALYGATQGEAYFNGMAAERFCVRNSGAKAVVEGVGDHGCEYMTGGTVVVLGETGRNFAAGMSGGIAYVLDLDGKFQSRCNLELVDLDKVEEEEDVYTLRMLIQQHQRHTNSLLAKEVLDDFENLLPKFIKVFPREYKRVLASVKSEEASKDAVVQAAKDAEDQDDEAQAVEKDAFEELKKLATVSLNEKQSQAETPKRPSQVTDAIKHRGFVAYEREGVQYRDPNVRMADWNEVMEETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPVKRTGKRVAIVGSGPSGLAAADQLNKMGHAVTVYERADRIGGLMMYGVPNMKSDKVDVVQRRVNLMAEEGVDFVVNANVGNDPLYSLDRLREENDAIVLAVGSTKPRDLPVPGRELSGVHFAMEFLHANTKSLLDSNLEDGSYISAKGKKVVVIGGGDTGTDCIGTSIRHGCSSIVNLELLPQPPPTRAPGNPWPQWPRIFRVDYGHQEAAAKFGKDPRSYEVLTKRFLGDENGVLKGLEVIRVCWEKDETGRFQFKEIEGSEEIIEADLVLLAMGFLGPEPTIAEKLGLDRDNRSNFKADYGRFSTNVKGVFAAGDCRRGQSLVVWAISEGRQAAAQVDNYLVKDDDEHRNQDGLVKRQQGLNKKQQGSSKHTVMT

SEQ ID NO: 44689 - protein, 315 aa, Vitis vinifera
MGHPERDHRSPFSGSSHPHIQQDSTDPQLLHTPQTSYAHAMQPGPQVPSQNPHAIPLDPVQPMQFPPQPGHGNLSHTTHSSGQHLQSNPVQYPAQQAQFIPEHRQTNVACHAHQPTYNPAQPVPASYHVQSTNFQPSPAAMQYVPVHQTHATMVVPLQQTAPVIMVQSQPRVTTVGTEAWTTGLFDCMDDPTNALVTCCVPCLTFGQVAEIVDNGHTSCGTSALVYGAIACLIGCPFLISCTYRTKLRSRYGLVESPAPDWVVHCLCDFCALCQEYRELQNRGFDPSIGWHANVARHMQQQQVAMVVPPNQTMIG

SEQ ID NO: 44690 - protein, 478 aa, Klebsiella pneumoniae subsp. pneumoniae MGH 78578
MMALPIIVAVLLLFVPVPEGLPPYAWHYFAIFVGVIVGLIFEPLPGAVIGITGVVVIALCSQWLLFSPDQMAAPGFKMAGASFKWAVSGFGNSTVWLIFGAFMFAAGYDKTQFGRRLALILVKYLGRRSLTLGYAITFADLLLAPFTPSNTARSGGTIYPIIANLPPLYGSKPNDPSARKIGSYLMWVAITAACITSSMFLSALAPNLLALALVKSIVGINISWGTWFIAFLPLGILLILAMPLLAYWFYPPEVKVNNEVPLWAARELEKLGKLSRNEILLLVFVCFALMMWIFAADWIEPALAALLVIVLMLWTGVLSWSDITNNKAAWNTFVWFATLVALADGLSSTGFIAWLGKEGGALMSGISPGMATIVLLLAFYLLHYLFASTTAHTTALLPAMLTIASTIPGMNMEVFVLLMVTSLGVMGIITPYGTGPSPIYYGSGYLPTKDYWRLGTIFGAIFLAALLLIGYPWMSMMF

SEQ ID NO: 44691 - protein, 422 aa, Pasteurella multocida
MTQFNTISVIGLGYIGLPTAAVFAQHHVKVIGIDINEHAVNTINQGKIHIVESDLEQVVQQCVNKGDLKASLTPEPADAFLIAVPTPFKGNNYEPDLSYIKSACKMISSVLKKGDLIVLESTSPVGTTEKMAIWLSEFRHDLTFPQQLGELSDIRIAHCPERVLPGHVMRELIENDRIIGGMTPKCSQMAVDLYKTFVKGDCIVTNSRTAEMCKLTENAFRDVNIAFANELSIICDKLGINVWELINLANRHPRVNILQPGCGVGGHCIAVDPWFIVNKTPELAKLIHTARLVNDSKPEWVINQVNNAVIEALQKNPNKTLQDIKIACLGLAFKPDIDDLRESPALKITKQLAAKYPNQITAVEPNIEALPEQLITQNIKHSSLQQALETCDVLVVLVDHKEFKEIQTTSVNATIVDTKGIL

SEQ ID NO: 44692 - protein, 539 aa, Ustilago maydis 521
MQFESSGLTAESKRARQSASLLRYRTSDRNAFLLVFSPLHGKRMTTTRSPFDWSVTDPHHNTEYMRFASRRSTVLSTKGVVASSQPLASSAGIEILNAGGNAADAAVAVAAALNVTEPCNTGIGGDAFCLFYDAEKRTVRAFNGSGRAPQAMTLDMLRSKGVQGVEIPGNSIHSVTVPGAAATWVDTVEKLGSGKLTMQDILAPAIRLAEQGYPVHEGTAYLWARSEKLIKSASPNADEMLYHGRAPRTGELMRMPTLARTLRELATKGKQGFYTGRVAQAIVDVVQSQGGVLELDDLKDHLDRGTEEVEPIKYTYNHPAGARDLAGKEGVTMYECPPNGQGLTTLVALGILDQLQNQGKVGDLAQVKHNSAEYLHALIEALRLAFADTRYHVSDPHHSQHDVAALLLKPEYLAERARLFDPKKASAELEKGSPANTCDTVYFSVTDQYGNACSFINSNYAGFGTGAVPAGCGFTLQNRGAGFTLVDGHPNCVAPRKRPYHTIIPAMATRGDELFLSFGVMGGFMQPQGQLQVLSEEVR

SEQ ID NO: 44693 - protein, 358 aa, Epichloe festucae
MAEFVRAQIFGTTFEITSRYSDLQPVGMGAFGLVCSARDQLTNQNVAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKHADDFAIDLLESMLVFDPKKRITATSALGHEYLAPYHDPSDEPVAEEKFDWSFNDADLPVDTWKIMMYSEILDYHNVEAGVAAMEGQDFNGQ

SEQ ID NO: 44694 - protein, 319 aa, Arabidopsis thaliana
  misc_feature (89)..(89): Xaa can be any naturally occurring amino acid
MAAGGGGGGGGSSSGRTPTWKERENNKKRERRRRAITAKIYSGLRAQGNYKLPKHCDNNEVLKALCLEAGWIVEDDGTTYRKGFKPPAXSDISGTPTNFSTNSSIQPSPQSSAFPSPAPSYHGSPVSSSFPSPSRYDGNPSSYLLLPFLHNIASSIPANLPPLRISNSAPVTPPLSSPTSRGSKRKLTSEQLPNGGSLHVLRHPLFAISAPSSPTRRAGHQTPPTIPECDESEEDSIEDSGRWINFQSTAPTSPTFNLVQQTSMAIDMKRSDWGMSGMNGRGAEFEFENGTVKPWEGEMIHEVGVEDLELTLGGTKARC

SEQ ID NO: 44695 - protein, 404 aa, Arabidopsis thaliana
MTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNAKKETLVKGLKEVGFTVFPSSGTYFVVADHTPFGMENDVAFCEYLIEEVGVVAIPTSVFYLNPEEGKNLVRFAFCKDEETLRGAIERMKQKLKRKVLSLN

SEQ ID NO: 44696 - protein, 399 aa, Desulfovibrio desulfuricans G20
MHTWALLLAAGQSSRIAAACPGVRKQFLLWQNAPLFWHSAVMLSRVSRMRGIIFVFPEDMLEEATAMVRELDAGRALGIPWKAVSGGARRQDSVASGLGQLPAECDTVLVHDAARPFASASLTNSILDALQAGAEGVVPALAVTDTIKVVEDGAVLSTPDRTKLVAVQTPQGFSLQALLGAHRHCAEKALAVTDDASMLELLGQHTVITVEGEASNIKVTHPEDLTMLHSSEKKNMQVPCVGWGYDVHRFGSDGRPMKLGGVPIAGGPGVIAHSDGDVLLHALTDAVLGCMGLGDIGMLFPDTDAAYDNADSAVMLNEVLEKARNAGLLITHVDLTIITQIPRITPWRDQIHKNICRITRLDASSVNLKATTEEKLGFTGEKKGIKAVAAVTALRRVSS

SEQ ID NO: 44697 - protein, 463 aa, Burkholderia thailandensis E264
MKGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGIGAVLAAMLTTMFSFLGTEIVTIAAAESEHPERQIVRATNSVIWRISLFYLGSIFVVAALVPWNDALLPAHGSYQRAMELIGVPHAKAIIDVIVLVSVASCLNSALYTASRMIFSLSRRGDAPALLRRTDASGTPRAAVLASTAFGFITVIANYVMPEQVFGFLLATSGAIALLVYLVIAISQLRMRKMLDATGERLQLRMWCFPWITWAVILFICGVLTVMLVSEAHRMEVGATAVLALIVLAASWLNKRGRDAQASVGRRVSAT

SEQ ID NO: 44698 - protein, 248 aa, Physcomitrella patens subsp. patens
MVEKNVGPDGRVTAARYNLSVTKKEFKTKEAKPASPKYKGVRMRQWGKWVSEIREPNKRSRIWLGSFPTAEMAARAYDAALVCLRGPTASLNFPDSPPQALPVCNSPKDVQVAAAAAAAAAEPCTPVSLPAQPAAQSLEAQLNEMETETKESESHDLEESSASSTANSSPSTPGSITTLEDVDLAFLADMDFIDLPPLEPFDINQSHQSSFPESAALTQGDNPPYCRVSSGPILATDLELYKLLYGVK

SEQ ID NO: 44699 - protein, 326 aa, Triticum aestivum
MASRSLMVALLLAAVAATCARAQLHEKFYSESCPSVEDVVRREMVRALSLAPSLAGPLLRMHFHDCFVRGCDGSVLLDSANKTAEKDAQPNQTLRGFGFVERVKAAVEKACPDTVSCADVLALIARDAVWLSKGPFWEVPLGRRDGSVSISNETDALPPPTANFTVLTQLFAAVNLDAKDLVVLSAGHTIGTSHCFSFSDRLYNFTGMENPSDIDPTLEPQYMMRLKSKCASLNDNTTLVEMDPGSFKTFDTDYFKLVSKRRGLFHSDGALLTDPFTRAYVQRHATGAFKDEFFADFAASMIKMGNANPLTGGQGEIRKKCSVVNH

SEQ ID NO: 44700 - protein, 318 aa, Neptuniibacter caesariensis
MSNIRLQCANGDSLPMIGLGTWKAKPGEVYEAVKSAIEVGYRHIDCASVYGNEAEIGQAIADQINAGTVSRDELWITSKLWCDSFAAEDIKPALISTLHDLQLEYLDLYLMHWPIPLKKGHGMRTADDFVDPVLLPYPDTWLNMNQLSAEGLVRHYGVSNFTVKKLKVLLENTPFKPAVNQVELHPYLQQADLVNFCQGAGIHLTAYSPLGSSDRPDPLKQAGEPVLLENSVIGEIAKELSASAAQVIIAWLNSQGISTIPKSTHLDRQKQNLDSRHLNLSEEQVNKIAEIDLARRYITGEFWIKDEGFYTLEDIWDE

SEQ ID NO: 44701 - protein, 322 aa, Oryza sativa Japonica Group
MVSMEVTDEMFKCMEVGLAFRDYNGRISSMDFHSKATNYLVTACDDESIRLYDIQNAVCLKTINSKKYGVELVCFTENPTYVLHSSKNGWDDSLRLLSLVNNCFLRYFKGHLDRVVSISLCSENGNILSGSLDRTVLLWDSRVEKAQGLLRVQGRPAVSYDDQGLVFAIAYGGYIRMFDARNFEKGPFDIFSVGNDDSEANVIKFSSDGRRLLLTTKAGRVHVLDSFHGNNIATYNVKPVVSNSTLEASFSPDGNHIISGSGDGSVYAWNVRSGKVARWGSTDSEPPLIRWAPGSLMFLTASSELSCWVPDLSKLGSFTVSK

SEQ ID NO: 44702 - protein, 433 aa, Aeromonas hydrophila [sequence omitted]

SEQ ID NO: 44703 - protein, 263 aa, Triticum aestivum
QPRAMACAFSASTVSTAAALVASPQAQPGCRSACRFPGAAARPSRLAAAGSRTARAPSFVARAAAEYDLPLVGNKAPDFAAEAVFDQEFINVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLQALQYVQENPDEVCPAGWKPGEKSMKPDPKGSKEYFAAI

SEQ ID NO: 44704 - protein, 240 aa, Oryza sativa
MESKEVHGRDWLVDLEKGNCLLMREGGDNGTDVNMISSQAKTPWNDLIAMKDDHHIPCCSSRSQDFAVKSGEDRTSDGEMKVGLLDKSMGEKEKKKRSKKPPRPPRPPSASPLDAADQKLISELSELASLKRARIERMKALKKMKNTKPASSIGNLVALIITIIFCLVILWQGVFSKYGAGIIFHGSPISSGRSHGSLFSIQFYKKNETATSPRSSSSAPNNTGITTRLEIHGEARGVTE

SEQ ID NO: 44705 - protein, 517 aa, Vibrio fischeri ES114
MTTNIHDQRILILDFGSQYTQLVARRIREIGVYCELWSWDVEESDIRDFNPDGIILSGGPESVTEENSPRAPQYVFDSGVPVFGVCYGMQTMAEQLGGKVATSTEREFGYAAVQVTGESALFKDLEATQDVWMSHGDKVVEIPSDFVKIAETETCPYAAMANEEKKYYGVQFHPEVTHTKNGMKMLENFVLNVCGCEGLWTSASIIEDAVARIKEQVGDDEVILGLSGGVDSSVVAMLAHRAIGDKLTCVFVDNGLLRLNEADQVMEMFGNKFGLNIVHVNAEQRFLDALEGESDPETKRKIIGHVFVDIFDEESKKLKNAKWLAQGTIYPDVIESAASKTGKAHVIKSHHNVGGLPDDMEMGLVEPLRELFKDEVRKIGLELGLPYNMLYRHPFPGPGLGVRVLGEIKKEYCDLLRRADAIFIEELHNADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 44706 - protein, 539 aa, Oryza sativa Japonica Group
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKPYFFSVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 44707 - protein, 399 aa, Triticum aestivum
MMTQLQATPLRTLALSRRRGAGAAARPMAGSVRCSAAARSYSITLLPGDGIGPEVVAVAKDVLSVAGSKEGVELRFREMLMGGAALDAAGVPLPDETLAAARASDAILLGAIGGYKWDNNEKHLKPETGLLNIRAGLGVFANLRPATVLPQLVDASTLKKEVAEGVDIMVVRELTGGIYFGKPRGFGTNDKGEETGFNTEIYSVAEIDRIARVAFEVARKRGGKLCSVDKANVLEASMLWRKRVTAIASEFPDVELSHMYVDNAAMQLVRNPKQFDTIVTNNIFGDILSDEASMITGSIGMLPSASVGESGPGLFEPIHGSAPDIAGQDKANPLATILSAAMLLKYGLGVESAAKRIEAAVTETLDNGFRTGDIYSPGTTLVGCKRMGEEVLKALESQK

SEQ ID NO: 44708 - protein, 657 aa, Corynebacterium glutamicum ATCC 13032
MKVTQSTFLKSVAAFTVAALTLTISSCSSGEDTSASSTDTENSSTQAAASPPLAPCELPADASAEEEVEGTHTGEDISVAPEIGTGYREGMTPVQTQGYAVATANPIASEAACAVLREGGTAADALVTAQFVLGLTEPQSSGLGGGGYILYYDAEANAVTAIDGRETAPVAADENYLIHVSAEDQTAPVPDARRSGRSIGVPGIVAALGQLHDSFGKTSWQDVLTTPQQLATDGFSISPRMSASIANSAEDLSHDPEAAAYFLDENGDAKAPGTLLQNPDYAETIRLISEGGPDAFYTGEIAADIVERATREVDGFTPSLMSTADLAAYTPETREALCAPYRDKIVCGMPPSSSGGVTVMETLGILNNFDLAQYPPTEVGLDGGLPNAEAVHLISEAERLAYADRDAYIGDPAFVEVPAGGVEELISDVYTGERSELIDPEHSMGQATAGLSQEPVMAALPESGTSHISIIDSYGNAASLTTSVEAAFGSFHFTRGFILNNQLTDFSAEPLDEDGEPVANRVESAKRPRSSMSPMLVFNASGDGEIADLNMVLGSPGGSLIIQYVVKTLVNIIDWDMDPQQAVSAPNFGAMNQPKTGLGSEHPLIANDSAELVSELESKGHEVNVGEQSSGLSALVKNGDTIVGGADPRREGVVLGG

SEQ ID NO: 44709 - protein, 593 aa, Oryza sativa Japonica Group
MYKNQLQELAQRSCFNLPSYACIREGPDHAPRFKATVNFNGETFESPAFCSTLRLAEHAAAEVALNELSKRGPSSSLAAKVLDETGIYKNLLQETAHRAGLKLPVYTTIRSGPGHTPVFTCTVELAGMTFTGNPGKTKKQAQKNAAMAAWSELKQLPRVGEPSSSSCPPDHDDDDQEQIIVARTLASLNQTNGGKTPQQKEKQQSSNRPSSRRPSYPKSNASFYGRLHLQKHAYPSVPPEQAMYHMWHQVQATQQKPHFPMVPTMGSTGFPPPPTVLHMYPPPRGQFTMPSSQDGLGLIPCYPEASPVLPRYFSPYPASFVPRRPLPVNVHKIHEKRLVGADMVELPDAAVFSRYTAPDFSGTSENAVQDNKKEEYTESSPASEQESKSHTASSSATRSPSQQLESNQDIEIMGGLRLESKKPAEQPPESSPSRVNPVLLCETGQRHHYSSVRHGDPVHRNSPQISVATSPSPIRRGDPAHINIPQISVATPPECRSPRAQAPPRFGTRMPVNLPSSLYQQRPPWLAASVTIRTTIPVCSARPNVVNSSAGAAQPAVQILSASPRKEEPEARTNTSDTSNAATASSELNKLHI

SEQ ID NO: 44710 - protein, 576 aa, Methylococcus capsulatus str. Bath
MRRFAAIHHGGEWDFPGWRPVASAFARCLLLAAAVCTAQAAGGPGHAAIASAHPLATQAGFEILDQGGNAFDAAIAISATLAVVEPQSSGMGGGGFWLLRRAADGKTVMLDGRETAPLAARPDMYLDVRGEPRPRASLDGALSAGIPGLPAALVRLSEDYGRLPLAKSLAPAIRHAENGFAVGQRYAKAAKDRESALRQSPAARAIFLDQGMAPQPGFHLVQKDLAQTLRRIARFGHAGFYGGTTARLLVQGVKDAGGIWRAGDLAGYRAVERAPVRGMYRGIRITSAAPPSSGGTVLLEALNILSGYDLARMDASTRKHLVIEAERRAYRDRDLYLGDPSFVKMPLSRLLSADYAAGLRVAIRPDRVLPSAALGTAPEPARQGDNTSHFSVIDRLGNLVAATLSINDSFGSGFVPPGTGVLLNDEMDDFATVPGRPNAYGLVGGDANAIAPGKRMLSSMSPTFLETKDRTAVLGTPGGSRIISMVLLAVLDFAEGRGPESWVSVGRFHHQYLPDVVEYEPGGLSEDDIRGLESRGHALKPTGYRYGDMQAVQWDRARNRLSAASDPRGEGAAEVK

SEQ ID NO: 44711 - protein, 386 aa, Arabidopsis thaliana
MSLRCSSSPQCSNPLLDSPPLRLPIFLLPSDNHYRTLARLITKHAWLYTEMIAAETLVHQQTNLDRFLAFSPQQHPIVLQLGGSNVENLAKAAKLSDAYGYDEINLNCGCPSPKVAGHGCFGVSLMLKPKLVGEAMSAIAANTNVPVTVKCRIGVDNHDSYDELCDFIYKVSTLSPTRHFIVHSRKALLGGISPADNRRIPPLKYEYYYALVRDFPDLRFTINGGITSVSKVNAALKEGAHGVMVGRAAYNNPWQTLGQVDTAVYGVPSSGLTRRQVLEQYQVYGDSVLGTHGNGRPNVRDLVKPLLNLFHSENGNSLWKRRADAAFKECRSVGSLLEESLRAIPDCVLDSPISGSPESGDEDVFADVHNVLPPPYEAGEEIILCA

SEQ ID NO: 44712 - protein, 341 aa, Bradyrhizobium sp. ORS278
MQTMKAAVVKAFGKPLVIEDVPVPVPGPGELLVKLKACGVCHTDLHAASGDWPVKPTPPFIPGHEAAGVVAALGAGVTDFKVGDAVGVAWLHDACLRCEYCETGWETLCEHQHNTGYSVNGGFAEYVIAAAAFAARLPANVDFARVAPILCAGVTTYKGLKETDTRPGEWVVISGVGGLGHVAIQYAKAMGLKAIGLDIAEDKLKLALEAGAAHAVNALDNDAVDRVLQITGGGAQGVLVTAVSTPAFAQALKMVRRKGTVSLVGLPPGEFPTPIFDVVLKRITVRGSIVGTRRDLDEAIAFAAEGKVKAEVTTAPLSEINTIFDRMKAGKIDGRVVLDFT

SEQ ID NO: 44713 - protein, 488 aa, Burkholderia thailandensis E264
MGKITGFLEYERRHEAYEAPLTRVKHYKEFVAALTDEDAKIQGARCMDCGIPFCNNGCPVNNIIPDFNDLVYRQDWRQAIDVLHSTNNFPEFTGRICPAPCEAACTLGINDDPVGIKSIEHAIIDKAWAQGWVAPQPAAHKTGKKVAVVGSGPAGLAAAQQLARAGHDVTVFEKNDRIGGLLRYGIPDFKLEKWLIDRRMRQMEAEGVTFRTSVFIGRDPLPESIGNMAKETISPETLKDEFDAVVIAGGSETPRDLPVPGRELAGIHFAMEFLPQQNRVNAGDKVADQLLAKGKHVVVIGGGDTGSDCVGTSNRHGAKHITQFELLPQPPEAENKPLVWPYWPIKLRTSSSHEEGCERDWAVATKRFEGKNGKVEKLIAVRVAWVDGKMQEVPNSEFEIKADLVLLAMGFTQPVAPVLEAFGVAKDARGNVRAGTEGDRAYYTSVDKVFAAGDMRRGQSLVVWAIREGRQCARSVDAYLMGGSELPR

SEQ ID NO: 44714 - protein, 298 aa, Zea mays
MGQRLLDRLAGFLLVVVVVVGVLYGGTEQRIAEAADGANPHRLLATVSVSKPSYPTVVTTPMSAYGADPASKPSYSTFPSLATGNGGAGAGAGAGGGGAAAGSGGGGGTWCVASQSASPTALQVALDYACGYGADCSAIQQGGSCFNPDTVHDHASYAFNSYYQKNPAPTSCDFGGTATITNTDPSSGSCQYPSSSGGGGAQNMVPPPSPTTTMPPTVPSTVPMTPTPTAPDTGTPVYGLSPPDYSGSTSPPGYGSTSPPDYNDVSAAAARVRQQGGAALALTLLCVVVATVSLRVSK

SEQ ID NO: 44715 - protein, 157 aa, Pseudomonas syringae pv. phaseolicola 1448A
MRIGHGYDVHRFAEGDFITLGGVRIAHGFGLLAHSDGDVLLHALSDALLGAAALGDIGKHFPDTDPQFKGADSRVLLRHVLKQIHGKGWKVGNVDATIVAQAPKMAPHIDAMRALIAEDLQVELDQVNVKATTTEKLGFTGREEGIAVHAVALLLRA

SEQ ID NO: 44716 - protein, 432 aa, Enterococcus hirae
MSIITDVYAREILDSRGNPTIEVEVYTESGAFGRGMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALAAILKSRGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKAA

SEQ ID NO: 44717 - protein, 474 aa, Clostridium perfringens ATCC 13124
MQKTKMIFTIGPASDSEEILREFIRIGMNAARLNFSHGDHASHKEKIELIKRLRKEEKSATAILLDIKGPKIRTHNFKNGEAELKNGDEFTFSCGDEILGDNTKCSISYKELYEDIKPGGSILVDDGLLEFKVKEVRGTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFQIAETGDNIMVAAGFPTSITGGTNMLKIEKI

SEQ ID NO: 44718 - protein, 399 aa, Clostridium perfringens ATCC 13124
MLSYEFLFDLALILISTKLFGLITKKVRMPQVVGALVAGVILGPAVLNVLSETEFIQKLAELGVIVLMFTAGLETDINQLKKTGKASFIIAVLGVIIPLAGGFFIASIFNKGNDVNTILQNVFIGIILTATSVSITVETLKEMGKLNTRAGNAILGAAIIDDILGIIALTITTSLADPSINVIIVLAKIVMFFIFAGFAGYLFHWAFIKLDERYQRDLRRFVIIAFVFCLLLSFCAEEFFGVADITGAFIAGLVISDSNRSKYLNSRFETLSYMLLSPIFFASIGIKVQLTAMTKTIFIFAILLLIVAILSKVLGCALGAKLCKYSNREAIQIGTGMISRGEVALIVANKGIAMGLMLPEFLAPVVIVVVVTTIVTPILLKVVFNNKSKSVDLNVKANV

SEQ ID NO: 44719 - protein, 359 aa, Capsicum chinense
MGSINQSLTQTEDEAFVFAMQLASASVLPMVLKATVELDLLEIMAKSGPGAFISPSELAAQLPTKNPEAPVMLDRMFRLLATYSVLNCTLRTLPDGRVERLYSLAPVCKFLTKNGDGVSIAPILLMNQDKVLMESWYHLTDAVLDGGVPFNKAYGMTTFEYHGTDPRFNKVFNCGMSDHTTLSMKKILEDYTGFEGLNSIVDVGGGTGATVNMIVSKYPSIKGINFDLPHVIRDAPSYPGVEQVGGDMFVSVPKADAIFMKWICHDWSDDHCIKLLKNCYEALPANGKVIIVECILPEAPDTSAATKSKVHGDIIMLAHNPGGKERTEKDFEALANWGWFSRFRKVCCAYHTWVMEFNK

SEQ ID NO: 44720 - protein, 390 aa, delta proteobacterium MLMS-1
MAISRKMAEFAESSSWIRRMFEEGARLKARYGEEQVCDFSLGNPDLPPPPLFGQALARLATASEAGAHSYMPNGGYPWVRAAVAAQLSGEQDCELSADEVLMTVGAAGGLNVALKALLDPGDEVLILAPYFVEYHFYIDNHGGIAKVVDTGEDFGPNPAAVAAAITPRTKAIIINSPNNPTGRIYTAAELRELVAVLKQAPRAIYLIADEPYRKITFDGHQVPAILPLYRHSMVVSSYSKDLSLPGERIGYLAVNPAIDDKPDLLAALTLANRILGYVNAPALMQKVVAELQGVTVDTGVYHRRRELFCRLLGEACYQFMPPMGAFYLFPQSPLADDAEFVRLLAAERILAVPGRGFGRPGYFRLSFCVADEVISRAAAGFQAARAQALA

SEQ ID NO: 44721 - protein, 362 aa, Saccharum officinarum
MGSTAEDVAAVADEEACMYAMQLASASILPMTLKNALELGLLEVLQAEAPAGKALAPEEVVARLPVAPTNPDAADMVDRMLRLLASYDVVKCQMEDKDGKYERRYSAAPVGKWLTPNEDGVSMAALTLMNQDKVLMESWYYLKDAVLDGGIPFNKAYGMTAFEYHGTDPRFNRVFNEGMKNHSVIITKKLLEFYTGFEGVSTLVDVGGGIGATLHAITSHHPQIKGINFDLPHVISEAPPFPGVQHVGGDMFKSVPAGDAILMKWILHDWSDAHCATLLKNCYDALPENGKVIIVECVLPVNTEAVPKAQGVFHVDMIMLAHNPGGRERYEREFHDLAKGAGFSGFKATYIYANAWAIEFIK

SEQ ID NO: 44722 - protein, 382 aa, Vibrio fischeri ES114
MALDIKPGQTHIKSKAMVAWAAGEPLKMEEVDVQLPKAGEVLVRIVATGVCHTDLFTLSGDDPEGIFPSILGHEGGGIVEMVGEGVTGLEVGDHVIPLYTAECGECKFCKSGKTNLCQAVRETQGQGLMPDGTSRFSINGETIFHYMGCSTFSEYTVLPEISLAKVSKDAPLEEVCLLGCGVTTGMGAVLNTAKVEKGDTVAVFGLGGIGLSAIIGAKMAGASRIIGVDLNESKYELAKKLGATDCINPMNYDKPIQEVIVEMTDGGVDYSFECIGNVNVMRSALECCHKGWGESIIIGVAGAGQEISTRPFQLVTGRVWRGSAFGGVKGRTELPGIVDRYMQGEFALDDFITHTMGLADVNAAFDLMHEGKSIRTVLHMDK

SEQ ID NO: 44723 - protein, 321 aa, Zea mays
  misc_feature (51)..(51): Xaa can be any naturally occurring amino acid
MAATTHAASMSFLLSHPQSRSATPSRHLPLRPAARRVRCATAAAAFPRRSXTKHRRTADENIREEAARHPAPKQGLSAWYEPFPPAPNGDPNERYSLDEIVYRSSSGGLLDVRHDMEALARFSGAYWRDLFDSRIGRTTWPYGSGVWSKKEFVLPEIEPDHIVSLFEGNSNLFWAERLGRDHLGRMNDLWVKHCGISHTGSFKDLGMTVLVSQVNRLRAPLSRPIAGVGCASTGDTSAALSAYCAAAGIPAIVFLPANRISLEQLIQPIANGATVLSLDTDFDGCMRLIREVTAELPIYLANSLNSLHLEGQKTAAIEILQ

SEQ ID NO: 44724 - protein, 434 aa, Mycobacterium tuberculosis CDC1551
MIAIGGVIGAGLFVGSGVVIRATGPAAFLTYALCGALIVLVMRMLGEMAAANPSTGAFADYAAKALGGWAGFSVGWLYWYFWVIVVGFEAVAGGKVLTYWIDAPLWLASLCLMMMMTATNLVSVSSFGEFEFWFAGVKVATIVGFLVLGTAFAFGLLPGHGMDFSNLSAHGGFFPDGVGAVFAAIVVAIFSMTGTEVVTIAAAEAPDPQRAVQRAMSTVVARIVIFFVGSVFLLTVILPWNSLELGASPYVAALRHMGIGGADQIMNAVVLTAVLSCLNSGLYTASRMLFVLAARQEAPAQLVKVNRRGVPTFAIMGSSVVGFLCVIMAWVSPATVFVFLLNSSGAVILFVYLLIALSQIVLRRQTSGQNLGVRMWLFPGLSIVTVTGIVAVLARMAFDYAARSQLWLSLLSWAVVVGCYLVTTLVRRPLNRPW

SEQ ID NO: 44725 - protein, 342 aa, Xanthobacter autotrophicus Py2
MIRNGLVDSIGNTPLIRLKRASEETGCEILGKAEFLNPGQSVKDRAALGIIKDAVARGALKPGGVIVEGTAGNTGIGLALVAAPLGFRTVIVIPETQSQEKKDMLKLAGAILVEVPAVAYANPNNYVKVSGRLAEALAKTEPNGAIWANQFDNVANRQAHIETTGPEIWEQTCGKLDGFICAVGTGGTLAGIAIALKARNPNIRIGLADPMGAALYSYYTTGELKAEGSSITEGIGQGRITANLVDAPIDTAFQIPDEEALPVVFDLLQHEGLCLGGSSGVNVAGAIRLAKEMGPGHTIVTILCDYGTRYQSKLFNPEFLRSKNLPVPEWLERKVEVPNVLV

SEQ ID NO: 44726 - protein, 210 aa, Zea mays
MASRCAARLPHPPCAAPHHGWASSRVSARPAQSGASRGRAVVCAVSFRPCIDIHKGKVKQIVGSTLRDASDDGTALVTNFESDKSPAEFANIYKEDGLVGGHVIMLGGDPASRSAALEALHAYPGGLQVGGGINLENAMSYLNEGASHVIVTSYVFSDGKMNIERLTQLVELVGKERLILDLSCRKKDGRYAIVTDRWQKFIDVLVDGPT

SEQ ID NO: 44727 - protein, 338 aa, Xanthobacter autotrophicus Py2
MSVLVTGGAGYIGSHAVLELVGRGESVTVLDDLSTGFDWAVPEAIDLVVGDVGDAVFMRRLLEERGITEIIHFAARSLVAESVADPLGYYFGNIVKTRTLIQTAIEAGVTRMIFSSSASVYGEPVVDIIGEDEPTVPINPYGRSKLASEWMLEDAARAHGLVYTALRYFNVAGADPLGRSGQSSRVATHLIKIASQVAAGARPGLEIYGTDYPTRDGTCIRDYIHVTDLARAHVAALERLRAGGGSLKVNCGYGRGYSVKEVVDVVKEVSGIDFPVTLSPRRPGDPACLVARADRVRAELGWEPTLDHLPTIVGHAIEWEKRLERRKAAQRAAASSVA

SEQ ID NO: 44728 - protein, 185 aa, Zea mays
  misc_feature (172)..(172): Xaa can be any naturally occurring amino acid
MMSQAAMQAEKAVGHGDNATTTQDVTNPGNNEAWADNSEKMKALAWFGKNDVRMVETPKPKVIEPRDVIVKVTGSTVCGSDLHLLHGSVVEMQKGDILGHEFCGVVDECGSEVTKFKKGQRVVASFQIACGECYYCKQKLSSQCEKTNSNTIENTMYGGRTAGMFGYSHFTXGFAGGQAEYTRVP

SEQ ID NO: 44729 - protein, 294 aa, Mycobacterium tuberculosis CDC1551
MSRIEALPTHIKAQVLAEALPWLKQLHGKVVVVKYGGNAMTDDTLRRAFAADMAFLRNCGIHPVVVHGGGPQITAMLRRLGIEGDFKGGFRVTTPEVLDVARMVLFGQVGRELVNLINAHGPYAVGITGEDAQLFTAVRRSVTVDGVATDIGLVGDVDQVNTAAMLDLVAAGRIPVVSTLAPDADGVVHNINADTAAAAVAEALGAEKLLMLTDIDGLYTRWPDRDSLVSEIDTGTLAQLLPTLELGMVPKVEACLRAVIGGVPSAHIIDGRVTHCVLVELFTDAGTGTKVVRG

SEQ ID NO: 44730 - protein, 169 aa, Triticum aestivum
  misc_feature (57)..(57): Xaa can be any naturally occurring amino acid
  misc_feature (77)..(77): Xaa can be any naturally occurring amino acid
  misc_feature (87)..(87): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(108): Xaa can be any naturally occurring amino acid
  misc_feature (120)..(120): Xaa can be any naturally occurring amino acid
  misc_feature (126)..(126): Xaa can be any naturally occurring amino acid
  misc_feature (135)..(135): Xaa can be any naturally occurring amino acid
  misc_feature (138)..(138): Xaa can be any naturally occurring amino acid
  misc_feature (142)..(142): Xaa can be any naturally occurring amino acid
  misc_feature (148)..(148): Xaa can be any naturally occurring amino acid
QKLARLAKLAKKTSVFDDPTLEIQELTAVVKKDIGALNNAVMDLQVLCNSQNESGNXSKDTTNHPLPLWTTWKNRLXMSATKESKEXFTMRTRDLKAHGKQKQXLXPXTAKEHQSHSIRXRPLFPXRASDTAPPXPWXMILXYPLFQXEERNWTSSLQTTHGSHYSSTN

SEQ ID NO: 44731 - protein, 501 aa, Corynebacterium glutamicum ATCC 13032
MNTQSDSAGSQGAAATSRTVSIRTLIALIIGSTVGAGIFSIPQNIGSVAGPGAMLIGWLIAGVGMLSVAFVFHVLARRKPHLDSGVYAYARVGLGDYVGFSSAWGYWLGSVIAQVGYATLFFSTLGHYVPLFSQDHPFVSALAVSALTWLVFGVVSRGISQAAFLTTVTTVAKILPLLCFIILVAFLGFSWEKFTVDLWARDGGVGSIFDQVRGIMVYTVWVFIGIEGASVYSRQARSRSDVSRATVIGFVAVLLLLVSISSLSFGVLTQQELAALPDNSMASVLEAVVGPWGAALISLGLCLSVLGAYVSWQMLCAEPLALMAMDGLIPSKIGAINSRGAAWMAQLISTIVIQIFIIIFFLNETTYVSMVQLATNLYLVPYLFSAFYLVMLATRGKGITHPHAGTRFDDSGPEISRRENRKHLIVGLVATVYSVWLFYAAEPQFVLFGAMAMLPGLIPYVWTRIYRGEQVFNRFEIGVVVVLVVAASAGVIGLVNGSLSL

SEQ ID NO: 44732 - protein, 335 aa, Burkholderia thailandensis E264
MLSMKVAVLGAGAWGTALAAHLAARHDTLLWARDAALVAELAARRENVRYLDGVALPPALRYEADLTAALSHAQADDALCVIAAPVAGLRALCRAMRDAGRVPAHFVWVCKGFEADTRLLPHQMVAEELPDHASYGVLSGPSFAREVAQGLPVALTVASASAACRGRTLAAFHHGAMRIYTGDDVVGVEVGGAVKNVLAIATGIADGLGLGLNARAALVTRGLAEMSRLGVALGGRAETFTGLTGLGDLILTATGDLSRNRTVGLQLAAGRSLDDILAALGHVAEGVRCARAVLSIARERGVDMPITEAVCAVLFDGVAPRDAVSGLLRRDAKAE

SEQ ID NO: 44733 - protein, 425 aa, Corynebacterium glutamicum ATCC 13032
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 44734 - protein, 197 aa, Zea mays
  misc_feature (57)..(57): Xaa can be any naturally occurring amino acid
  misc_feature (92)..(92): Xaa can be any naturally occurring amino acid
  misc_feature (119)..(119): Xaa can be any naturally occurring amino acid
  misc_feature (143)..(143): Xaa can be any naturally occurring amino acid
  misc_feature (172)..(172): Xaa can be any naturally occurring amino acid
ADLNGKKVFVRTDLNVPLYNAHKIADDSRIHAVVPIINVLLEKGAKVILESHLCRPXCAAPFDRLDPLVPHLSELLGAEVAMANDCIAEDLXELAVALPEGAVQLLDDVLFYIEEDTIXTDVANNLPSAADLYAIDAFGAAFXARDCTGGDIWYFNPAVAGFLMQKDLTYLXGTVAQPKNPFAATVREYVPQGELRH

SEQ ID NO: 44735 - protein, 659 aa, Prosthecochloris aestuarii DSM 271
MTKLPCFHETDAYRSLNTINSPEDLKRFKPSELQQIADECRSYLIDVIAENGGHFASSLGVVELTVAMHYVFDSPKDKFIWDVGHQAYIHKILTGRRDLMHTNRRFNGLAGFPKIHESRHDAFGTGHASTSISAAAGMAAARDLEGGNEKIIAVIGDGSMTGGMAFEAMNHLGDLKSDVLVILNDNQMAISPSTGGLRDYLINISLNKTYNKLRQFVWNSLSLINNDVGDAAKTAIHKIEDGIKASLTPGAFFEALGFRYFGPIDGHNMDQLVKAMKEMQALPHPKLLHVITKKGKGFLPAEQNQSAWHAHSGGFDRTTGESLKPSQKKSPPKYQEIFGEALTEIATNDRKIVGITAAMPSGTSLDIFQKAHPRRFYDVGIAEQHAVSFAAGLAAHGYKPVCAIYSTFLQRAYDQLIHDVALQNQHVIFAIDRAGLVGEDGPTHHGSFDLSYLHPVPNMVIMAPKDGQELRDMLYTALEHHHGPSAIRYPRGQAAAMELRKEFKAIAIGKGEIIREGNDIAILAIGSMVGHALQAAEILEAKGIDPLVANMRFVKPLDTQLLDTIASSHEKIVVIEENSVIGGLGSGIGDALQKKGMKNKVFKIGLPDQFVTHGSMNELYSMLGLDRNGLAETVIKIYNGSSNAVNDSAQTMIRTERLA

SEQ ID NO: 44736 - protein, 193 aa, Thermotoga maritima MSB8
  misc_feature (1)..(1): Xaa can be any naturally occurring amino acid
  misc_feature (23)..(23): Xaa can be any naturally occurring amino acid
  misc_feature (34)..(34): Xaa can be any naturally occurring amino acid
  misc_feature (43)..(43): Xaa can be any naturally occurring amino acid
  misc_feature (76)..(76): Xaa can be any naturally occurring amino acid
  misc_feature (115)..(115): Xaa can be any naturally occurring amino acid
  misc_feature (182)..(182): Xaa can be any naturally occurring amino acid
XGSSHHHHHHSSGRENLYFQGHXTDQIREHLVSXLVHNKPGVXRKVANLFARRGFNISSITVGESETPGLSRLVIXVKGDDKTIEQIEKQAYKLVEVVKVTPIDPLPENRVEREXALIKVRFDEDKQEIFQLVEIFRGKIIDVSREGAIIEITGARSKVEAFINLLPQKQVEEIARTGIVAXNRWNVKEGEGF

SEQ ID NO: 44737 - protein, 512 aa, Pseudomonas syringae pv. phaseolicola 1448A
MPHTTVPTQPLSEVYDIAVIGGGINGVGIAADASGRGLSVFLCEKDDLASHTSSASSKLIHGGLRYLEHYEFRLVREALAEREVLLTKAPHIVKPMRFVLPHRPHLRPAWMIRAGMFLYDNLGKREKLPASKTIRFGADSPLNSSITRGFEYSDCWVDDARLVVLNALAARENGAHIHTQTRCVSARRIKGMWHLHLERSDGSLFSIHAKALVNAAGPWVAKFIREDLKLDSAYGIRLIQGSHLIVPKLYEGEHAFILQNEDKRIVFTIPYLEHFTIVGTTDREYQGDPNKVDITEGEMDYVLKVANDHFKKQLSRADVLHTFSGVRPLCNDESDNPSAITRDYTLSLSGGADEAPILSVFGGKLTTYRKLAESTMTQLAPFFKQMKPSWTAKAALPGGEDMSTPEALAAEMTRRFSWLPTPIAKRWAITYGSRSWRLLEGAQGLEDLGQHLGAGLYTREVDYLCDQEWATSIEDILWRRTKLGLFTTPEEQAAVRSYLETVVRNKAAIEAA

SEQ ID NO: 44738 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTGVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 44739 - protein, 368 aa, Nocardia farcinica IFM 10152
MRIRGAVLERIAAPAPFAESAPINVCELELGEPGPGELLVRIEAAGLCHSDLSVVDGNRVRPVPMLLGHEAAGRVEAVGPGDSDVAVGQRVVMTFLPRCGECAGCASQGRMPCVPGSVANNAGELLGGGRRLIRDGAPVHHHLGVSAFATHAVVDRRSVVPVPDDVPPEVAAVLGCAVLTGGGALLNSAKPGPADRIMVVGLGGVGMAAVLVAVSLGAPEVIAVDTVPEKLALARELGASAAYTPAEVAERGIVAEVVVEAAGNVRAFETAVAATAAGGTTVTVGLPAPDARASIAPLGLVAQGRSIVGSYLGSAVPARDIPEYVRMWRAGTLPVERLVSAHIGLDEINRAMDELAAGHALRQVIVFD

SEQ ID NO: 44740 - protein, 468 aa, Oryza sativa Indica Group
MASVDLTPRQARKAYGGDGGTYYEWSPADLPMLELANIGGAKLSLNAGGLALPSFSDSGKVAYVLQGKGTCGIVLPEASKEKVIAVKEGDSLALPFGVVTWWHNLPESPIELVILFLGDTSKAHKAGQFTNMQLTGATGIFTGFSTEFVGRAWDLAESDAVKLVSSPLPPASSRSSKGTCGIVLPEASKEKVIAVKEGDSLALPFGVVTWWHNLPESPIELVILFLGDTSKAHKAGQFTNMQLTGATGIFTGFSTEFVGRAWDLAESDAVKLVSSQPASGIVKIKSGQKLPEPSAADREGMALNCLEAPLDVDIKNGGRVVVLNTANLPMVKEVGLGADLVRIDGHSMCSPGFSCDSAYQVTYFIRGSGRVQVVGADGKRVLDTHVEGGNLFIVPRFCVVSKIADASGLQWFSIITTPNPIFSHLAGKTSVWKAISPEVLEASFNATPEMEKLFRSKRLDSEIFFAPN

SEQ ID NO: 44741 - protein, 456 aa, Nocardia farcinica IFM 10152
MSKKKTTTPLIPSGQGGPSLRQRVDEAVDSGVRRTVLPGGLRVVTEHVPGVRSASIGVWVGVGSRDEGRTVAGAAHFLEHLLFKATPTRSALDIAQAMDAVGGELNAFTAKEQTCYYAHVLDEDLPLAVDMVSDVVLNGLCRSADVDVERQVVLEEIAMRDDDPEDLVGDAFLTALFGDHPIGRPVIGSVESIESMTAAQLRGFHQRRYRPDRMVVAVAGNVEHEHTVELVHRAFENRLDPAAQPAPRREGRFRPHGAPELQWSFRDSEQAHLVFGVRAFGRHEGERRWPLSVLNTVVGGGLSSRLFQRIREERGLAYSVYSSVDTFADTGAFSVYIGCQPENLGEVARLAKGVLEEVAEHGVTDAECARAKGSLRGGLVLGLEDSASRMNRIGRSELSYGNHRSVSETLARIDAVTTEEVAAIARTLLSRPFGVSVAGPYRRTRDLPAAVRRLVA

SEQ ID NO: 44742 - protein, 136 aa, Triticum aestivum
RGRGRGIDATGRFDVLSKADGVPLVAIRLKDSTNFSVFDISENLRRFGWIVPAYTMPADAEHVAVLRIVIREDFNRSLAQRLLTDINKIVGELDAHAVHAIKLSTAAAAEGASKSTVDAVTEAFKGLAGNKKAGVC

SEQ ID NO: 44743 - protein, 197 aa, Corynebacterium efficiens YS-314
MTETDMDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 44744 - protein, 500 aa, Schizosaccharomyces pombe 972h-
MTIDLNVIQSDIISARRAPENSLFIDGKFVSPIEPAAKPIPLINPATEEIIGTCANASAKDVDSAVENAYNTFRSGIWAKWPGKQRGLVLRKIAKMMREKRELLAGIDTINCGKPTPYALFDIDSCADMFEYYAEVAETDNPTVKVPLPNNPGFCAFEKRFPRGVIGVITPWNFPLKMALWKLVPAIASGNCVVLKPSELAPWSCLEFALICKEAGLPDGVLNVIIGSGKESGAALSCHPKIAYLAFTGSLATGKKIMHAAAENIVPLTLELGGKSPLIICEDADLSLAIPSAAFAIFFNQGEACTAASRLIVHESVADEVLGGLVSEANKLIIGNGLDPQVTLGPVVSKTQFEKIVSYIQSAINEGCKCVVGGLPRSEQKGYFIPPTVFTNVQTHNKIWREEIFGPVLAVKTFHTNEEALELANDSEYGLGSGVFSTNPKTLEFFSNNIEAGMCSLNNYHVVTHELPWIGWKHSGLGVGLSKHGYNEYMRLKQITQYVG

SEQ ID NO: 44745 - protein, 235 aa, Triticum aestivum
  misc_feature (158)..(158): Xaa can be any naturally occurring amino acid
PRVVERSLSFHLANKLCSSTLLSTLLYDLFVGSLAAHPTIRAAAVADLLAVRSRDPACAGFSHCLLNYKGFLAVQAHRVAHVLWAQNRRALALALQSRVAEVFAVDIHPAAAIGKGVLLDHATGVVIGETAVVGDNVSILHHVTLGGTGKAVGDRHPXKIGDGVLIGAGATILGNVLIGAGAKIGAGSVVLIDVPPRSTAVGNPARLIGGKKGDDMPGESMDHTSFIQQWSDYTI

SEQ ID NO: 44746 - protein, 436 aa, Mycobacterium tuberculosis CDC1551
MRTYRTVRYPLGEALLALYRWRGPLINAGVGGHGYTYLLGAEANRFVFANADAFSWSQTFESLVPVDGPTALIVSDGADHRRRRSVVAPGLRHHHVQRYVATMVSNIDTVIDGWQPGQRLDIYQELRSAVRRSTAESLFGQRLAVHSDFLGEQLQPLLDLTRRPPQVMRLQQRVNSPGWRRAMAARKRIDDLIDAQIADARTAPRPDDHMLTTLISGCSEEGTTLSDNEIRDSIVSLITAGYETTSGALAWAIYALLTVPGTWESAASEVARVLGGRVPAADDLSALTYLNGVVHETLRLYSPGVISARRVLRDLWFDGHRIRAGRLLIFSAYVTHRLPEIWPEPTEFRPLRWDPNAADYRKPAPHEFIPFSGGLHRCIGAVMATTEMTVILARLVARAMLQLPAQRTHRIRAANFAALRPWPGLTVEIRKSAPAQ

SEQ ID NO: 44747 - protein, 432 aa, Streptomyces coelicolor A3(2)
MSAPSRFDRGHTDDLMTFLSASPTPYHAVASAAARLEKAGFRQVAETDAWEATSGGKYVLRGGAIVAWYVPEGAAAHTPFRIVGAHTDSPNLRVKPRPDTGAHGWRQVAVEIYGGPLMNSWLDRDLGLAGRLSLRDGSTRLVDVDRPLLRVPQLAIHMDRNVSTEGLKLDKQRHLQPVWGLGDSVRDGDLIAFLEDEAGLARGEVTGWDLMTHSVEPPAYLGRDRELVAGPRMDNLLSVHAGTAALASVAASGADLPYIPVLAAFDHEETGSQSDTGADGPLLGGVLERSVFARGGSYEDRARAFAGTVCLSSDTGHAVHPNYAERHDPTHHPRINGGPILKVNVNNRYATDGSGRAVFAAACEKADIPFQTFVSNNSMPCGTTIGPITAARHGISTVDIGVAILSMHSARELCGADDPHLLANALVAFLQP

SEQ ID NO: 44748 - protein, 492 aa, Vitis vinifera
MASLSNSVKLKYIKLGYQYLVNHILTFFLIPILMGFLIKILSLGPDQIYEIGSSLHFDLLQFLGSSLMIIFLATVYFMSKPRSVYLVDYACFKPPASYRVPHATLVKHLRLSNKDNPEIVEFQRRILQRSGLGDETCLAPANLYIPPTPSLEASRAEAELILFSVIDDLLKKTGTKTKDIDILIVNCSIVSPTPSLSAMVINKYKLRSNIKSFNLSGMGCSASLISIDLARELLQVHPNSCAIVVSTEITTPNYYSGNERSMVLINCLFRMGGAAILLSNKKADRSRSKYQLLHLVRTHKGADDKAYRCIHEQEDTQGIQGVSLSKDLMLIAGEALKSNITTIGPLVLPASEQLNFLFTLIGQKILKLKWKPYIPDFKQAFEHFCIHAGGRGVIDELQKKLQLSAKDVEASRMTLHRFGNTSSSSIWYEMNYIESKGRMKKGDRIWQIAFGSGFKCNSAVWKCNRTITTPTDGPWLDCIGRYPVSISQVLDL

SEQ ID NO: 44749 - protein, 640 aa, Vitis vinifera
MISLNSSSFLSNSGFSGISRSVSQRKVLPPVVLALGSNGRAGELNVSAVMESTLKELRDGNTVLEVDSKSAVSGGVRDVQGEDAATEDQIVTPWTITVASGYSLLRNPHHNKGLAFTEKERDHHYLRGLLPPAVVSQDLQVKKLMANIRQYTVPLQKYMAMMDLQERNEKLFYKLLMDNVEELLPVVYTPTVGEACQKYGGILRRPQGLFISLNEKGKILEVLKNWPEKNIQVIVVTDGERILGLGDLGCQGMGIPVGKLSLYTALGGVRPSACLPVTIDVGTNNQKLLDDEFYIGLRQKRATGQEYAELIHEFMCAVKQNYGEKVLVQFEDFANHNAFDLLARYGTTHLVFNDDIQGTASVVLAGLISALNLVGGTLAEHTFLFLGAGEAGTGIAELIALEMSKQTQAPLEETRKKIWLVDSKGLIVSSRMDSLQHFKKPWAHEHEPIKNLVDAVKAIKPTVLIGSSGVGRTFTKEVVEAMASFNEKPIILALSNPTSQSECTAEEAYTWSEGRAIFASGSPFDPVEYNGKVFVPGQSNNAYIFPGFGLGLIISGAIRVHDDMLLAASEALAKQATQENFDKGMIYPPFSNIRKISAHIAANVAAKAYELGLATRLPQPENLVEYAENCMYSPAYRSFR

SEQ ID NO: 44750 - protein, 957 aa, Chlamydomonas reinhardtii
MATIQLTDQQRKVLHEVACTTAAPVLDTASKDKIKQLLDDYDMRKAAMGSKPGANMVLPGQVLGEAGPFLDYGHPPGVALGDKFKDRGQVMVAGVHGTTVRGIHAPNAGSEHFVRGAYSVLMSGVYVDDEDMGEAFWYTGEGGMDGKKQVKDQQMASGSNAALKNNCDTRTPVRVVRGFVQEAGGGEGGGGGEGGGGAKKGKGGKGGGKKEKGLVYEGLYLVLECKMEPSKDGPQVCKFLMHGLPGHSTVSAKVEYNIFGNAGSAYSLHARRLAGAGAPAGGKRARKAAQDEKARELARQWMLSEIRRQYPGPELQLEDVSGGQEAVPIPVINQVNSERLPTDFAYTREYAWAPGVYQLVAPALRLADEEMLQFSREGDRGGVCGIAFNRHIAALDRRLEQEGRLPQGYEAHLEEQYNAAGCLMVTDPCGVHECGDGCSAKACRRNMQLSAGVQLPLEVFMTESKGWGVRCREEVPAGAFVCCYVGQLITDAMAEVRKGVDHYLFDLDFFAHIYAEIAEKGMQAVAEEIPLHKIPPVLSVGMIRQAQINAADAARRLPEQQPQQQQPQQQQQQPAAGGAAPGGAAAGEQAAGGAEGGGAYGGGGAAAAATAAGTAPGAGDNMDGVEGPAAQRSGGEEAAAGPGSSGAAGGCGYRLDGMVTREGLAQAAHALAEACDALARSVADGASTNLGGENILAAIEAAKARAAAAATTSGGAAAADQHQLEQLDRAAALAAASKAAADAVKAGDPGAFYLQPIISRDEEKAAERAAAAAAAAAAAAGVPPALPSTSDVGNGGTTGSGGGGGAFSNRGPAGCAVGSPRALAARSGMEAAAQAAGGAASGPVAGPGAVEDHGEEYAPMLVIDARTTGNVGRFINHSCDGNLTIQAVFAGVYRSTLLYHVGLYACRNIPQLEELSYNYGYHKQQQQQQQAQRGGAAEKQFVMQCNCGAVGCIGNLM

SEQ ID NO: 44751 - protein, 232 aa, Zea mays
  misc_feature (209)..(209): Xaa can be any naturally occurring amino acid
MPKRTTHTYSSEDALPEGPESDLFVYYCKHCASHVLITDTQLQKMPKRRTDRAHVLDKAKHLSRLNVKEAGKVMLKRGEGKLEKQFRMSCVGCDLFVCYRSEEDLEVSPFIYVIDGALSSVAAETNPHDAPVPPCITQLEGGLVQVAIEVEDRAQRSAITRVNADDVRVTVAALAARGEANSELLEFMGKVLGLRLTQMTLQRGWNNNXKLLIVEDLSARQVYEKLLEAVQS

SEQ ID NO: 44752 - protein, 101 aa, Triticum aestivum
  misc_feature (15)..(15): Xaa can be any naturally occurring amino acid
  misc_feature (33)..(33): Xaa can be any naturally occurring amino acid
  misc_feature (69)..(69): Xaa can be any naturally occurring amino acid
RVLDFTNVARLAARXPGTLENGCLRYTAQYMIXKSLIWRDCLCPWNTHPTRTVIPQTFIVEGNFHDITXNVGDCVALADAEDTREHLQDTCHLVNEYFCHP

SEQ ID NO: 44753 - protein, 590 aa, Burkholderia thailandensis E264
MSFTLHGIPVSRGIAIGRAYLIAPAALDVAHYLIEAERIEAEIERFRAALDAVRRELDALRADLSDDTPTEVAAFIDVHAMILGDAMLVQETIDLIRTRRYNVEWALTEQLDVLAGHFDDIEDEYLRERRADIEQVVERVLKALAGAPSAAQALDRAAGNGRDEMIVVAHDIAPADMMQFKTQSFQAFVTDLGGRTSHTAIVARSLGIPAAVGVQHASALIRQDDLIIVDGDQGIVIVDPAPIVLEEYSYRQSEKALEQRKLQRLKFSPAQTLCGTKIDLLANIELPDDAKAAVDAGAVGVGLFRTEFLFMSKERMPEEEEQFAAYKRAVELMHGMPVTIRTIDVGADKPLDAHDEGYETAPNPALGLRAIRWSLSEPQMFLTQLRAILRASAFGQVKILVPMLAHAQEIDQTLDLINEAKRQLDAAGLAYDPNVRVGAMIEIPAAAIALPLFLKRIDFLSIGTNDLIQYTLAIDRADNAVAHLYDPLHPAVLHLIAFTLREAKRAGVPASVCGEMAGDPALTRLLLGMGLTEFSMHPSQLLVVKQEILRAHLKALEKPTADVLAAFEPEEVQAALKRLASAEPKADVAA

SEQ ID NO: 44754 - protein, 469 aa, Novosphingobium aromaticivorans DSM 12444
MKALPQDAIYRPSPRIMALADWIGDPVQAADFPETRLRWRNDRAAAEIGLATLDDAAWTRAFGRFEPLPDNMPGPLALRYHGHQFRVYNPELGDGRGFTFAQMLDGSDRLMDLGTKGSGQTPWSRRGDGRLTLKGAVREILATEMLGALGVNTSRTLSVIETGESLWRGDEPSPTRSAVLVRLSHGHIRIGTFQRLSVLELDDEMAQLVAYCLANFPGSAFADAPHPAVRFYNQVIERMADMAASYMVAGFVHGVLNSDNMNVTGESFDYGPWRWLPTWDPGFTAAYFDHAGLYAFGRQPEAIHWNCGQLAVALRSLVEAPPLVEALNRFPDLYQQAMARRWCWRLGVEPRGIEQDTALIGACEKVMVSEKLGPDAFFFTHRGGRGPFADSSDGAALREMVALYEASPDDHPYWSDEAPQSLLIDEVEAIWEPIATGDDWSALHAKVAALRRMGEALGPRPEPWGHATA

SEQ ID NO: 44755 - protein, 387 aa, Oryza sativa
  misc_feature (126)..(126): Xaa can be any naturally occurring amino acid
  misc_feature (128)..(128): Xaa can be any naturally occurring amino acid
  misc_feature (144)..(144): Xaa can be any naturally occurring amino acid
  misc_feature (194)..(194): Xaa can be any naturally occurring amino acid
  misc_feature (345)..(345): Xaa can be any naturally occurring amino acid
MKKATLSLLSKHLNPASKVVVRADFNVPIKDGKVTDVNRIKSTVPTINELLRHNPKSLVLLSHLGRPNGQKNAKHSLKPVVSHLESYLGRPVTFLEDCVGEGIIDQVNRSKNGEIFLCENVRFHPXNXGSIKDKDGKKIKSKPXAIESFRQQLSSLGDVYVNDAFGSAHRAHSSVVGIKHKFRVAGLLMQKELXYLGGFLQSPKKPVLVILGGSKVTDKIELILNMINIADEIIIGGGMSNPFLKQFYGHKLGITQTDMPKDPNTLQQIMDKAKAKGVKIHLPVDGVCAKEYNPNAPTIICKNENVSDDYEIFDKVPEFVKYFDEVVKRANSIFWNGPIGIFWVXNFKNGSEGLLKSVIEKTKGWGHPNYLGGRETWQFWVFEPAGA

SEQ ID NO: 44756 - protein, 195 aa, Robiginitalea biformata HTCC2501
MGMTPNIIEERQLNAIAMDVFSRLMMDRIIFLGTGISDQVANIVQAQLLFLASADSSKDIQIYINSPGGSVYAGLGIYDTMQFIKPDVATICTGMAASMAAVLLCAGEKGKRSGLQHSRVMIHQPLSGAQGQASDIEIAAREVLKIKDELYQIISKHSGQPFDRIQEDSDRDYWMKAGEALEYGMIDEILERDKD

SEQ ID NO: 44757 - protein, 303 aa, Solanum neorickii
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELDQTHLSTVVKGTLGYLDPEYFIKGRLNEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 44758 - protein, 841 aa, Arabidopsis thaliana
MPLCNNFSGNLVVAVALFFAGALYIFNYQNYVNTLRTTQYPVDELEAALYTAAAGNNKTVIITMVNKAYVKEVGRGSTMLDLFLESFWEGEGTLPLLDHLMVVAVDQTAYDRCRFKRLHCYKMETEDGVDLEGEKVFMSKDFIEMMWRRTRLILDVLRRGYNVIFTDTDVMWLRSPLSRLNMSLDMQISVDRINVGGQLINTGFYHVRSNNKTISLFQKWYDMRLNSTGMKEQDVLKNLLDSGFFNQLGLNVGFLSTTEFSGFCQDSPHMGVVTTVHANCCLHIPAKVFDLTRVLRDWKRYKASHVNSKWSPHLKCSPNVSMRIFRFTSISPRILPSNHYSTFPLKQNVSSLSPAKYIAGALQEHINSPAPKAGKKIHADIIKTGFQPDLNISIKLLILHLKCGCLSYARQVFDELPKPTLSAYNYMISGYLKHGLVKELLLLVQRMSYSGEKADGYTLSMVLKASNSRGSTMILPRSLCRLVHARIIKCDVELDDVLITALVDTYVKSGKLESARTVFETMKDENVVCCTSMISGYMNQGFVEDAEEIFNTTKVKDIVVYNAMVEGFSRSGETAKRSVDMYISMQRAGFHPNISTFASVIGACSVLTSHEVGQQVHAQIMKSGVYTHIKMGSSLLDMYAKCGGINDARRVFDQMQEKNVFSWTSMIDGYGKNGNPEEALELFTRMKEFRIEPNYVTFLGALSACSHSGLVDKGYEIFESMQRDYSMKPKMEHYACIVDLMGRAGDLNKAFEFARAMPERPDSDIWAALLSSCNLHGNVELASIAASELFKLNADKRPGAYLALSNVYASNDKWDNVSKIREVMKRRRISKTIGRSWTSED

SEQ ID NO: 44759 - protein, 527 aa, Trametes villosa
MGKYHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGVLNAPGAPHPFHLHGHTFSVVRSAGSSTFNYANPVRRDTVSTGNSGDNVTIRFTTDNPGPWFLHCHIDFHLEAGFAIVWGEDTADTASANPVPTAWSDLCPTYDALDSSDL

SEQ ID NO: 44760 - protein, 501 aa, Glycine max
  misc_feature (275)..(275): Xaa can be any naturally occurring amino acid
MSEPVADIAVIGLAVMGQNLILNMNDHGFVVCAFNRTVQKVTEFLENEAKGSRIVGAKSMEEMIKLLKKPRRVMLLVKAGKAVQEMIDRLVPLLEEGDIVIDGGNSEYHDSNLRCRELASKGIHFVGCGVSGGEEGARFGPSLMPGGSSGAWPHLKPIFQAIAAKAPDGKPCCDWLGEAGSGHFVKMVHNGIEYGDMQLISEAFHLMHQGLQMDFEAMSKVFTEWNKEELDSFLVEITANILRFKDETGEPIVPKILDSAQQVSQRKGHKGNIRXQKGTGKWTGIAALEYGIPVTLIAEAVFARCLSALKKQRMDASKLLPKPSKKASDLVKDSKKFLNSIGSALYASKVVSYAQGFMLMAEASREFDWNLNYGAIALMWRGGCIIRSRFLDRIQNAFEKNPSLVNLLLDDFFMKAIGDAQDSWREVISTAVQLGIPMPAFSSALAFFDGYRTEALPANLIQAQRDYFGAHTYELLAQPGVAVHTNWTGRGGKVTSNAYSA

SEQ ID NO: 44761 - protein, 529 aa, Pseudomonas fluorescens Pf-5
MSQDWNAQWRQEVLPGLATQAWDLIVIGGGISGAGILREAARRGWRCLLLEQRDFAWGTSSRSSKMVHGGLRYIAKGQWRLTRDSVRERQRLLQEAPGLVEPMSFLMPHYRGKFPGPRVFGGLLSVYDALAGRRNHRFYDARQLAFLAPGVKEPGLLGGTSFLDALTDDARLVMRVLAEARADGAQVFNGVRVTRLLRENGRVCGVQIEDSEGGQPQQVRCAVLAVATGAWAERLRPADRVRQLRPLRGSHLLLPGWRLPVAQAFSFMHAEDGRPVFVFPWEGATVVGTTDLDHRDDLDQSASISQEELEYLLAACAQQFPQALITAGDVLSTWAGVRPVVASSDGQQGKPSNETREHVLWQEPGCVTLAGGKLTTFRPQAIEVLQACGAMLGREVVDDGAPVFTPVAPLEIPGLSGAQVRRLAGRHGRHLPRLAQWVATLGGDCVGASDTLWAELAFAAEAEMVLHLDDLLLRRTRIGLLLAEGAAQYLPAIRRLCQPQLGWDDERWQAEEQRYRALWQRHHSLPPLA

SEQ ID NO: 44762 - protein, 332 aa, Prosthecochloris aestuarii DSM 271
MNKLITIERHFLEQQKSHPEATGELTDLLNDVAFAAKLVRREVVRAGLADILGMAGTTNVQGEEVKKLDLFANEKIINAIGEHGRFALMGSEENEGTIIPPNNDTGRYILLFDPLDGSSNIDVNVSVGTIFSIYRLTGDDPKEADINDCLQKGSEQVAAGYVIYGSSVMMVYTTGQGVHGFTYDPTIGEFLLSHENITTPERGKYYSINEGSLHQFNDSTVNFINYLKEDDEATGRPYSTRYIGSLVADFHRNLMTGGVFVYPATKGHPNGKLRLMYEANPLAFICEQAGGRATNGKERILDINPTELHQRTPLYIGSKEDVLKAEEFEKEG

SEQ ID NO: 44763 - protein, 283 aa, Pseudomonas syringae pv. phaseolicola 1448A
MTDNARLLSQHSFIELGARQRARALLDADSFRELLGPFDRVMSPWLARQGVVPQADDGVVVAKGTVDGRPVVIAAIEGSFQGGSMGEVGGAKMAGALELAAEDNRNGIPTAAIVLLETGGVRLQEANLGLAAIAEIHAAMVDLRQYQPVIGVVAGSVGCFGGMSIAAGLCSYLLVTQEARLGLNGPQVIEQEAGIEEYDSRDRPFIWSLTGGQQRFASDLVDGFAADDVADIRQQVSGWLKQGVPAAYRSSQYELFLQRLTSLHTEAQIDPQSVRTLYQGARS

SEQ ID NO: 44764 - protein, 469 aa, Streptomyces coelicolor A3(2)
MTDSSVREFKMPDVGEGLTEAEILKWYVQPGDTVTDGQVVCEVETAKAAVELPIPYDGVVRELHFPEGTTVDVGTSIIAVAVGDGAAAAAEPVQEAVAEEPKPEGRQPVLVGYGVSTSSTKRRPRKGAEAPAAAQTPAAAIQAELNGHGQAAPAAPATPAAPVTGDRPLAKPPVRKLAKDLGVDLATVVPSGPDGIITREDVHAAVSAPEPAQAAAPRSEQAAPAPSPSAPSSYDTTRETRVPVKGVRKATAAAMVGSAFTAPHVTEFVTVDVTRTMKLVEELKQDKEYTGLRVNPLLLIAKALLVAIRRNPDVNASWDEAAQEIVVKHYVNLGIAAATPRGLIVPNIKDAHAQTLPQLAGSLGELVSTAREGKTSPAAMQGGTVTITNVGVFGVDTGTPILNPGESAILAVGAIKLQPWVHKGKVKPRQVTTLALSFDHRLVDGELGSKVLADVAAVLEQPKRLISWA

SEQ ID NO: 44765 - protein, 404 aa, Brassica rapa
MGICMSVQVKAESPSNTGASPKYMSSEANDTQSMGSKCSSVSVRTSPRTEGEILQSPNLKCFSFAELKAATRNFRLDSVLGEGGFGCVFKGWIDEESLTASKPGTGMVIAVKRLNIEGWQGHQEWLAEVNYLGRLSHPNLVKLIGYCLEDEHHLLVYEFMPCGSLENHLFRRGSYFEPLSWNIRLKIALGCAKGLAFLHSAETQVIYRDFKTSNILLDSNYNAKLSDFGLAKDGPTGDNSHVSTRVIGTYGYVDPGYLLNGHLTTKSDVYSYGVVLLEMLSGRKVVDNNRPPREQKLVDWAKPLLANKKKVSRVIDNRIRDQISVKEAHKVATQVFRCLDVDKNQRPNMNEIVFHLENIQASREEGGNKTEKRMRRRRDSFAQQTGVGGIATAYPRPSASPLFV

SEQ ID NO: 44766 - protein, 309 aa, Burkholderia thailandensis E264
MTAKTIRHYLQFKDFSLEDYEYVLERTGILKRKFKNYETYHPLHDRTLAMIFEKSSTRTRLSFEAGIFQLGGHAVFMSTRDTQLGRGEPVEDSAQVISRMVDIIMIRTFEQDIIQRFAENSRVPVINGLTNEYHPCQVLADIFTYYEHRGPIRGKTVAWVGDANNMLYTWIQAARILDFKLQLSTPPGYALDAKLVDAESAPFYQVFDDPNEACKGADLVTTDVWTSMGFEAENEARKRAFADWCVDEEMMSHANSDALFMHCLPAHRGEEVTAGVIDGPQSVVWDEAENRLHVQKALMEFLLLGRLNH

SEQ ID NO: 44767 - protein, 341 aa, Pseudomonas syringae pv. phaseolicola 1448A
MTTQQPVAVLGGGSFGTAIANLLAENGHQVLQWMRDPEQAQAIRVNRENPRYLKGIKVRPEVEPVTDITATLEACELIFVALPSSALRAVLSPHVERLNGKMLVSLTKGIEAQSFKLMSQILEEIVPQARIGVLSGPNLAREIAEHALTATVVASEDEALCQQVQAALHGRTFRVYASNDRFGVELGGALKNVYAIIAGMAVALDMGENTKSMLITRALAEMTRFAVSQGANPMTFLGLAGVGDLIVTCSSPKSRNYQVGFALGQGLTLEAAVTRLGEVAEGVNTLKVLKVKAQEVQVYMPLVAGLHAILFEGRTLSQVIEALMRAEPKTDVDFISITGFN

SEQ ID NO: 44768 - protein, 381 aa, Burkholderia thailandensis E264
MLPSFSPALLALADGTVFRGYSIGAAGHTIGEVVFNTAITGYQEILTDPSYARQIVTLTYPHIGNVGVNAEDVEATKVHAAGLIVRDLPALASNFRMERTLGDYLRDEGVVAIAGIDTRKLTRILRDKGAQNGCILTGSDDETKALALARSFPGLAGMDLAKVVSTTKPFEWRQTEWRLGSGYGMQEAPRYRVVAFDFGVKYNILRMLAERGCHVTVLPAQSSAAEALALNPDGIFLSNGPGDPEPCDYAIAATKEFIERGVPTFGICLGHQIMGLALGAKTLKMKTGHHGANHPVKDLANGRVVITSQNHGFAVDADSLPANARATHVSLFDGTLQGFELTDKPAFCFQGHPEASPGPHDIGYLFDRFTALMDAAKARSA

SEQ ID NO: 44769 - protein, 402 aa, Physcomitrella patens subsp. patens
MELFPAPGRNHLFVPGPTNIPDRVLQAMNRNNEDHRSPTFPALAKSVLEDVKLLFRTQTGTPFIFPSSGTGAWESALTNTMSPGDRIIVPRMGQFCVLWINLMTRLHFNVDVIECEWGEGIDLEILKQKLQSDHTHAVKAVCVVHNETSTGVTNDLSAVRKALDEARHPALLLVDGVSSVGAMDFRMDDWGVDVALTGSQKALSLPTGLGILCASLKAIETSKQAKYPRGYFDWAEYLKSYKAGTYSPYTPSVQLLYGLRASLDIILKQEGLENVIARHLRLAEATRRAVRAWGLTVCARKPQWDSAVVTGVVVPSSLDSNDVIKIAWKKYNLSLGLGLGEVNGKVFRIGHLGYVNELQLLGALAGVELVLLEVGYPVIFGSGVAAAQAFLSKQTPIIASRL

SEQ ID NO: 44770 - protein, 107 aa, Tulipa gesneriana
MAVRKSSNLPQAAVIRHILKRCSSFGRKNGACSDKGHSLPLDVPKGHFAVYIGEKRSRFIVPISLLAHPEFQSLLRAAEEEFGFDNDMGLTIPCEEVVFRSLTAVLC

SEQ ID NO: 44771 - protein, 158 aa, Glycine max
PKPGILFQDITTLLLDPQAFRDTTDLFVERYKDKDITVVAGVEARGFIFGPPIALAIGAKFVPIRKPKKLPGEVISEEYSLEYGTEKIEMHVGAVQPNDRVLIVDDLIATGGTLCAAAKLIERVGAKVVECACVIELPELKGRDKLGDMPVFVLVQAD

SEQ ID NO: 44772 - protein, 364 aa, Populus tremuloides
MGSTGETQMSPAQILDEEANFALQLISSSVLPMVLKTAIELDLLEIMAKAGPGALLPPSDIASHLPTKNPNAPVMLDRILRLLASYSILICSLRDLPDGKVERLYGLASVCKFLTRNEDGVSVSPLCLMNQDKVLMESWYHLKDAILEGGIPFNKAYGMTAFEYHGTDPRFNKVFNKGMSVHSKMAMKKILETYKGFEGLASLVDVGGGTGAVVSTIVSKYPSIKGINFDLPHVIADAPAFPGVENVGGDMFVSVPKADAVFMKWICHDWSDEHCLTFLKNCYDALPENGKVILVECILPVAPDTSLATKGVMHVDVIMLAHNPGGKERTDREFESLARGAGFKGFEVMCCAFNTHVIEFRKKA

SEQ ID NO: 44773 - protein, 190 aa, Brassica napus
  misc_feature (170)..(170): Xaa can be any naturally occurring amino acid
MVLATNSDSEEHLHSTFASRYVRAVVPRFTMPNNSMPKDAAYQVISDELMLDGNPRLNLASFVTTWMEPECDKLIQESVNKNYVDMDEYPVTTELQNRCVNMIANLVHAPMGEEEAAIGCGTVGSSEAIMLAGLAFKRKWQQRRRAQGLPTDNPNIVTGANVQVCWEKFXRYFEVELKEVKLSEGYYVMD

SEQ ID NO: 44774 - protein, 365 aa, Populus sieboldii x Populus grandidentata
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILEGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPNADAVFMKWICHDWSDAHCLKFLKNCYDALPENGKVILVECILPVAPDTSLATKGVVHVDVIMLAHNPGGKERTEKEFEGLANGAGFQGFEVMCCAFNTHVIEFRKKA

SEQ ID NO: 44775 - protein, 364 aa, Populus sieboldii x Populus grandidentata
MGSTGETQMSPAQILDEEANFAMQLISSSVLPMVLKTAIELDLLEIMAKAGPGALLSPSDIASHLPTKNPDAPVMLDRILRLLASYSILICSLRDLPDGKVERLYGLASVCKFLTKNEDGVSVSPLCLMNQDKVLMESWYHLKDAILEGGIPFNKAYGMTAFEYHGTDPRFNKVFNKGMSDHSKMAMKKILESYKGFEGLASLVDVGGGTGAVVSTIVSKYPSIKGINFDLPHVIADAPAFPGVENVGGDMFVSVPKADAVFMKWICHDWSDEHCLRLLKNCYDALPENGKVILVECILPVAPDTSLATKGVMHVDAIMLAHNPGGKERTDKEFEGLARGAGFKGFEVMCCAFNTHVIEFRKQA

SEQ ID NO: 44776 - protein, 137 aa, Corynebacterium efficiens YS-314
MTDFKLITDAEWRERLNPEEYRVLRQAGTEAPHVGEYTNTTTEGVYSCRACGEELFRSTEKFDAHCGWPSFFSPLAKDKIIEKEDLSLGMRRIEVLCANCGSHMGHVFEGEGFNTPTDLRYCINSISLRLEEKPVSE

SEQ ID NO: 44777 - protein, 453 aa, Arabidopsis thaliana
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 44778 - protein, 300 aa, Oryza sativa Japonica Group
MAASSARLLAAAARGRAATTFRHAPTVSSSLSFPPNPHHRPSLRGRAGISFSSTSISLPSGSPHGASAPFNLFPPDSDPFIQWDPPPPDAASPLGAGRRRPQGAGGLKGVRAPRGGSARGRSTCGGLVDKNVVDRVKDNFPFLPCLEVRNPLVEVLFDNSVICGHAIHMAIYENFAIKFLSRYGAILENLQSRADIIERIRGCIVDSAPVLEIRPEVWAAGFSAAMLKKSSSMTGPSVESPDGYTSNGTLNNLSSDVTRPTWGENILLSTLQKFFEIVLHLPDVNKHLFYEDCRLTALNE

SEQ ID NO: 44779 - protein, 593 aa, Legionella pneumophila subsp. pneumophila str. Philadelphia 1
MKEPRELNRQPNPEHMAQLIKDTPKDVWFHLAKYLPDHELLNLMQVDKRLNRFFKEGTPPKEIIKKIEHAPLKVVSSGVNTFILTQYHGKPLLLACGQNKDGQLGCGDTKIRTALTPVNIPESFASIESVQISLFHAVLWGRDKDNKPILATCGLNDKGQLGCGDYKSRALFTQVKLAEDITSIESVEINIFHSVILGHDKHNRPVLASCGSNHLGKLGCGDIKDKTTFTRMKLPTEIVSIDTLQMNWHTIVSGRDKNNKPVLAACGWNDRGQLGCGDKKERALLTPVKLPENIVSIQSAQIGTSRTTVLGRDKDNKPILTYCGWNERNQMGWSNTEDKTALTPAKLPENIVSIELMQISTSRTVILGRDKNNKPILAACGLNNHGQLGCGDIKTRTTLYPIKFPKDIVSIESVQISDNHTVILGRDKHKNPIIAACGLNNYGQLGCGDTKNRMLLTPIKLPKEIVCIDSVTVKYSSLFVSGRDKNHRPILAACGDNRYGQLGVPSKKLLTELTIVPTPILTLPATPKREASSRKEATEKALVFATHGSREQKPRKSNRILTAIIASFGRFFTGAHPHTPDSDKESPSPKRSA

SEQ ID NO: 44780 - protein, 565 aa, Robiginitalea biformata HTCC2501
MKKFLILIPILAFTLSTSAQDRLTGETHTTRSEILARNGMAATSQPLATQVALDILKKGGTAMDAAIAANAVLGLVEPASCGIGGDIFAIVWDADDQKLYGFNGSGRAPQSLSIDYFMERDMRYVPFSGPLPVTVPGCVDGWFALHKKFGELPMKEILQPAIDYGREGFPVSEVIAYEMERSYPYSQDQPGFAETYMPNGRPPKKGEVFQNPDLASTYEMIAKGGRDAFYKGDIARTIDSYMKKHDGFLSYEDLAAHTSNWVEPVSVNYRGYDIWELPPNGQGTAALQMLNILEGFDIASMGFGSTDYLHVLTEAKKLAYEDRAKFYSDPEFNDIPLEELLSDAYADQRRSLIDMDRAADSYPAGDMEIEAGNTTYLTVADEDGNMVSLIQSIYSEFASGMVPDGLGFVLQNRGQMFNVQDPGHANALEPGKRPFHTIIPAFITKDGRPVLSFGLMGGAVQPQGHTQIVVNIVDFGMNLQEAGDAPRMRHSGSSQPTGSKMTNGGTLNLESGFDYQTVRELEKKGHAVAFAVGIYGGYQAIGVDLPNKVYTGASESRKDGQAAGY

SEQ ID NO: 44781 - protein, 175 aa, Zea mays
MASASATATLLKPTPLPPHKPIITASVSPPLPPPRRHNLLRRDLLSLSAASTLLLTQSLPFLAPSPASAAEDEEYVKDTSAVISKVRTTLSMERTDPNVADAVAELREVSNSWVAKYRKEKALLGKASFRDIYSALNAVSGHYVSFGPTAPIPAKRKARILEEMETAEKALSRGR

SEQ ID NO: 44782 - protein, 167 aa, Xylella fastidiosa Dixon
MTGLNVRIGQGYDVHAFGPGDHVMLGGVLVPHRCGVLAHSDGDVILHALCDAMLGALGFGDIGQHFPPSDVRWKGVDSGVFVRHCNLLLRERDWCVGNVDATAICESPKIAPYVNAMREGIARLLEVQPECVSVKATTSEGLGFIGRGEGLAAQVVVLLYRLNGVVV

SEQ ID NO: 44783 - protein, 197 aa, Staphylococcus aureus subsp. aureus MW2
MILVIDNNDSFTYNLIDYIKTQTKLTVQVVGIDNLLIEDVINMKPKAIVISPGPGNPDDYPILNEVLEQFYQRVPILGVCLGFQCIVSYFGGNIIHGYHPVHGHTTQLRHTNEGIFQGLPQNFNVMRYHSLIADGATFPNCLKITAKNDEAIIMAFEHITFPVFGVQYHPESILSEYGYRQVELFLSKVGDYCENRI

SEQ ID NO: 44784 - protein, 709 aa, Shewanella sp. ANA-3
MEKTFNLTRREDGIAILMMDVPGETMNTLKAEFGPEISEILSEIKRDSSIRGLVLISGKKDSFVAGADISMLDACQTAGDAKALSQQGHVVFNELEALNIPVVAAIHGACLGGGLELALACHQRVCSDDGKTMLGVPEVQLGLLPGGGGTQRLPRLVGITTALDMMLTGKQIRPKQALKMGLVNDVVPQTILLQTAVEMALAGKRTAKPVKKSLVNQLLEGTGFGRNIIFDQAAKQVVKKTQGNYPAPAKIIDCVRQGMAKGMQKGLEVEASHFAELVVSKESEALRSIFFATTEMKKETGAEGATPRKVKKAVILGGGLMGGGIASVTTTKAKIPARVKDINEKGLSNALSYAYKLLDKGVKRRHMTPAVRDNLMALMTTTTEYKGVKDADIVVEAVFEDLALKHQMVKDIERECGEHTIFASNTSSLPIGQIAQAASRPENVIGLHYFSPVEKMPLVEVIAHAKTSPETIATTVAFARKQGKTPIVVQDGAGFYVNRILALYMNEAAQLLLEGQSIEHLDKALVKFGFPVGPITLLDEVGIDVGAKIAPILEKELGERFKAPAAFDKLLSDDRKGRKNGKGFYQYAAGNKASSKKKAVDESVYAVLGIKPGMDKDLSAVAERCVVQMLNEAVRCLDDGIIASPRDGDIGAIFGIGFPPFLGGPFHYIDTLGADNLVNILERYQAQYGDRFEPCPRLKAMAAEKARFF

SEQ ID NO: 44785 - protein, 430 aa, Xylella fastidiosa Dixon
MTAIVKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSLKS

SEQ ID NO: 44786 - protein, 240 aa, Bacillus cereus ATCC 10987
MRTPLSFDKDTAILLASCCELTYEQYKQNGIFEIPDGFQYVQSFQGKTIQTTEWFGFILESEDTVIVAFRGTQTDTDWIIDSLVNQKPYPYALNSGNVHNGFLSIYESCRDSIMDMLVSLPAHKKLLATGHSLGGALATLHILDARINTAFAQYGLYTFASPKVGDIAFRNYYKLQVASSFRFVNLFDVVPLLPPRNINFNDQDWEYAHVHHNMTFTKNTKSITNNHAMTTYKTCLTSHF

SEQ ID NO: 44787 - protein, 447 aa, Prosthecochloris aestuarii DSM 271
MSKNSHAISLVEAVSMAVGTMIGASIFSIFGLGAEIAGQNLPMAFFLSGMLAFMVAYSYAILGRQIISNAGPISFLLKGIGDNVLTGTLAVLMWLSYVISIALFVKGFSGYLLPFINIESTPLAIGLTEAGIIMFFTLLNTYGSQAVGKLELYIVAVKLSILLIFIVLGMSSIHLSSIVPSLTPKGTEGMLMGSIVFFLSYMGFGLITNASENIDNPFVNVPRAIYISISIVIMVYVLVSVVALGNLAIPDLVKAQDNALAVAARPFLGQTGFALLSVGALFSIASALNATLYGGANIAYSLAKDGELPGIFERKIWFGSSEGLYITAGLGLFFALLFDIGAIASITSTIYTIIYLCVMISHYRIAGTYGGSRPLIFIFSCTMAVVLIGLMSYQYMTSKITFFATIATFFGALLIEYLYRYGRKRRFGIINNLSDTSQALHPARKDI

SEQ ID NO: 44788 - protein, 107 aa, Tulipa gesneriana
MAVKKSPKISEAAAIKQILKRCSSIGRKHGAYSEENYCLPLDVPKGHFAIYVSEKRSRFVVPISLLAHPEFQSLLRDAQEEFGFDHDMGLTIPCEEIVFKSLTAVLW

SEQ ID NO: 44789 - protein, 325 aa, Physcomitrella patens subsp. patens
MESSEAPIYIVPDYVPEYRSGGCAERGIRRSMEDAHVCVDNLEETLGTRGAFYGVFDGHDGEAAACYVKEHLLPFILRDVSFPTCVEDAVKNAYLELDKEFLEACRLDDSLSSGTTVLTALLQGRSVNLLVANAGDCRAVLCRKGQAVPMSQDHDPSSAWEKSRIESVGGYVVDGYVNGQVTVARAIGDWHMQGLKEAGGKGPLSALPDVKSLVLSEDDEFLLMGCDGLWEVFTNEGAISFARKQLQRHNDPELCSKELVVEALRRNSQDNVTVIVICFKADAPPPLVVLERRTTIRNFCLKKMLSVQKDIDIAQASASERRCVV

SEQ ID NO: 44790 - protein, 202 aa, Shewanella sp. ANA-3
MHNASDIQSALVPMVIEQTAKGERSFDIYSRLLKERIIFLVGQVEEHMANLIVAQLLFLESESPDKDIFLYINSPGGSVTAGMAIYDTMQFIKPNVSTVCIGQAASMGAFLLAGGEKGKRFCLPNSRVMIHQPLGGFQGQASDIAIHAQEILGIKHKLNLMLSEHTGQPLEVIERDTDRDNFMSATQAVEYGLVDAVMTKRG

SEQ ID NO: 44791 - protein, 491 aa, Streptomyces coelicolor A3(2)
MAHASDGHVLEFKLPDLGEGLTEAEIVRWLVEVGDVVAVDQPVVEVETAKAMVEVPCPYGGVVTARFGEEGTELPVGAPLVTVTVGGGGAAADGPARDSGTDAGAAGTPVAGTPAAAAAETSPAAETKAEGSGNVLVGYGTSEAPARRRRVRPGRQAATGASGRANGRVRGAGAVDGPVRTAEPADGPVPVISPLVRRLARQHDLDLRELTGSGPDGLILRADVEYALRAAAAQGGRTADPEAGTGRVPDAAPAAVSSAPRSDGTRVPLKGVRGAVADKLSRSRREIPDATCWVDADATELMRARTAMNASGGPKISLVALLARICTAALARFPELNSTVDTDAREVVRLDRVHLGFAAQTDRGLVVPVVRDAHTRDAEALTAEFARLTEAARAGRLTPGELTGGTFTLNNYGVFGVDGSTPIINHPEAAMLGVGRIVPKPWVHEGELAVRQVVQLSLTFDHRVCDGGTAGGFLRYVADCVEQPAVLLRTL

SEQ ID NO: 44792 - protein, 354 aa, Zinnia elegans
MGSNQDDQAFLFAMQLASASVLPMVLKTAIELDLLETIAKAGPHGSVSSSELVAQLPKVNNPEAPVMIDRICSLLASYSVLTCTLKETADGCAERFYGLAPVCKFLIKNDAGVSLAPLLLMNQDKVLMESWYYLKDPVLDGGIPFNKAYGMSAFEYHGKDQRFNKVFNSGMFNHSTMTMKKIVELYNGFSGLKTLVDVGGGTGASLNMITSKHKSLKGINFDLPHVIADATTYQGIEHVGGDMFESVPKGDAIFMKWILHDWSDAHCLQVLKNCYKSLPENGKVIVAECILPEAPDTTPATQNVIHIDVIMLAHNPGGKERTEKEFEALAKGAGFKGFNKAACALNTWVMEFCK

SEQ ID NO: 44793 - protein, 302 aa, Burkholderia thailandensis E264
MSAGFPQFVSAGDILTDMVRTGGAHWTSRPGGAGWNVARAVARLGAPSACAGAVGRDCFSDALWRESEAAGLDLRFLQRVDRAPLLAIVHETQPPAYFFIGENSADLAFDPKRLPDGWREHVKWAHFGCISLVREPLASTLVALAAELREAGVKISFDPNYRNLMTDSYRPTLAKMAELADLIKVSDEDLRHLFAGEDEASATARLRALNPQAALLVTRGPDTATLYAHGATLDAQPPRIEVADTVGAGDATIGGLLFSLMTVPARGWREHLAFALAAGAAACRHTGAHAPTLDEVVALVAA

SEQ ID NO: 44794 - protein, 352 aa, Oceanobacillus iheyensis HTE831
MLTKERVVELLSSVQDPFLHITLEETGGINSVTIKEDKKHVSVKIGISKTNTAEQMELQQEIVGILKREGANTVGLRFEALPDEVIQKYQPAAEKAKEASLMGGSSNTKFIAVASGKGGVGKSTVTVNLAVSLMRLGKKVGIIDADIYGFSVPDMMGVEKRPVVRGEKIIPVERFGVKVISMGFFVEDNSPIIWRGPMLGKMINSFFSEVEWGELDYLLLDLPPGTGDIAMDVHELLPTCKEVIVTTPHPTAAFVAARAGQMALKTDHEILGVVENMAYFESKTTGEKEYVFGKGGGKKLADVLKTKVLGQLPLQQPYEEEDVFAPSVYQEDHPIGKEYHKIAAKVIAKMEE

SEQ ID NO: 44795 - protein, 713 aa, Idiomarina baltica OS145
MSVKKILLALVIIAAIVAAVMFDVTQYLNLDTLKAQQTRVNGWFETEPLLTFAIYFVAYVLVTALSIPGATILTLGAGAIFGLGWGGLLASFASSVGALLAFLSARFLLKDWVQSKFGQRLEAINRGVKRDGAFYLLSLRLVPIFPFFVINLALGLTQIRTWTFYWVSQVGMLLGTVVYVNAGTQLAEIEQVGDVVSADLIGAFVLLGIFPLIAKWLLTAIKRRRAFKGFTRPQHYDNNLIVIGAGSAGLVSAYIAATVKAKVTLIERDKMGGDCLNTGCVPSKALLHVANQVHHMRHSEQLGIKVDSVSVDFQQVLARVQQVIQRIEPHDSVERYQGLGVNVELGEATIKSPWEVELKQDGESRRLTTKHIVVATGARPLVPNLPGINNVDYLTSDNLWQLRELPKRLLILGGGPIGCEMAQAFQRLGSEVHLVEMSERLLTNEDPDTSTYVARALQDDGVTLHLGTRAKAFSQTEQGVELTVESEQREQSLHADRVLLALGRQANLEGFGLKELGIEQGKTIQVDEFMQTSLPNIYACGDVVGPYQFTHVASHQAWYATVNALFGRFKRFRVDYSVIPWVTYTSPQVANVGLTEQQAKAQQVDYETTCYDIAELDRAIADGNANGRVKVLTEPGKDTILGVNIVGPQAGELLAEFVLAMKHGIGLNKILGTIHSYPTLAEANKYAAGEWKRAHAPEKLLQWVEKLHRWLRS

SEQ ID NO: 44796 - protein, 391 aa, Magnaporthe grisea 70-15
MTAEPPPKRKCLGADCENDAGSLQCPTCLKLGIKDSYFCSQDCFKKNWGTHKATHKQENSILSHLFPPKVVSKPDPETGLFNPFPAFNFSGPLRPVYPLSERRKVPASIPHPDYAGDGIPKHGRSLVRSNKIECLDAKAQEGMRKVCRLAREVLDIAAAAIHPGITTDEIDKIVHDAFLPIPRSTTTTSPSPVCTSLNEVICHGIPDKRPLVDGDILNLDVTLYHEGYHGDLNETYYVGDKALADPDVVRLVETTRECLDEAIKLVKPGTLFREFGNVIEKHAKANNCSVIRTYVGHGINSVFHCPPNIPHYAKNKAVGECKPGMTFTIEPMLALGKYRDITWPDNWTSTTIDGKRSAQFEHTLLVTETGVEVLTARKADSPGGPVPLPTA

SEQ ID NO: 44797 - protein, 150 aa, Triticum aestivum
  misc_feature (53)..(53): Xaa can be any naturally occurring amino acid
  misc_feature (66)..(67): Xaa can be any naturally occurring amino acid
  misc_feature (114)..(114): Xaa can be any naturally occurring amino acid
  misc_feature (120)..(120): Xaa can be any naturally occurring amino acid
  misc_feature (123)..(123): Xaa can be any naturally occurring amino acid
  misc_feature (130)..(131): Xaa can be any naturally occurring amino acid
  misc_feature (143)..(144): Xaa can be any naturally occurring amino acid
SQEVVGDLLGEEFEGYIFKIMGGCDKQGFPMKQGVLTPGRVRLLLHRGTSCFXVGHGRRLVERRRXXPVGAFVNQNLPLSTWVIVKKGQNDFPKPDRHWKNPKIKGPKEASKIXRPFNLXKDXDVRQFVXXYRKPSKTRRETXXSPKNCP

SEQ ID NO: 44798 - protein, 242 aa, Zea mays
  misc_feature (76)..(76): Xaa can be any naturally occurring amino acid
MDHAADAHRTDLMTITRHVLNEQSRNPEPRGDFTILLSHIVLGCKFVASAVNKAGLAQLIGLAGETNVQASALSSXFFLFFGEIDRDVTMPLPWLLGVLDRERSRRSWTSCPTRCSSRPSSAAVAPASLCPRGRGSTFVTLAAWIGSMVADVHRTLLYGGVFLYPADEKNPNGKLRILYEVFPMSFLMEQAGGQSFTGKERALDLVPTKIHDRSPIFLGSYDDVEEIKALYAEQAKSSSASS

SEQ ID NO: 44799 - protein, 580 aa, Gibberella zeae PH-1
MGQLQVLAALLSVFPQIGLSKPCETTYPPLMHPLQSRQFSDNLGAVASESEICSTIGVNILRDGGNAADAMVATVLCVGTIGMYHSGIGGGGFMLIHAPDEKNGSNAYEFVDFRETAPAAATENMFKNNVNESISGGKASGVPGELRGLQHLHEKYGSLPWSQLVQPAIKVARYGFPVNNDTLKFMGATYTKFENESFLLNDPAWAIDFAPSGRLVKFGEKLTRKRFADTLETIASEGPDVFYQGAIAEATIRTLKREKGIMTMDDLKNYTVEIRQPSQINYRGGKVTSGSAPSSGAVVAAALNILDGYDFLGDPSRVNDTAYYTDEAFKFSYGMRTNLGDPSFVDDMSEYQKQMYSNKTAQEVRAKLDGRALALKDYDPKGLESLETPGTSHIVAMDSSGLAISLTTTINLNFGSKVIVPETGIIMNNEMNDFSIPGESNQFGYIPSEANFIRPGKRPLSSISTTIVEDADGKVSLVTGSAGGSRIITATTQVVLNAIDKNMTVREALAAPRLHDQLVPRQVSFEYAFDNSTVAYLKEVGNNVTWVPTQSTAQALRRLANGTFEAAGEPRQVNSGGFST

SEQ ID NO: 44800 - protein, 481 aa, Oceanobacillus iheyensis HTE831
MKVMEQGGNAVDAAIAISFVLGVAEPYGSGIGGGGTMLIHPNNNQDPIVYDYRETAPDDSLSSSGIGVPGFINGMYRVHEDFGTKNMEQLINPSIHFAENGVTVSETLHNALEDDESRLSDLDHLFPDGEPIKEGDLLVQEQLAETLEDIQRDGPSAFYQGDIANEINEEEDDIEEEDLETYKTEVKDPIQGKFGGYDVLAPPPPSGGVMLIQMLEMAESLNIEETKGYPLAFSLKMGLINRISYGDRLENIGDPNFIDMPMKELISKDHIDHLASKIQGLELSEEYRRDLESDADKENHANTTHFVVVDKNGMMVSVTNTLSDLFGSGEYVDGFFLNNQLKNFSNKEDSPNLPESGKRPFSYTSPTILTKDDSPVIGIGSAGGRKITTMIAQQLVKTIKFNEPIQASVNSPRTFLEFNEDVLQVEQDSIFLKNPEDVGLDVQSIDDMAYHGSVQGLIIDGENGKIHGFSDNNRDGKWMSK

SEQ ID NO: 44801 - protein, 636 aa, Corynebacterium efficiens YS-314
MGILNSISTPADLKALAEEDLEVLAGEIRSFLVDKVAATGGHLGPNLGVVELTIGLHRVFDSPREPIIFDTSHQSYVHKILTGRGDAFDTLRQKGGLSGYTSRAESEHDWTESSHASAALSYADGMSKAFQLDGDTNRNVVAVVGDGALTGGMCWEALNNIAAGKDRNVVVVVNDNGRSYSPTIGGFAENLAQLRMEPFYDRVMEQGKSTLKSMGWVGERTFEALHAFKEGVKSTVIPTEMFPELGMKYIGPVNGHDQKAVDNALAYARDFKGPIIVHVVTEKGRGYAPAERDLDELMHATGVMDPRTGIPVAASKPGWTAAFSEELVKLGGRREDIVAITAAMAGPTGLAKFAANFPSRFYDVGIAEQHALTSAAGLALAGKHPVVAIYSTFLNRAFDQLLMDVALLNLPVTVVLDRSGVTGSDGASHNGVWDLALTSIVPGIRVAAPRDEDTLRELLGEAVDINDGPSVVRFPKGDLPAPIEAIETLEDGVDILAYLEASPASEDAPDLLIVAVGERATLALELGERLVAAGANVTVVDPRWVIPIPQSLVALAADHDLVITIEDGVIHGGVGSLLSDALNAAEVDTPRRQVAVPQKFLDHASRGQVLLDHDLDIDSVEKTALGWMDRLFGGGN

SEQ ID NO: 44802 - protein, 521 aa, Chlamydomonas reinhardtii
MSEPGEEPVAAPAGPAPDPVLNELYGSERPAVELLPGVPLSPIVNSCWLPADAKAMLAESWIPVPPEDAGEEAGPPPPAFEAAAPEYNELVRRLAKTAPFRKWNELTIQAKQLEQEVAGLKGPDAEAKQAELENVKVQIADAEAAVAEVKQSFSDDPLSLTGWMQALTDLADGGMTTFEVSGQGWPYCSLRQLFGEMPSAAPPAGFFDGVERVLGTFKRRYEKERGPGSVQLMLKLAPNVFSDAWSTGGAPAAVAAVEAYVERARANVFGPDGGVTPEGVPEPLDLVQLVWWDFAAADPLPVLKALQRMATDQLQVDEDSGEVSVSEPKKIRGIGLVDFPADRLKAAIQAGVPITCVQVEHSVLVRSAQPVLDLCAKYGIKVLARGGTLGGLLSAKYLGAPPPDPVRGDADLDSVPGCLDAVNNVGGWARLQAALAVIKGIADKHGVKPETVALRWQIDAGCFPLVTTRWSSRVWRQFGYEGWSSFEVSGGRPGVDGPLFQVESFLDVEDVRALAGLAAVH

SEQ ID NO: 44803 - protein, 479 aa, Legionella pneumophila subsp. pneumophila str. Philadelphia 1
MQEERGMSSQHTDKTLIKWIDNLIDEQSFLPIGSEYIPDNNLHSLPGAEVITGLAKVNQRPVAIYAHDSSVNRGYVTRQGARKIIHLMDKAEKLRIPIVAFLASPGVSLEENLLSGDEYTQIIARNIRLSGIIPQFAVILAPTLGAPAYSAVLMDLLFFNKHRSYLMVTSPTVVQQAISEKVTMGELGSATLHATTTGIADFVDDSVTAQINHVKAMLGFFPLHTNERPPVHPIMEPNHPIPDIPANPRMPFNMLNLIQAVVDNSNVIQYKRTYGQAMICAFVHIHGFAVGVVANQSIRYSGAIDSDAAQKAAKFIRICDAYSIPILTFIDVPGFMPGKREEQKGLLQHGARFCVAMQTRVPRLSVIVRKCYGAAAFLMMQTKSQNGDLVLALETANLGVMGKETTNKVQAMDGQPVQESSQSQLTEKSQIDDSLMEAYSLGLIDEIIQAAQIRSRLASHLEFLYRSMETMPPAKHSIV

SEQ ID NO: 44804 - protein, 326 aa, Corynebacterium efficiens YS-314
MYKPTGNPAGKQLQRSYVRVISRCGKWNHRHLREKHTMMDSMESTHAYTFSFNELRAVASETVTLTAARIRDKRADLGDMWAYTNTKSSAVDPVTIVDTLAEDFIANRLQELRPEDGLIGEEGTGTPSISGVTWIVDPIDGTVNFVYGLPQYAVSIAAAIDGEVVAGAVINVETGVLYSAARGQGAYKYLPDNDEIVALRVNGIDDITQCLVATGFGYSTTRRAQQAQVLTGVLPVVRDIRRMGSAALDLCHLADGEVDVYYEHGLSCWDYAAGILIAQEAGARIHAPGLSVPGQSGEILYAAPHPVFEAVTDLFDTIGALTPLQH

SEQ ID NO: 44805 - protein, 886 aa, Zea mays
METGAAAAPASRADGVRRCKILVPWRFQPGFVRQPLKQAANDAAVNGDGGNTAGAPDAKSCRADGAASDGGETNVFRDAKKFGSGRATRGKNGEVDGGEEHSERCTSSQSLKSPDVENGGRPGPGDACNLGESVRGGWVKSSPLEGTGNSRGANGGVEAGEDYNLGSSNCDASWKDARTQEFRGAGDGAACDPEVIESNVGAEKCFAKGLKKPFMDQTGSKSNGSSAPGLESEDPEGNVGLEDSSYQAAKGCSMGDGAAKENEATANGCSSATPGSIGNGTYVRKGRKAAVPWRFQARYKRSFSDAFGSNNESPDLPAYMFDSSSTQCTPATRSTVRCYASAHSGVRVSAMNNFSVKGDTECKKRKTNNDYQDESMLNNGGVVVRERIMRSLQDLRLIYRDLLDEEDNSREKVLNVRPDLKAYRIFRERFCTDFDDEKYIGSVPGIYPGDIFHLRVELCVVGLHRPHRVGIDCTKKDDGTTVAVSIVSCAQSHDIKYNLDAFVYTGLVAVAVNQRIEGTNLALKKSMDTNTPVRVIHGFTTFNGKKKFPAYIYGGLYLVEKYWREKEHGDRYVYMFRLRRMEGQKHIDIQEILQTGNSGSNDNVIIKDLSRGLERVPLPVVNKISDERPMPYCYISHLRYPRNYRPTPPAGCNCVGGCSDSNKCACAVKNGGEIPFNDKGRIVEAKPLVYECGPSCKCPPTCHNRVGQHGLKFRLQIFKTKSMGWGVRTLEFIPSGSFVCEYIGEVLEDEEAQKRTNDEYLFAIGHNYYDKSLWEGLSRSIPSLQKGPGKDDENETGFAVDASEMGNFAKFINHNCTPNIYAQNVLYDHEEISVPHIMFFACDDIRPNQELAYHYNYKIDQVHDANGNIKKKKCLCGSVECDGWLY

SEQ ID NO: 44806 - protein, 339 aa, Vitis vinifera
  misc_feature (46)..(46): Xaa can be any naturally occurring amino acid
  misc_feature (151)..(151): Xaa can be any naturally occurring amino acid
MVSDQDIAKGVETLLRQSEPNSFTSLNGVVKQLEAKLGLDLSHKAXFIRDQISFLLRSHPQPLPPKDHFALQQHPQFLSPHPQIPSHFALQHHRPPPEDLNFLYPLPQPQQHQPQTQPQPQPHHLPKGEAFLQNAASVAAQAPKESAPAAXKRRGGSGGLNKVCGVSTELQAVVGEPTMPRTQIVKQLWAYIRKNNLQDPSNKRKIICDDALRLVFETDSTDMFKMNKLLAKHIIPLEPSRESSQAKRLKVDVESATESSEASPSPVMISDALATFFGTGEREMLQEEALRRVWEYIKDPLNSMAILCDAKLRELFGCESISALGVSEMLARHHLFKRS

SEQ ID NO: 44807 - protein, 369 aa, Nostoc sp. PCC 7120
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSINGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVNVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 44808 - protein, 294 aa, Francisella tularensis subsp. holarctica
MKGIILAGGSGTRLYPLTLGVSKQLLPVYDKPLLYYPLSVLMLAGIREILIISTVRDISLIQELLGDGLQFGIQLSYKIQPSPDGLAQAFILGEEFLAGDSACLILGDNIYYGQGMTTMLESARAQCGGPVGGACVFGYYVNDPHRYGIVEFDKQKNVISVEEKPQNPKSHYAITGLYFYDNNVVEYAKQVKPSARGELEITSLNELYLKENKLNVELLGRGFAWLDAGTHDSLLEAGQYVATIEKRQGLKIACLEEIAWRKGFISTQQVLAQAEKLSKTEYGQYLKNLIKDGL

SEQ ID NO: 44809 - protein, 356 aa, Candidatus Kuenenia stuttgartiensis
MQQAGFNPACFYMQIKMTQNFSAKNITVIGNGGWGTALAILLYNKGNKIGLWGHDKSYTDYLNEKRENTKYLKGIIIPPDIAITSEITATLMDTQFILSATPTPYLRSVLLKFKEVFVNKTPIISITKGIENETLMRPSEIIRDVLGDPPVSLLLGPSHAEEVAHGLPTTIVASSNDLSLAQTVQELFTTDRFRVYTNTDIIGVEIGAALKNVIAIAAGICDGLSLGDTTKAALITRGLAEISRLGTAMGAKKITFSGLSGLGDLITTCISPYGRNRWVGEQIGKGKMLEEILRDMKQIAEGVWTTKSVIELSKKYRIEMPITHEIYSVLFSGKKPLEALNNLMLRTPKSEIEEIY

SEQ ID NO: 44810 - protein, 176 aa, Robiginitalea biformata HTCC2501
MSLVKPVRGKAPVFGADCFLAETAVVVGDVEMGDRCSVWFHAVVRGDVNSIRMGDQVNVQDGAVIHCTFEKAATRIGNNVSIGHNAIVHGCTVRDNVLVGMGSILMDHCDVGSYSIIAAGAVVPQGTVIPEGSIYAGVPARKIGEVRPELRTGEIERIAKAYTRYSGWFREGSPED

SEQ ID NO: 44811 - protein, 588 aa, Hordeum vulgare
MVMGSTDRFDKSPLLDGGSSSQESTTEYTGDGSVCTSGHPASKKHTGNWKASSLTIVCSFCCYLAYSSIGKNLVSYLTKVLHETNLDAARHVATWRGTSYLAPLVGAFVADSYLGKYRTALIACTIFIMGMMMLLLSAALPLISAGPHAWTLWADPVSSRYIMFLVRLYMVGLGYGAQSPCVTSFGADQFDDTDEVEKTRKSSFFNWHYFSINAGSLIAGTVIVWVQEHEGWLWGFTISTLFVTLGISVFSLGSIVYRFQKPGGSPLARIWQVVVAASRNFDKVLPCDSSALYEFSGQGSAIEGSRKLVHTSGLEFFDKAAIVTLPDCESPGQLNEWKICTVTQVEELKILIRMFPIWSAMVLFAAVQEQMFSTFVEQGMTMEKHIGSFEIPAASFQSIDTITVIMLVPIYEKVLVPVIRKFTGRANGITSPQRIGIGLCFSMFSMLLAALVESNRLQIAQAEGLVHSKVVVPMSILWQGPQYFLLGVAEVFSNIGLTEFFYDESPDAMRSLGMAFSLLNISVGNYLSSFILSLVPVFTARGGSPGWIPDNLNEGHLDRFYLMMAGLSLLNIFVFAFYARRYKCKKAS

SEQ ID NO: 44812 - protein, 208 aa, Aspergillus oryzae
MASLKGPGATPSFDGSGLRIAIVHARWNMGIIGPLVEGARKSLLAAGVVEDHITTLTVPGSYELPYAAQRLYAASQLQAAKSSSSGEGISATDLLSSSTADISKASPESPTPATSRPFDAIIAIGVLIKGETMHFEYIADAVSHGLMRVQLDSGVPVIFGVLTVLTEEQGLERAGLGKKGMHNHGEDWGSAAVELGARRREWAEGRIA

SEQ ID NO: 44813 - protein, 376 aa, Bacillus cereus ATCC 10987
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 44814 - protein, 468 aa, Francisella tularensis subsp. holarctica
MITPIILSGGSGSRLWPLSREASPKQFIGLVDEHSLLENTIKRLDNVKDITSPVVVCNESHRFQVAEVLRKINKKGDILLEPLARNTAPAIALAALHLATNDPNTIMLVLAADHHIENLEIFHQAIEKAQQKVIKDDSLVTFGITPTCPHEGYGYIKQGVQTTVNGVYKVDKFVEKPSAVVAQEYLDSGKYYWNSGMFMFTARAYLEALEKLQPEIYRGCEKTYQKSQQDLDFVRFDKQSFTLVQSQSIDYAVMEKATNVAIVPMQQSGWSDVGSWDSLYDIAAKDSCGNVVIGDVITSNVKNSYLRSHDRLLAAVGVNDLIIVETADAILVADKNKTQDVKKIVEILKIQQRSELLQHKQIYKSWGSATILEDKSGYKIQAIQLEPGKKLSLQQHYHRSEHWIVISGTATVTIGTTKSIVRPNESVYIKIGESHRLENNGKIPVILIEVQVGEYISEDDIVRLYTSS

SEQ ID NO: 44815 - protein, 625 aa, Staphylococcus aureus subsp. aureus MW2
MEAYKIEHLNKSYADKTIFDNLDLSISEGEKIGLVGINGTGKSTLLKVIGGIDDDFTANVMHPNQYRIRYSSQKQDLNEDMTVFDAVLSSDTTTLRIIKQYEQAVQAYADDQSDKLFKRMMDAQDAMDQHDAWDYNAEIKTILSKLGIHDTTKYIKELSGGQQKRVVLAKTLIEQPDLLLLDEPTNHLDFESISWLINYVKQYPHTVLFVTHDRYFLNEVSTRIIELNRGKLASYPGNYESYIEMRAEREVSLQKQQQKQRALYKEELAWMRAGAKARTTKQQARINRFNDLENEVNQQYKDDKGELNLAYSRLGKQVFELEDLSKAINDKVLFEHLTEIIQKGERIGVVGPNGAGKTTLLNILSGEDQQFEGKLKTGQTVKVAYFKQTDETLDRDIRMIDYLREESEIAKEKDGTSVSITQLLERFLFPSATHGKKVYKLSGGEQKRLYLLRLLVHQPNVLLLDEPTNDLDTETLTILEDYIHTFGGTVITVSHDRYFLNKVAQSYWFIHDGQMEKIIGTFEDYESYKKSLDKNKSTLKQQSKSSTTVRKKNGLSYKEKLEYEQLMKRIEQAEVRMEEIDVLMIEASADYGKIKELNEEKEQLEIQYDLDITRWSELEEIKEQQ

SEQ ID NO: 44816 - protein, 405 aa, Saccharomyces cerevisiae
MNIGGGKFLLGRISNNPTSGIVGLANVGKSTFFQAITNSKLGNPANYPFATIDAECAKVNIPSVPLSNLLRIYQSAKCVPGTLTIYDIAGLTRGASQGHGLGNKFLNDIRHVEGIFQVVRGFLKEDITHIEGNVDPVRDLSVVQDELILKDLEFLENIRERLSKKMRMVSKNSKEHQEMKIETELLDALEEHLFNGKKIRHFKDHWNLDEVKILNKHNFLTSKPTLILLNVSPQDYVRNENKFVRNIIEWINEFSPGDKFLLFSAEFESQLMECKGIASEYFDKIKEDTNVSDQQLVSAIPQIILEMRKLLNLISFFTCGPQEVHQWNIREGTTAQEAAGVIHSDLRETFISADVIKYDDLKKMEPPLNESLLKSKGLIKRAGKQYIMQDNDIALFKAAGGKIKK

SEQ ID NO: 44817 - protein, 386 aa, Aspergillus oryzae
MFSLRTAQPAQSFLRRAAVTAPTVRSSLAARSFASVQSDIFKPTKYGGKYTVTLIPGDGIGAEVAESVKTIFKADNVPIEWEQVDVSGVDAGNKHSEELFKESIASLRRNKLGLKGILFTPVERSGHQSFNVALRQELDIFASIVLIKNIPGYKTRHENVDLCIIRENTEGEYSGLEHQSVQGVVESLKIITRAKSERISKFAFGFALANNRKKVTCIHKANIMKLADGLFRSTFHKVAENYPTLEVNDMIVDNASMQAVSRPQQFDVMVMPNLYGGILSNVGAALVGGPGVVPGCNMGRDVAVFEPGCRHVGLDIKGKDQANPSAMILSGSMLLRHLGLDDHANRISKAVYDVIGEGKTRTRDMGGQATTHEFTRAVLDKMEAAL

SEQ ID NO: 44818 - protein, 320 aa, Saccharomyces cerevisiae
MPTNSIKLLAPDVHRGLAELVAKRLGLQLTSSKLKRDPTGEVSFSIGESVRDQDIFIITQIGSGVVNDRVLELLIMINASKTASARRITAIIPNFPYARQDRKDKSRAPITAKLMADMLTTAGCDHVITMDLHASQIQGFFDVPVDNLYAEPSVVRYIKENVNYMDSIIISPDAGGAKRAATLADRLDLNFALIHKERARANEVSRMVLVGDVTDKICIIVDDMADTCGTLAKAAEILLENRAKSVIAIVTHGVLSGRAIENINNSKLDRVVCTNTVPFEEKIKKCPKLAVIDISSVLAESIRRLHNGESISYLFKNYPL

SEQ ID NO: 44819 - protein, 1407 aa, Bacillus cereus ATCC 10987
MKKKNRFVTGIVTAGVLFSTALPFNVLAENPINQIDSSNAQSLLSKLSKEQRQALQTLDANPGFTISPDINTSSSEPVNIIVEFQTAPVKINELKQKEKGLQAAPENIKARIDQEHEEFQKGLKRLYQFSPSVKSGNFQSVQIKRSYKHAINGVALTLPANTVEELLRIGVVKRIWKDYEVKLNLPKQAKQKAPQKLTDSIPQIGVDKLHSEGITGKGIKVGVLDTGIDYNHPDLKDVYKGYRAKPGEDSSKVDPNSVKGWDFINNDADPMETTYTEWQQSGAPEFDDRGSSFYTAHGTHVAGIVSAQKKNTSDSAVKGVAPDIELYNYRVLGPYGSGDSSGIIAAIDKSISDGMNVINLSLGDDSNNPLDPTSIAVNNAMLSGVVTVVAAGNSGPNPATLGSPGASPFAITVGASDSSISLPKLSGHAGQLQFPNLILFGKNFTDKIEDFKGQTLPIESVGIGTPDEFSKKDVKGKIALVARGTLSFDEKIANAKQAGAKAVIIYNNVDGEIPFYVGESTKYIPAFRLTKEDGEKLKAQIEQGNTSFTFDELSYIQTEGDHLADFSSRGPVTSNDDIKPDITAPGVAVLSTVPEYINDPQEGENYDVSYERMQGTSMASPHIAGVAALILQEHPEYSPFDVKTSLMNTADDLKEKYSVYEVGAGRVDAYNAVHTETSFKVLDTTKTVVNDEVIEVPEETGSIAFGKFYQKDGEALEQKRNIKVQNHNKQEKKEFKTEISYTPASSSINDATANGVKVSVPETITLDAGKSDEIEAKINVPAGVKQGRYEGYIHITNTKNKEETYQIPFSIRVSEPGIENAILSRKAISTDTSKFNPYRESYLHGAFQLNSELETLDLIVKDSKTNKALGFLGTLNTSGLKTDVYYYLDSFFNGRVYPFTNDPAKPIGDEKIDLPEGDYTIEFVGYDKDGKARVKGDYVVIDNTPPEVKLTGLQPGIYELNEENYTVEDGKKALWIKGNVYDSNVDYLKGKGLNITQEANGVMYYDYSPYLHKFLPINANGDFKVGITPESFKTEGPMNTGVYIFDYATAGADYPSGVNNYWFIPQGAQYAKTSYDKKEVYKGDEFTVTLNAKHVKQFVAGEFNVKFLEKNFKFANAKLNPAFEKLLSEKGVTAKVNEPKLEEGSVTVGGAIDDKNFAGLDGDFPFIDVTFKVENDEFYEANAQLDLSVFAYWKQGESEPNRMRVLQDQTFSVMSLNSLVEGSIKPGAFLNERGYLDEKFDYTKLGVKVYATDSYRHKFEGSLDKYGSFKLNGLPVNKRDYNLYVEVPGHLTSRLTTKLGTEKDGKLLGQYYYARFDENLAGDVNGDKVIDIKDAEIIANNYGKKGLSVKDGDLNKDGIVDEKDIRFVEKNFLKKGPDASKSQTPVEKSKSGTLADILKKLGLTPKK

SEQ ID NO: 44820 - protein, 586 aa, Xylella fastidiosa 9a5c
MSPQTSLSILLHPGSPAPMSSSSIEDIKGKSHRLRGSLLESLANPTTGALHESDQTLIKYHGSYQQDDRDLREERRRQKLEPAYQFMIRTRTPGGVITPQQWLQLDAIATRYANHSLRVTTRQAFQFHGVIKRELKATMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVAIGGGMGTTHGDPDTWPRVGNIIGFITRADLIAISTAIVTTQRDFGNRTLRKRARFKYTIDDRGLDCIVGEIQQRAGITLQPARPFVFEHNGDRYGWIEGEDRHWHLTLSLPAGRIADTESSPLLSGFRAIAQLGIGQFRMTPNQNVVIAGISPGQRATIDALVTQYGLDTGNRAPTALARHAMACVALPTCGLAMAEAERYLPDFNVKLQPILEKYGLAEKPILLRISGCPNGCSRPYLAEIALVGKAPGRYNLMLGGDQRGQRLNTLYRENITETEILAALEPLLGRYQQKRLPGEGFGDFLHRTGIIALPPYPTHRHVISSTLQA

SEQ ID NO: 44821 - protein, 107 aa, Synechococcus sp. RS9916
MSSAAAVTDASFEQDVLQSDVPVLVDFWAPWCGPCRMVAPIVDEISKEFEGKIKVFKLNTDENPNVASQYGIRSIPTLMVFKGGQKVDTVVGAVPKATLSGTISKYL

SEQ ID NO: 44822 - protein, 470 aa, Vitis vinifera
  misc_feature (42)..(42): Xaa can be any naturally occurring amino acid
  misc_feature (51)..(51): Xaa can be any naturally occurring amino acid
MAMCHSRISQYGIKIVELMDQSEEDSEEHSGIRGAYLLLWEXCQLHEGGBXAGSYFFKSFSKRLECNITAYEFYHRVYVPEGQSPKSDPEEPLRVYVLFQHIQKMLSSETAVIAETGDFWFNCVILGYAQVMPNKRVMITRISILRSQELLEVLGVSGNSNSSQPCKLCGHSENILYMLICDNGEEAFHASCCNPRHIHILIPPPDLSAFPFYPYSIRGNMADVLIHGVPGGMLSVPYDMAGMPFRDAAVSQPAPIEGIDYCPCQILRVSSHHRLVIYTKHSCDIHLTANAVQMGTKFSRNVYLLMPGVASSMGIITESSMVVALATVNAKGSFYPKVIGTSALVLSANEIKNSIEAAVGMNGLICNPEEYVPIFGVASFKKIKAPRRWKESYTPYPLTESDMEELQSRIVVAENLPEDHCHQNLMKIFSTVGSVETIRTYEWLDNLTSDKSDGGEYLVQSADMSKILGG

SEQ ID NO: 44823 - protein, 467 aa, Erythrobacter sp. SD-21
MPSAPEPADYRPETPITELADWLGDPVAPADFPETTLRFRNNRWAAAVGLGDLSDNDWARHFGRFESLEDNLPQPLALRYHGHQFRVYNPEIGDGRGFLFAQMRDGAGRLLDLGTKGSGQTPWSRAGDGRLTLKGGVREILATEMLEALGVYTSKTFSIVETGEQLERGDEPSPTRSAVMTRLSHSHIRIGTFQRLLVLEEQAHMEALVAYCLEHFPGPPPPEDAPGREDPAVRLMHLVVERLADLAASWMVAGFVHGVLNTDNMNISGESFDYGPWRFLPKWEPGFTAAYFDHQGLYAFGRQPEALHWNCGQFAIALRLLADAPPLIAAMERFGPLYMEAVGRRWCWRLGLVPRGGEEDGRLVGACEAEMAASGEQPDAFFYRLRTGGATGEIAELLGTYDKVEDTHAYWSESAPESMLINEVEAIWSAIDERDDWDPLQEKVTRLRRMGDAHGPAPVPCGHISCL

SEQ ID NO: 44824 - protein, 311 aa, Novosphingobium aromaticivorans DSM 12444
MKIMAGNSNLPLARAISAYLEMPLTDASVRRFADEEVFVEIHENVRGEDVFVVQSTSYPANDNLMELLICIDALRRASAKRITAVVPYFGYARQDRKPGPRTPISAKLVANLITQAGADRVLSVDLHAGQIQGFFDIPTDNLFAAPVMAADIQTRYGAQELMVVSPDVGGVVRARALAKRLNNAPLAIVDKRRDRPGQSEVMNIIGEVKGRMCILIDDIIDSGGTLCNAAQALMDAGAVGVSAYITHGVLSGGAVARVAGSALKELVITDTIMPTEATASCDRIRVLTIAPLIGEAVRRIADESSVSSLFD

SEQ ID NO: 44825 - protein, 383 aa, Salinibacter ruber DSM 13855
MKENLTRRPHLSRWRRATGPPWIRAEFSVPNLTLLQPMRAAVFHEPGDIRVEDVPDPSIEAPTDAILRITRTAICGSDLWFYRGHRDYEAGWRTGHEPMGVVEDVGSEVRSLEPGDRVLAPFAISDGTCEFCRQGLHTSCVHGNVWAAEHDGAQGEAVRAPQADGTLVKIPERAEGDASLLRALFPLTDVMGTGHHAAVSAGVEAGSTCVVVGDGAVGLCAVLAAQRLGAERIIAMGHHEERLEKARGFGATDIVSSRGEEAVEEVREMTRGGARHVMECVGAASAIETAISVCRPGGTIGYVGVPFGAEDGGLDMFRLFRENITLQGGIAPVRAYIPELMDDVLDGTLDPSPVFDTTIGLEEVPDGYAAMDERESIKVMVEL

SEQ ID NO: 44826 - protein, 328 aa, Corynebacterium efficiens YS-314
MKLLVTGGAGYVGSVCAAVLVERGHDVTVIDNFTTGNREAVPASATLVEGDVRDVADEVLAAGGFDGVVHFAARSLVGESVDHPADYWQHNMVTSLTLLDAMRAHGVDNLVFSSTAATYGEPEQVPITEDMPTAPTNPYGASKLAIDYAITSYARAYGLGATSLRYFNVAGAYGNIGENREVETHLIPLVLQVALGHREKIFMFGDDWPTADGTAVRDYIHIHDLAEAHVLALESNVGGTHRIFNLGSGDGYSVRQVVEMCREVTGHPIPAEVAPRRAGDPAVLIASSEKAQRELGWNPTRTDLRTIVEDAWAFTSQLGERAHSAHRG

SEQ ID NO: 44827 - protein, 279 aa, Aspergillus oryzae
MSRPEDVLPPDLFYDDNESRKYTTSSRIRNIQSDMTNRALELLDLRSPSLVLDIGCGSGLSGEILSAVPPEHGGPHTWIGMDISPSMLDIALQRDVEGDLFLADIGQGVPFRPGTFDAAISISAIQWLCNAETSDVSPEGRLRRFFEGLYASLRRGGRAVCQFYPKNDAQRNMISGAAIKAGFGAGILEDDPGTKNSKLYLVLTVGGGGLQGDITGVVNGMDDVNILDARRKAMEHGKMQLPRKGDKAWIMRKKEQMERKGKVVKQNSRYTGRKRRPAF

SEQ ID NO: 44828 - protein, 148 aa, Codonopsis lanceolata
MEQTFIMIKPDGVQRGLVGEIISRFEKKGFLLKGLKLLNVEQSFAEKHYADLSAKPFFGGLVEYIVSGPVVAMVWEGKGVVKTGRTIIGATNPAASAPGTIRGDFAIDIGRNVIHGSDAVESATKEIALWFPEGVANWQSSLHSWIYE

SEQ ID NO: 44829 - protein, 300 aa, Robiginitalea biformata HTCC2501
MEEYIITLKETNNPAILKFEANQPLVTKGSYEYKNIDEAKDSPLAQQLFYLPFIKTVYISGNFVAMERFDIVTWDDVKQEVAQQLVEYLNAGEPVVDEPEQAGRVAVTVYAEVTPNPAVMKYVANKQLVPDVFEFKDIDQARHSPLAQKLFGFPFVKEVFMDHNYISVTKYEVAEWEDVSMELREFIREYLAAGGEVLEPGASAEKSQIAGVPEGNLEQMDPISQEIAGILEEYVKPAVASDGGNIVFQSYEAESKTVHVILQGACSGCPSSTFTLKNGIQTMLQNMMGDRVNEVVAING

SEQ ID NO: 44830 - protein, 556 aa, Mycobacterium tuberculosis CDC1551
MPDDIAAADPTDTQPHLRRDLANRHIQLIAIGGAIGTGLFMGSGRTISLAGPAVMVVYGIIGFFVFFVLRAMGELLLSNLNYKSFVDFAADLLGPAAGFFVGWSYWFAWVVTGIADLVAITGYARFWWPGLPIWVPALVTVALILAVNLFSVRHFGELEFWFALIKVAAIVCLIAVGAILVATNFVSPHGVHATIENLWNDNGFFPTGFLGVVSGFQIAFFAYIGVELVGTAAAETADPRRTLPRAINAVPLRVAVFYIGALLAILAVVPWRQFASGESPFVTMFSLAGLAAAASVVNFVVVTAAASSANSGFFSTGRMLFGLADEGHAPAAFHQLNRGGVPAPALLLTAPLLLTSIPLLYAGRSVIGAFTLVTTVSSLLFMFVWAMIIISYLVYRRRHPQRHTDSVYKMPGGVVMCWAVLVFFAFVIWTLTTETETATALAWFPLWFVLLAVGWLVTQRRQSRRSFGFHCQVVGVRQQLGRGMARLAMKIHARPKLRSAVVVEPVSAGEPGARRSAKSVRKLASDDSQSAHCPVAVVGLADGGRDPQYHHDGPDR

SEQ ID NO: 44831 - protein, 799 aa, Xylella fastidiosa Dixon
MALNGASYLNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRRLGSKLVRMVYSDAPGERVKIEDTPTELRHCFAISDADVQELARQALIIEQHYGRPMDIEWAKDGVSGKLFIVQARPETVKSRSHTTQIERFALQQRGEILTEGRAIGQKIGSGIARVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNAAVKKLLSMAIKAARSKGKYIGICGQGPSDHPDLAEWLMQEGIESLSLNPDTVVDTWLRLAKLKTVH

SEQ ID NO: 44832 - protein, 261 aa, Aspergillus oryzae
MMSFMGHQPQSQAVGYTFSQPTNAPNKEHSFYPYTDNGGSTLGITGADFAILAGDTRSVAGYNINSRYAPKVFKIGGDDDTGEGAHIILSVVGFAADGQALKERLDAVVKMYKYQHGKPMSVRACAQRLSTILYQKRFFPYYVHAILAGLDEEGKGALYSYDPVGSYEREQCRAAGSAASLIMPFLDNQVNFKNQYIPSSGDGHALEPKKPEPLPRETVEQLVRDAFTSAVERHIEVGDGLQMMVITQNGIEEIYTPLKKD

SEQ ID NO: 44833 - protein, 411 aa, Saccharomyces cerevisiae
MTSATDKSIDRLVVNAKTRRRNSSVGKIDLGDTVPGFAAMPESAASKNEAKKRMKALTGDSKKDSDLLWKVWFSYREMNYRHSWLTPFFILVCVYSAYFLSGNRTESNPLHMFVAISYQVDGTDSYAKGIKDLSFVFFYMIFFTFLREFLMDVVIRPFTVYLNVTSEHRQKRMLEQMYAIFYCGVSGPFGLYIMYHSDLWLFKTKPMYRTYPVITNPFLFKIFYLGQAAFWAQQACVLVLQLEKPRKDYKELVFHHIVTLLLIWSSYVFHFTKMGLAIYITMDVSDFFLSLSKTLNYLNSVFTPFVFGLFVFFWIYLRHVVNIRILWSVLTEFRHEGNYVLNFATQQYKCWISLPIVFVLIAALQLVNLYWLFLILRILYRLIWQGIQKDERSDSDSDESAENEESKEKCE

SEQ ID NO: 44834 - protein, 227 aa, Burkholderia xenovorans LB400
MTQFRIAPSILSADFARLGEEVRNVVAAGADWIHFDVMDNHYVPNLTIGPLVCEAIRPHVDVPIDVHLMVRPVDRIVPDFAKAGANLISFHPEGSDHIDRTLSLIRDHGCKAGLVFNPATSLNYLDHVMDKVDLVLIMSVNPGFGGQSFIPEALNKLREARQRINAYTERTGREIHLEVDGGVKVDNIAEIAAAGADTFVAGSAIFGQPDHKVVIEKMRAALANIQH

SEQ ID NO: 44835 - protein, 396 aa, Bacillus cereus ATCC 10987
MKQFELSRAAESLQPSGIRKFFDLAANMKGVISLGVGEPDFVTPWNVRQACIRSLEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVHFSELMLKIHQYSMMCAPTMSQFAALEALRAGNDEVIRMRDSYKKRRNFMTTSFNDMGLTCHVPGGAFYVFPSIASTGLSSAEFAEQLLLEEKVAVVPGSVFGESGEGFIRCSYATSLEQLMEAMKRMERFIENKKRTKHNTFCP

SEQ ID NO: 44836 - protein, 247 aa, uncultured archaeon GZfos19A5
MKEEIELIKDGKRLDGRGFDELRPIKIEVGVLKRADGSCYLELGDNKVIAAVYGPREMHPRHAQDAKMAVVKFRYNMAPFSTDDRKRPGPDRRSVEISKVCREAFDPVIMRELYPKMGIEVYVELLQSDAGTRTAGINAASIALADAGIPMKDLVSSIAVGKINGEMVLDLNAAEDNNGEADMPIAMIARTNTITALQMDGRLTKEEFERGLKLAVGACHQIYELQRTALVTRYNQNYESKSKREEE

SEQ ID NO: 44837 - protein, 257 aa, uncultured archaeon GZfos19A5
MGLEIVNDVRTDYVCDLVRNGKREDGRGFREYRDISVERDVIKRAEGSARVKIGDTEVLVGVKVELGTPFPDTPDKGVIITNAELVPLASPKFESGPPNENSIQLARVVDRGIRGSETIDLDKLCIEEGEKVWMVFIDIHVLDDNGNLVDAAALGAITSLLNLRIPNERYGLTGENTLPMRDTPVAVTTVEIEGNILVDPSFDEGNAAASSVTVISNADGALSGMQKSGSGGLKEAQIAEMVEIGIEKAGEIRKKYL

SEQ ID NO: 44838 - protein, 252 aa, Synechococcus sp. RS9916
MSTSPNHGWFDAVATAYQSCRPRYPDSLFRWLAEQAPARHCCWDVACGSGQASEGLALWFNRVEASDLSPAQIAAAPSHPRIHYRVAAAEHSGLEDGSVDAVVVAAAIHWLDVPQFNQEVRRVLRPGGLLAWLGYDPIQGAPPALQRWLDDLYHQRLNPWWPAERAHVDRRYQDLPFPTHSQAIPGALQIDLHWSCNELLGFISTWSALRRAGGQAPALLHDFRAELLELWPADTPQLKLHLPLMGRWGRLS

SEQ ID NO: 44839 - protein, 550 aa, Oryza sativa Japonica Group
MHKNNDTIMPSQLIAQNDHAYVLTFLMSIAMAILLLVALFYRIKKQAAAMAAKRKQQPKLPPGLATMPVVSNMHQMLMNKPVFRWIHRLLDEMDTEILCLRFGRVHVIAVASPEMAREVLRKKDAMLASRPSSFVSRTFSFGYKNTIMSPAGDQWRKMRQVLTSEILSPAMERRMLGRRVEEADHLVNYVYSHCNDGTVDVRHVTRHFCGNIIRKLVFGRRHFNSGDGNIGPGRDEEAHIDALFTALDYHGAFSVSDYFPTLVGLDLDGHEEVVNGLMNTFNRLHDPIIMERIEEWKSLRTKGDKRREVADFLDVLISLEDAQGKPFLSVDEIKAETLEIILATVDNPSNAVEWALAEMVNNPKVMKKAVDELDMVVGRERLVEESDIHNLTYLKACIREAFRLHPYHPFNPPHVAIADTTVAGYMIPKGSHVMLSRIGLGRNPRAWDKPLEFQPERHLKNTGTVVLAEPELRFVSFSAGRRGCPAVSLGTSITMMLFARLLQGFSWSIPPGGDRIELQESATSLQLSKPLLMQAKPRLLLHLYEADVLN

SEQ ID NO: 44840 - protein, 181 aa, Synechococcus sp. CC9311
MSIFVGNLPFRAEQEDIIELFSTYGEVTNCALPLERDTGRKRGFAFVEMSDEAAEASAIEALQGAELMGRPLRINKAEPRGSAPRRDFGGGGGGNYGGGGGGNYGGGGGGNYGGGGGGNYGGGGGGNYGGGGERRSGASGWEDRSYGSGAPPAGGSAYDDGRTRRRRGGADDNSGYGGAEG

SEQ ID NO: 44841 - protein, 338 aa, uncultured archaeon GZfos34H10
MATYAHNLFLDSNLGDSGLFPGTKAMEDELIRMIGSLLGNENAHGYISTGGTESNIQAIRAIRNRKRKEGLQEMNIIVPKTAHFSFDKIESLLCLEVKKAGLDDELRVDVNLVKELIDDNTISIVGIAGTTEFGQIDPIKELADIAHNSDIFLHVDAAFGGFVIPFLDAEYQFDFSLDAVSSISVDPHKMGMSTIPAGCILFRDESYLADLAVNTPYLTTNEQCSLIGTRSGAPVAATYAVLKYLGRNGLRAIVDECMLLTRMLVRGAKAMDIYPVIEPVMNVVTLRFPDVDRVAKALEARGWQVSTTRAPKALRLVIMPHVTEDTIEMFLNDLACVT

SEQ ID NO: 44842 - protein, 224 aa, uncultured archaeon GZfos34H10
MHRKEQIRGNVKRLLAELPKDVVLEAAAKTRTTEETLAAIEAGITIVGENYIQEAERAFEVIGRVVNWHFIGHLQRNKVKKAVELFDLIETIDSFSIAEEVNRVSSKIGKIMPILIEINSGREPQKFGVFPEYVAELVVKISALASVKIVGLMTMGPYEEDIEKSRLYFRAAKEIFERIKKSGIPSVDMRFLSMGMSDSYNIAIEEGANIVRVGTGIFGPRGRV

SEQ ID NO: 44843 - protein, 260 aa, uncultured archaeon GZfos34H10
MGQEVIEDIRKDYVYDLIEKGKRADGRGFLDFRDIIVERDLIKKADGSTRVQIGDTVVLVGVKVEPGEPFSDTPNKGILMTNAELVPLASPEFESGPPNENSIELARVVDRGIRGSETIDLEKLCIEEGEKVWMLFIDIHTLDNDGNLVDAAALGAITSLLNVAIPYEQYGLTGEDTLQIRDTPVAVTVVEIGGNLLVDPNVYEESAATSKLTVISNADGSISGLQKSGSNGLTEEKIVKMAEIGIEKAREIREKYLPKI

SEQ ID NO: 44844 - protein, 242 aa, uncultured archaeon GZfos34H10
MKEGKMELIKDGKRLSGRGFEELRPIKIEVGVLKRADGSCYFELGNNKVIAGVYGPREMHPRHFQNAKMAVVKYRYNMAPFSVDDRKRPGPDRRSQEISMVSRKALDPVILRELYPKTAIEVYVEVLQSDAGTRTAGINAASVALADAGIPMRDLVSSVAIGKIDGEVVLDLDAKEDNFGEADMPIAMIARTNTITLLQMDGRLKKEEFERGLKLAMDGSRKIYELQKAALVEKYSKSGNEE

SEQ ID NO: 44845 - protein, 442 aa, Salinibacter ruber DSM 13855
MPALARSLDRIRETTVPARRYGRVTSVVGLLVEASELDAAVGEMCRIHVAEGGETRTVRAEVVGVKESTTVLMPMEQTHGLQAGCLIRPADEGMSVPVGPDLLGRVIDAGGRPIDGKGPLGTDAREPIHRDPPSPLDRPLIDTPLSTGIRSIDAFLKMGKGQRTGIFAGSGVGKSTLLGMIARRAEADVNVIALIGERGREVREFIVDNLGEEGLRRSVLVAVTGDEAAMSRVKAASAAMAIAEHFRDRGQDVLLMMDSITRVAQAQREIGLAVGEPPTRRGYPPSVFALLPRLLERAGPAEAGTITGIFTVLVEGDDMSEPISDAARGILDGHIVLSRELAEAGHYPAVDVLQSVSRVMPRVASLEAEAAAQEARELLSAYEEVEDLISVGAYEEGSDPETDRAVEAYPALADFLQQPVDAPPPDPAPSTQLRQLLDDIPE

SEQ ID NO: 44846 - protein, 164 aa, Brassica napus
IEIFKNTTFPRICRTSFTRVPNRITKHDRVIWLGDLNYRIALSYTETKTLLDKNAWDTLLNKDQLKIERDAGRVFKGWHEGKIFFAPTYKYSYNSDAYAGDTTKEKKNKRRTPAWCDRILWHGDGIRQLSYVRGESRFSDHRPVCSVFVVNVEVCEGRTGARRQ

SEQ ID NO: 44847 - protein, 340 aa, Schizosaccharomyces pombe 972h-
MSSYILFGLENPLLDYYVGGETATLEKYGLKSNDAVLASESQMGIYKEPCVSYSAGGAAQNSCRAAQYVLPPNSTVFAGCVGQDKFADMLLESNEKAGLRSEFSVDPTTPTGVCAVVLSNNNKNRSLCTNLGAANNYKLKDLQQPNVWKFVEEAKVIYVGGFHLTVSPESMLCLAQHANENNKPYIMNLSAPFLSQFFKEQMDSVIPYCDYVIGNEAEILSYGENHGIKSTDVQEIALALSSVEKVNKKRTRVVVITQGADATIVAKDGKVTTYKPNRVPSEEIVDTNGAGDAFAGGFIAALSQGQGIDYAVTLGHWLGQECIKVSGTTLPLPKKQFPLP

SEQ ID NO: 44848 - protein, 457 aa, Legionella pneumophila subsp. pneumophila str. Philadelphia 1
MLNPREIRTIEDAKRIVEERQLTHVKVGLFDIDGVMLGKYMSRNKFFSALEHGFAFCDVILGWDSKDKLYDNVKYTGWHTGYPDASVRIVPSTCREILFEENQLLFMAEFSQAAEAICPRGILRRVINKAAGMGYDVYAALEYEFFVFDETPDSVRAKGFRNLKPVTPDNFGYSIIRNTVHAEFYHQILTMAEKMDFPIEGLHTETGPGVLEAAIAVDDAEAAGDKAALFKTFMKILAQRNNKMATFMAKWSGDYPGQSGHIHLSLRDRDGGKSAFYESGREYNMSKIQRHFLAGQQKLMPEFLAMLSPTVNSYSRLIPGYWAPTEATWGVENRTTALRVIPGSDKSQRIEYRLGSADANPYLALAAAIGSGLYGIENELEPEAEVKGNSYEQHHSPALALPRTLWESAQNLKNSSAAYELFGQEFVEHFAASREWEEREFRKHITDWELDRYFEII

SEQ ID NO: 44849 - protein, 146 aa, Schizophyllum commune
ARAKTCYKCGGEGHISRDCSSADAGGAGGYSGGGFGGGARGGECYRCGKAGHMARACPEPAPGGNASYGGGGSYGYGGGFQSQKSCYTCGGVGHLSKDCVQGQRCYNCSETGHISRDCPNPQKKACYSCGSESHISRDCPGAVAAA

SEQ ID NO: 44850 - protein, 175 aa, Escherichia coli
SLLNVPAGKDLPEDIYVVIEIPANADPIKYEIDKESGALFVDQFMSTAMFYPCNYGYINHTLSLDGDPVDVLVPTPYPLQPGSVTRCRPVGVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 44851 - protein, 210 aa, Mesorhizobium sp. BNC1
MKNPVETAMNLVPMVVEQTNRGERAYDIFSRLLKERIIFITGPVEDGMATLVCAQLLFLEAENPKKEIALYINSPGGVVTSGMAIYDTMQFIQPPVSTLCIGQAASMGSLLLCAGHKDMRFATPNARVMVHQPSGGFQGQASDIERHAQDIIKLKRRLNEIYVKHTGQDYDTIERTLDRDHFMTADEAQAFGLVDRVISEREAIEAPRTS

SEQ ID NO: 44852 - protein, 429 aa, Saccharomyces cerevisiae
MANNTWKLIATTALISVFSTQLAKSVWKEYKLSCAANKNKTVSRPRQYDDHLFREQLARNYAFLGEEGMRKIKEQYIVIVGAGEVGSWVCTMLIRSGCQKIMIIDPENISIDSLNTHCCAVLSDIGKPKVQCLKEHLSKIAPWSEIKARAKAWTKENSHDLIFADGESPTFIVDCLDNLESKVDLLEYAHHNKIDVISSMGVATKSDPTRVSINDISMTEFDPISRCVRRKLRKRGIATGISVVFSNEMLDPRRDDILSPIDCEHRAINAVRDEALRHLPELGTMPGIFGLSIATWILTKVSGYPMKENEVKNRLKFYDSILETFQKQMARLNENKERSSLLGLEEVGYIVEEMFRGKSPISGYSTKLALTKWEANKEISLTNVVLMTKEEQEIHEKRILLDGEKLTAVYSEEVLDFIERLFKEEEYYS

SEQ ID NO: 44853 - protein, 472 aa, Saccharomyces cerevisiae
MGCTVSTQTIGDESDPFLQNKRANDVIEQSLQLEKQRDKNEIKLLLLGAGESGKSTVLKQLKLLHQGGFSHQERLQYAQVIWADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDADRNNSSRINLQDICKDLNQEGDDQMFVRKTSREIQGQNRRNLIHEDIAKAIKQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKIGII

SEQ ID NO: 44854 - protein, 253 aa, Picea sitchensis
MGRKFFVGGNWKCNGTLEEVKKLVGTLNAAEVPSEDVVEVVVSPPFVFLSTVKALLRSDFAVAAQNCWVRKGGAFTGEISVEMLVNLGIPWVILGHSERRLLLNEDKEFVADKVAYALSQGLNVIACVGETLEQREAGDTLNVVSEQTKAIADKVVNWSNIVIAYEPVWAIGTGKVASPAQAQEVHYELRNWLNVNVSPEVAASTRIIYGGSVNAGNCVELAAQPDLDGFLVGGASLKAEFVDIIKSATVKQG

SEQ ID NO: 44855 - protein, 214 aa, Oryza sativa
  misc_feature (2)..(2): Xaa can be any naturally occurring amino acid
  misc_feature (14)..(14): Xaa can be any naturally occurring amino acid
  misc_feature (27)..(27): Xaa can be any naturally occurring amino acid
  misc_feature (48)..(49): Xaa can be any naturally occurring amino acid
  misc_feature (52)..(52): Xaa can be any naturally occurring amino acid
  misc_feature (75)..(75): Xaa can be any naturally occurring amino acid
  misc_feature (81)..(81): Xaa can be any naturally occurring amino acid
  misc_feature (89)..(89): Xaa can be any naturally occurring amino acid
  misc_feature (93)..(93): Xaa can be any naturally occurring amino acid
  misc_feature (97)..(97): Xaa can be any naturally occurring amino acid
  misc_feature (101)..(101): Xaa can be any naturally occurring amino acid
  misc_feature (109)..(110): Xaa can be any naturally occurring amino acid
  misc_feature (121)..(122): Xaa can be any naturally occurring amino acid
  misc_feature (124)..(124): Xaa can be any naturally occurring amino acid
  misc_feature (127)..(127): Xaa can be any naturally occurring amino acid
  misc_feature (133)..(133): Xaa can be any naturally occurring amino acid
  misc_feature (135)..(136): Xaa can be any naturally occurring amino acid
  misc_feature (138)..(138): Xaa can be any naturally occurring amino acid
  misc_feature (144)..(144): Xaa can be any naturally occurring amino acid
  misc_feature (150)..(150): Xaa can be any naturally occurring amino acid
  misc_feature (156)..(157): Xaa can be any naturally occurring amino acid
  misc_feature (164)..(164): Xaa can be any naturally occurring amino acid
  misc_feature (170)..(171): Xaa can be any naturally occurring amino acid
  misc_feature (173)..(173): Xaa can be any naturally occurring amino acid
  misc_feature (175)..(177): Xaa can be any naturally occurring amino acid
  misc_feature (179)..(179): Xaa can be any naturally occurring amino acid
  misc_feature (181)..(182): Xaa can be any naturally occurring amino acid
  misc_feature (187)..(188): Xaa can be any naturally occurring amino acid
  misc_feature (195)..(195): Xaa can be any naturally occurring amino acid
  misc_feature (203)..(203): Xaa can be any naturally occurring amino acid
WXTVSSSVFLIEIXADIFSIKDDQGSXHLVDKVLDKTGMKGTGKWTVXXAAXLSVAAPTIEASLDSRFLSGLKDXRVEAAXVFQGDFSXNLPXDKAXLIEXVRQALYAXXICSYAHGMNIXXAXNMXKGWSLXLXXLXKIWKGXCIIRAXFLERIXXAYHRNSXLPHLLXXPXFXXXIXDXXTALRXXVCLVINXGSAPRMSXILLHTEGAASH

SEQ ID NO: 44856 - protein, 530 aa, Saccharomyces cerevisiae
MSATKSIVGEALEYVNIGLSHFLALPLAQRISLIIIIPFIYNIVWQLLYSLRKDRPPLVFYWIPWVGSAVVYGMKPYEFFEECQKKYGDIFSFVLLGRVMTVYLGPKGHEFVFNAKLADVSAEAAYAHLTTPVFGKGVIYDCPNSRLMEQKKFVKGALTKEAFKSYVPLIAEEVYKYFRDSKNFRLNERTTGTIDVMVTQPEMTIFTASRSLLGKEMRAKLDTDFAYLYSDLDKGFTPINFVFPNLPLEHYRKRDHAQKAISGTYMSLIKERRKNNDIQDRDLIDSLMKNSTYKDGVKMTDQEIANLLIGVLMGGQHTSAATSAWILLHLAERPDVQQELYEEQMRVLDGGKKELTYDLLQEMPLLNQTIKETLRMHHPLHSLFRKVMKDMHVPNTSYVIPAGYHVLVSPGYTHLRDEYFPNAHQFNIHRWNKDSASSYSVGEEVDYGFGAISKGVSSPYLPFGGGRHRCIGEHFAYCQLGVLMSIFIRTLKWHYPEGKTVPPPDFTSMVTLPTGPAKIIWEKRNPEQKI

SEQ ID NO: 44857 - protein, 495 aa, Chlamydomonas reinhardtii
MDLPPELAVLADKVLSLSPVVLVALGSAVLILALAVGRVLFNLLPSKRPPVWEGLPFIGGLLKFTGGPWKLLENGYAKFGECFTVPVAHRRVTFLIGPEVSPHFFKAGDDEMSQSEVYDFNIPTFGRGVVFDVEQKVRTEQFRMFTEALTKNRLKSYVPHFNKEAEEYFAKWGETGVVDFKDEFSKLITLTAARTLLGREVREQLFDEVADLLHGLDEGMVPLSVFFPYAPIPVHFKRDRCRKDLAAIFAKIIRARRESGRREEDVLQQFIDARYQNVNGGRALTEEEITGLLIAVLFAGQHTSSITTSWTGIFMAANKEHYNKAAEEQQDIIRKFGNELSFETLSEMEVLHRNITEALRMHPPLLLVMRYAKKPFSVTTSTGKSYVIPKGDVVAASPNFSHMLPQCFNNPKAYDPDRFAPPREEQNKPYAFIGFGAGRHACIGQNFAYLQIKSIWSVLLRNFEFELLDPVPEADYESMVIGPKPCRVRYTRRKL

SEQ ID NO: 44858 - protein, 134 aa, Triticum aestivum
KPNMVTPGSESKKVSPQLIAEYTVRALQRTVPAAVPAIVFLSGGQSEEEATVNLNAMNKLSTKKPWAMSFSFGRALQQSTLKAWGGKTENVVKAQKAFITRCKANSEATLGTYQGDAVLGEGASESLHVKDYKY

SEQ ID NO: 44859 - protein, 710 aa, Xanthomonas oryzae pv. oryzae KACC10331
MQIAVCALVLTGIGMLLGFAPPVAFVAASGFVLTSTAVVMQLLAERGDVALPPGQKIVAILLFEDLLIVPLLAIVAWMAASCDPQAASQRWQGIGIGLACIVGLLVAGRWLLNRLFRILAASKAREVMTAAALLVVLGAALLMQVAGLSMAMGALLAGVLLSESTFRHQIEADIEPFRGILLGLFFLGVGMSLDLRVVAADWRLIVAGVLALMVGKGACIYAVARLMRSDHRQALDRGMLMAQGGEFACVLFAAASASGVIDAQVTASLTAIVVLSMALTPLFVLLQRRLTPAAAVSLDGVEEASGQTGSDLIIGFGRFGQVASQSLLARDVAVTIIDNDIEKMQSAEELGFKIYYGDGPGWTCCMPPARTAHARCGLRRQPGGGQSHRRTGNARVSACQAAGAFLRSPAFAATGGCGRGLPDPRDLRVGGDLRQSRAGGTGDGRGPSRHDFAPYSSARCRAFRIGDRCRRCTRRSRADVRQHVASRAPAHTVHATASRQPHAQSRCGAVSRASRDSDTRVRAANETTAQAPGRCGRRRWAFTTHPPRLVRAVCTYLTTARYLVAPEKPSQTPNAMFAGHMMLERVEGRARTTCNQARKKAIQRSRHRRLSPAAQPSTCSASPWAPLRWQRFKRQSCFRCPITGSTACRRLIQRHCRRVSVLALPRCRICTPSTSRPRYPKSTIATFGITFTSCSSPRACSSCSANVSPS

SEQ ID NO: 44860 - protein, 364 aa, Burkholderia xenovorans LB400
MSLKCGIVGLPNVGKSTLFNALTKAGIAAENYPFCTIEPNVGIVEVPDARLKALAEIVKPERILPAVVEFVDIAGLVAGASKGEGLGNQFLANIRETDAITHVVRCFEDENVIHVANKVDPLSDIEVINTELALADLATVEKALARYSKAAKSGNDKEAIKNAAVLEKVRAQLDQARPVRALDLSDEEKATLKPFCLITAKPTMYVANVKENGFENNPHLDAVTKFAATENAPVVAVCAAIEAEIADLDEADMEVFLADMGMEEPGLNRVIRAAFKLLGLQTYFTAGVKEVRAWTIHIGDTAPQAAGAIHTDFERGFIRAQTIAFNDFITYKGEQGAKEAGKMRAEGKEYVVHDGDVMNFLFNV

SEQ ID NO: 44861 - protein, 214 aa, Picea sitchensis
MASEVVMVDEFQFPKSIAPTASKALHLVGYGITDMEIHFLQIKFTAIGIYLNAEVASHLQGWKGKSGAEILADDDFFDSLCGAPVDKFIRVVVIKELKGAQYGLQLENAVRDRLAAIDKFEEEEEEALEKLVEFFQGKYLKKNSLITYHFSASTKTVEVSFLAEGKEENKLAKTVVENENVAAMIKKWYLGGSSAVSQNTVKTLADGMAALLKQ

SEQ ID NO: 44862 - protein, 255 aa, Shewanella sp. ANA-3
MAVLQGKVAIITGASSGIGYATAKRFAREGAKLVLGARRGAILASLVDEIITQGGEAIYLAGDVTDEVYASDLVALAVEQYGGLDIAFNNVGINGELGVDSDALSRAEWENTLTTNLTSAFLAAKYQLPQMLKRGAGSIIFTSSFVGYTIGFPQTAAYAASKAGMIGLTQSLAVEYGARGIRVNALLPGGTDTPMGREFANTPEAMAFVKNLHALKRLADPAEIAQSALYLASDAASFTTGIALLVDGGVSICKT

SEQ ID NO: 44863 - protein, 419 aa, Burkholderia thailandensis E264
MPYQHIKVPEGGDKITVNKDFSLNVSDQPIIPYIEGDGTGFDITPVMIKVVDAAVEKAYGGKKKIHWMEIYAGEKATKVYGPDVWLPEETLQVLKEYVVSIKGPLTTPVGGGIRSLNVALRQELDLYVCLRPIQYFKGVPSPVREPEKTNMVIFRENSEDIYAGIEWAAESEQAKKVIKFLQEEMGVKKIRFPETSGIGIKPVSKEGTERLVRKAIQYAIDNDRKSVTLVHKGNIMKFTEGTFRDAGYALAQKEFGAVLIDGGPWMKFKNPKTGNEIVIKDSIADAFLQQILLRPAEYDVIATLNLNGDYISDALAAQVGGIGIAPGANLSDSVAMFEATHGTAPKYAGKDYVNPGSEILSAEMMLRHLGWTEAADVIIAAMEKSIKQKRVTYDFARLMEGATQVSCSGFGQVLIENMQ

SEQ ID NO: 44864 - protein, 144 aa, Zea mays
  misc_feature (64)..(64): Xaa can be any naturally occurring amino acid
  misc_feature (124)..(124): Xaa can be any naturally occurring amino acid
MVAVDLTSWTSKKVYGGDGGAYYEWSPADLSMLAVASIGGAKISLAAGGLYLPSYSDSAKVDYXVLQGVCTCGLVLSDATNEKVVQTNEEDAMTLAFGALTSCYYGPVAQADITVLFISDTSRXHKRMLFIYFQLTRPADIFWG

SEQ ID NO: 44865 - protein, 212 aa, Brassica napus
MSQNGKLIPPNMDQNSTRLLNLTVLQRIDPFIEEILITAAHVTLYEFNIEISQWSRKDVEGSLFVVKRNKQQPRFQFIVMNRRNTDNLVEDLLGDFEYEVQGPYLLYRNASQEVNGIWFYNERECEEVARLFDRLLSAYSKANQKPNTSSSKSEFGELEAVPTMAAMDGPLEPSLTARDAPNDPAFVNFFSSAMTLGNGSASGPPYQSSATP

SEQ ID NO: 44866 - protein, 324 aa, Oceanobacillus iheyensis HTE831
MKATAKAHTNIALIKYWGKRNEPIILPTNSNLSLTLDGFSTVTTVHFQEELSSDEFFLNDRLVEDAASQRVTGFLDKVRAMAGKEMYARIHSLNHVPTAAGFASSASGFAALAAASTKAIGLELNDTELSILTRQGSGSACRSIYGGFVEWQMGEKEDGSDSYAVPIASKDHWDIRVAAVVLSATEKKVSSRDGMRRTVETSPFYDGWLKQTPKDLEEIKTAIHDKDFEKTGSIAEANCMRMHATTLGANPPFTYWQDTTMRVMQNVQQMREEGIPAYFTIDAGPNVKVLYLPKDESKVKQRLEQIMGVEDVIVSKPGKGISYL

SEQ ID NO: 44867 - protein, 363 aa, Synechococcus sp. RS9916
MLKAGIVGLPNVGKSTLFNALVANAQAQAANFPFCTIEPNVGTVAVPDDRLQKLSDLSSSKETIPTRMEFVDIAGLVKGASQGEGLGNKFLANIREVDAIVHVVRCFEDDDVIHVSGSVGPARDAEVINLELGLADLSQIEKRRERLKKQMRTSKEAQVEDAALERIQEVLEKGGSARSVALSDDEAAMIKPLGLLTAKPIIYATNVSEDDLAGGNRFCEEVVALAAKEGAETVRISAQVEAELIELGDEERADYLEGLGVSEGGLQSLIRATYRLLGLRTYFTTGEKETRAWTFKAGMTAPQTAGVIHTDFERGFIRAQTIGWEKLLEAGSLAEARNKGWLRSEGKEYVVDEGDVMEFLFNV

SEQ ID NO: 44868 - protein, 570 aa, Corynebacterium efficiens YS-314
MANVADVSHDTSFKGTGVVGGVRYARAVWITPRPALPTAGAEIPEDGRENEQSRFTVAADTVSSRLLARSESVTGAASEVLKATAGMVDDRGWRRAVAKNIKGGHPAEYATVLATDKFIEMFEKAGGIIAERITDLRDIRDRVIAELRGEPEPGLPAVDGQVILFAEDLSPADTAALDTDLFIGLVTELGGPTSHTAIIARQLNVPCIVAAGAGIKRISSGTKVLIDGSLGTVLVNPDEDMALAQVEESRARAAKIAQWTGPAQTRDGHRVQLLANVQDGATARTASTTVAEGIGLFRTELCFLSSTEEPSVEEQADIYARVLEAFPESKVVVRTLDAGSDKPVPFTSMPEEMNPSLGVRGLRIAFDNEGLLTRQLDAIARAATELGRDDTAPTWVMAPMVATVGEAKWFARLCRERGLIPGAMIEVPAAALMADKIMPHLDFVSIGTNDLTQYAMAADRMAPSLASLTDPWQPAVLRLIKMTCDEGQRQDVPVGICGEAAADPLLAVVLTGLGVNSLSAASTALAGVGAQLAEVDLATCRQAAVAALDAEDALRAREAVRAAIAAGQPG

SEQ ID NO: 44869 - protein, 401 aa, Arabidopsis thaliana [sequence omitted]

SEQ ID NO: 44870 - protein, 841 aa, Oryza sativa Japonica Group
MPLGQRAGDKSESRYCGVEVLDFPAGEELPAVLSHSLSSSFDFLLAPLVDPDYRPTPGSVLPVAASDLVLGPAQWSSHIVGKISEWIDLDAEDEQLRLDSEITLKQEIAWASHLSLQACVLPPPKRSSCANYARVVNHILQGLTNLQLWLRIPLEKSEPMDEDHDGAKDNSDMVGYSLIRSTLPSMNSLGRWFGEPAFLTNARGYPCLSKRHQKLLTGFFNHSVQVIISGRSNHNVSQGGVLSGDENHTEDTAVRHALSPYLDYIAYIYQRMDPLPEQERFEINYRDFLQSPLQPLMDNLEAQTYETFEKDTVKYTQYQRAIAKALVDRVSDDDVSTTKTAAEETGRKLKVYAVEKNPNAVITLHSLIKLEGWESLVTIISSDMRCWEAPEKADILVSELLGSFGDNELSPECLDGAQRFLKPDGISIPSSYTSFIEPITASKLHNDIKAHKDIAHFETAYVVKLHRIARLAPTQSVFTFDHPNPSPNASNQRYTKLKFEIPQETGSCLVHGFAGYFDAVLYKDVHLGIEPNTATPNMFSWFPIFFPLRKPIYVPSKTPIEVHFWRCCGATKEKGEERERIEGIGEEDMTCEGIEEEDMTCEGIEGERECEQTADLSPLMEETATAAAAAEKASSYRYWVREATGDAAPLPVPRKLDATAAAAANGNGNPPPLGSVWNQAGTWEEKNLNSWANSRIKEMLGSLDSLEFPTGKASLDGVSKCIGDAFLVTVRNKKRVGYTYELSLKFKGEWLIKEEKMKVKGHLDIPEFSFGELEDLEVEVRFTDDKGLASDDKRQICKDLKSFLSPIREKLRAFEEELKDRSLKVPYFSQYPIACNCDCML

SEQ ID NO: 44871 - protein, 254 aa, Sinorhizobium meliloti 1021
MTEIPSFDDLLDFSGKTVVVTGAATGIGRAVAEAFATKRARVALLDRDAAVSDVAVSLGTGHIAHVADVTDEQGVERAVKSVTEAFGRIDILINNAGIGPLAPAESYPTAEWDRTLAVNLKGAFLMARAIAPGMLEQGSGRIVNMASQAAIIGIEGHVAYCASKAGIIGMTNCMALEWGPRGVTVNAVSPTVVETELGLTGWAGEKGERARAAIPTRRFAKPWEIAASVLYLAGGAAAMVNGANLMIDGGYTIT

SEQ ID NO: 44872 - protein, 540 aa, Nostoc sp. PCC 7120
MNTAVTLLTEQAPQPIEEFGQLERQIIIILDFGSQYSELIARRIRETQVYSEVLSYRTPAEHLRQLNPKGIILSGGPSSVYSDRAPHCDPEIWNLGVPILGVCYGMQLMVNQLGGEVAKADRGEYGKASLHIDDPTDLLTNVEDGTTMWMSHGDSVTKMPPGFEVLAHTDNTPCAAVADHEKKLYGVQFHPEVVHSVGGLALIRNFVYHICECEPTWTTAAFVEEAIREVRAKVGDKRVLLALSGGVDSSTLAFLMHKAIGDQLTCVFIDQGFMRKYEPERLVKLFQEQFHIPVEYVNARDRFLDIMSGVTDPEEKRRRIGHEFIQVFEETSKNLGPFDYLAQGTLYPDVIESADTNVDPQTGERVAVKIKSHHNVGGLPKDLRFKLVEPLRKLFKDEVRKVGRSVGLPEEIVQRQPFPGPGLAIRILGEVTADRLNILRDADLIVRQEINQRGLYNEYWQAFAVLLPIRSVGVMGDQRTYAYPIVLRIVKSEDGMTADWARVPYDVLEAISNRIVNEVKGVNRVVFDITSKPPGTIEWE

SEQ ID NO: 44873 - protein, 546 aa, Zea mays
  misc_feature (152)..(152): Xaa can be any naturally occurring amino acid
KDPNNVQDYVQRHLLSLSVWEELRFWDGYFEYLMENCSNKSANYVTLVTAQLILMATHMAGLGLPDIDSWNMIEKIAERNNLGYKQLIKLRALLTHLQQLRIGYWGVATGKSQPLQSYGMASPHAIDVIDESQQPAEASGLGRSWVQSRPSXRGGPAAGSFYRASDGNAAAATGKTEISAAQKKTQTNMRTLRGHTGAITALHCVTRKEVWDLVGDREDAGFFISGSTDCTVKIWDPSLRGSELRATLKGHTRAIRTISSDRGKIVSGADDQSVIVWDKQTFKLLEELKGHEAPVSSVRMLSGERVLIASHDGTVKMWDVRTDTCVVTVGRCQSAVLCMEYDDSTGILAAAGRDITAHVWDIRSSKQMFKLQGHTKWIRSMRMTGETIITGSDDWTARVWSLNRGTCDAVLACHAGPVLCVEYSPSDKGIITGSADGLIRFWENEGGIKCVKNLTLHTASVLSISASDHWLAIGAADNSMSLFHRPQERFGGFSNAGSKVAGWQLYRTPQKTAAVVRCIASDLDRKRICSGGRNGLLRLWDATTSI

SEQ ID NO: 44874 - protein, 747 aa, Sulfolobus tokodaii str. 7
MSQEVSLRVSEARQRDVGKKIARLSDYTMRKLGIETGDYIEIIGPNGSALAQAMPSYDISDDEIKIDGYIRKSIGVGIGDDVKVKKANVTPATKITLAPTQPIRFDRSFVEYVKDQLMNKPLAKGETIPVPIYTGTLDFIVINTQPSNYVYVTESTNLEIREEPAKESELGGYPKVTWEDIGDLEEAKQKIREIVEWPLRHPELFQRLGIEPPKGILLYGPPGNGKTLLARALANEVGASFYTINGPEIMSKFYGESEQRLREIFEEAQKNAPAIIFIDEIDSIAPKREEVTGEVEKRVVAQLLTLMDGIKGRGKVIVIGATNRPDAVDPALRRPGRFDREIEIRPPDTKGRKEILQVHTRNMPLAEDVDLDKLAEITYGYTGADLAALAKEAAMNALRRFIAEKKINLEQERIPAEILKELKVTMQDFLEAMKSIQPTLLREVYVEVPKVHWNDIGGLEEVKQQLREAVEWPLRFSELFNKSGITPPKGILLFGPPGTGKTMLAKAVATESGANFIAVRGPEILSKWVGESEKAIREIFRKARQAAPTIIFFDEIDAIAPMRGLTTDSGVTERIVNQLLAEMDGIVPLNKVVVIAATNRPDILDPALLRPGRFDRLIYVPPPDKRARAEILKVHTRNVPLAEDITLDELAEKTEGYTGADIEALVREATINAMRKIFNDCDKKAKDQCQNNVDCYNSKMRDCMNNAKVIVTKEDFNKALEVVKPSLTAADIQRYERLAKELKRSVL

SEQ ID NO: 44875 - protein, 1676 aa, Streptomyces coelicolor A3(2)
MEALSFDSGARTAFAERLALLYREAGNPPLKRVSEAVVRLQRVDERGRPVRVSAQRISDWRRAKNVPAQFPALAAVLHVLIPQARRARPVPVSAGLYDLVQWQRLWERALADPSGERPGAAAVEEQTPAEAPAALGGVCPYRGLAAYRRQDADWFFGRERSTRALLAQLDATRDTGGLVMLVGASGAGKSSLLNAGLVPALRAGSRDAGCGPPRRVLQLVPGADPLGELTRLVPQLAPVVVAIRETAGRDPGSPGTWNPGDPETEDAVRAAFAAWAASTEAPSGQEGQEEQEEREGRESRSGRKGFAGQNGPESQDGPGRRHGLDRQSEPDRHRPGPADPADPGRRTNQAAGADRARQDDQTERADEAGKTGRTDRDGSTSPSGPDISACRNGETGRTARVSQAVGPDPGDRTDPVAPAGQADGGDRADADDQPGNTGQVDQTEQTGREGQGQENRGGQGGQGGQTDQSGRSGQTGREIRHAPIAPARRPDGDGRADPYGEAGQDGQTGQDAQVGQDAQDRQDAQDRQAGLSDRARQADLGAQDGPASPARQLGRTPSDGETRPDGPPGQANPTARAIRTRPPGTAPPDGREDHAGGPDDPAAARPVVIVDQFEELFTLCADEADRRVFIQLLQAACLPGAHGDPPPVLVTLGVRADFYDRCLRYPELADALQHRHMVLGPLTTAELREAVTAPARAVGMELEPGLAELIIREVSTDGPRGGCDSHAFRAVGEHDAGVLPLLSHALLATWQRRKAGRLTLAGYRAAGGIQGAVAATAERAWSGLDPAARTAARLLLLRLIRLSEDTQATRRRSTRRRLAEEARDPDKTEESLEALVRARLVTLDADTVEITHEALLHAWPRLRDWIDEDRAGNLLRQRLEEDGLAWEESDRDSALLYRGSRLAQADGWAKSADDTFLTRSAVEFLAAAVRLRRRTVMISRAAVSALVVLALLAVGSAVLAWQQRNDAVFEQVVAEADRVQDTDPSLSAQLDLAAHRLRPDDEDVRNRLISIVNAPLATPLLGHTGAVYLTSFSPDGRILATASYDRTVRLWDVSDPGRPQQLGKPLTGHTSWVSTAVFSPDGRTLASASDDGTIRLWDVTDPGRPRPLGAPLDGHGGTVYLLAFSPDGRTLASAHDDHAVRLWNVADRRAPEALDTLTGSTGAVRSVAFSPDGDTLASGGDDDKVRLWDVSDPRRPEPAGAPLAGHSGLVHSVAFSPDGHTLASGSADDTVQLWDVTDPAGAKPVGAPLTGHSGPVWAVAFSPDGAMLAVSSADSTASLWNVSDPAYPSQVGVPLAGGSGEMYALGFSPDGHTLATGSGDSKVRLWSLPTSEMIGRIGAFRPDGHVLATAARDGRVRLWDVTDPGRPVSLSAPFEPGDGDIRSLVFSPDGGTLAVLVGGRALQLWDVTDPAGPTAHGPPVALSTRYAGPDTLAFSPDGRTLATAHDDRTIQLWNADDPSRPRRLGKPLAGHSGYVNTLAFSPDGRTLASGGADDAVRLWDVTDPAHATRLGAARTGHLGPVNVLAYSPDGHTLASGSDDGTVRLWDVTEPGEGSGGGTTLAGHTDSVVSLTFSQDGDTLASGANDNTVRLWSVTDPAEAAPIGRAMSPNAKTGNFLSFSPVSHMLGVSSGTDTVRLWSLGVDDAIDRICSATRGVLTEEKWHEYLPRLDYEPPCHQ

SEQ ID NO: 44876 - protein, 399 aa, Thermus thermophilus HB8
MEGIASVKELLEELKAGRPVILVDDEDRENEGDLIMAAEHVTPEWVNFMLKECRGLLCVALTEERAKALDLPLMVERNQDPQGTRFTVSVDARGTTTGISAFERAATIRLLADPEATAQDFRRPGHVFPLVARPGGVLRRAGHTEATVDLLRLAGLTPVGSLIEILKEDGTMARLPDLLAFARRHGLKVGTIADLIRYRLEKGDLYVRREAEALLPTRFGEFRILGYRDTLTGEEHAALVMGSWAPEEPVLVRMHSECLTGDALHSLRCDCGFQRDLALQRIAEEGKGVLVYLRQEGRGIGLVNKIKAYHLQDQGLDTVEANLALGFPPDLRDYGVGAQILYDLGVRKMRLLTNNPRKVRALSGFGIEIVERIPLRAGDNPHNERYLQAKKEKLGHWMD

SEQ ID NO: 44877 - protein, 296 aa, Zea mays
PRTGLLPSAASPVLHSCIRSRFTPSGRPPRSFSPPSLSLRRLGRLPPPPYARSRGPRHSYSSVSSPGDARFRNDLCNNCKRPGHFARECPSVAVCHTCGLPGHIAAECSSKGTCWNCKEPGHMANSCPNEGICRNCGKSGHIARDCTAPPVPPGEVILCSNCYKPGHFREECTNEKACNNCRQSGHIARNCTNDPVCNLCNVAGHLARQCPKSDTLGERGGPPPFHGVGAPFRGVGVPFRGGLSDVICRACNQIGHASRDCMAGAFMICHNCGGRGHTAYECPSVSLIERFPPRRF

SEQ ID NO: 44878 - protein, 271 aa, Staphylococcus epidermidis ATCC 12228
MKLVFYGAGNMAQAIFTGIINSNNLNANDIYLTNKSNEQALKSFAEKLGVNYSYDDEALLKDADYVFLGTKPHDFENLANRIREHITNDNRFISIMAGLSIDYIRQQLNTNNPLARIMPNTNAQVGHSVTGISFSNNFDPKSKNEVDELINAFGSVIEVSEEHLHQVTAITGSGPAFLYHVFEQYVKAGTELGLERNQVEESIRNLIIGTSKMIERSDLSMSQLRKNITSKGGTTQAGLDALSQYDIVSMFEDCLGAAVNRSMELSHKEDE

SEQ ID NO: 44879 - protein, 251 aa, Brassica napus
MIIMVRLKASLRLLLLSIALLKGSFGSESSKEAYVTLLYGDEFLLGVRVLGKSIRDTGSDKDMVALVSDGVSDYSKNLLKADGWKVEKISLLANPNQVHPTRFWGVYTKLKIFNMTDYNKVVYLDADTIVVKNIDDLFKCSKFCANLKHSERLNSGVMVVEPSQALFNDMMRKVKTLSSYTGGDQGFLNSYYPDFQNARVFDPSLSPEELKTRPVPDMERLSTLYNADVGLYMLANKWMVDESKLHVIHYT

SEQ ID NO: 44880 - protein, 207 aa, Glycine max
SAQVPSPDWARCSPLVSRRRTTGDPSSKPPSSSPPALPLLHHSTQLSSRAADGRMMGSNNPGGAGGGGGMAPGTGAGGSDGRHDDEAVLTEFLSSLMDYNPTIPDELVEHYLGRSGFHCPDLRLTRLVAVAAQKFISDIASDSLQHCKARVAAPVKDNKSKQPKDRRLVLTMDDLSKALREHGVNLKHPEYFADSPSAGMAPSTREE

SEQ ID NO: 44881 - protein, 313 aa, Schizosaccharomyces pombe 972h-
MSNTHITDWSSKDGEFRRQVSSFRERISPEHKYFQPEKDRYHLYVSYACPWAHRTLIVRKLKGLENVIPVHVVGWLMGPNGWNFDKENDSTGDPLYNSPYLRNLYFRADPNYNMRFTVPVLWDSKYNTIVNNESAEIIRMFNDAFNEVIEDEEKRVVDLYPSSLRTKIDELNDYFYDTVNNGVYKTGFATTAEAYEKNVRVVFQGLDRLEQVLKESKGPFLLGDHLTETDVRLYTTIVRFDPVYVQHFKCNIGTIRHNYPHINQWLKRLYWKHPAFHETTDFKHIKCHYTQSHTQINPLGITPLGPIPNVEYF

SEQ ID NO: 44882 - protein, 473 aa, Pseudomonas fluorescens Pf-5
MSGQNSHSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYVHYWWPDVPTWASAAVFFVMINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVVLLSLTPWDTLLVTLNASGDAYSGSPFVQVFSMLGSNTAAHILNFVVLTAALSVYNSGTYCNSRMLLGMAEQGDAPKALAKIDKRGVPVMSILASALVTFVAVVLNYLIPQHALELLMSLVVATLVINWAMISYSHFKFRQHMERTGQTSLFKALWYPYGNYVCLAFVVFILGIMLMIPGIQISVYAIPVWVVFMWVCYCIKNKRSAQHALQAASASLK

SEQ ID NO: 44883 - protein, 494 aa, Staphylococcus epidermidis ATCC 12228
MSTKQKHIPCLITIFGATGDLSHRKLFPSIFHLYQQDNLDEHIAIIGIGRRDYNNEQFRDQVKTSIQTYVKDTDRIDEFMTHVFYHKTDVSDKESYQSLLQFSERLDSEFALGGNRLFYLAMAPQFFGVISDYLKSSGLTQTTGFKRLVIEKPFGSDLKSAESLNNQIRRSFKEEEIYRIDHYLGKDMVQNIEVLRFANAMFEPLWNNKYISNIQVTSSEVLGVEDRGGYYESSGALKDMVQNHMLQMVALLAMEAPISLNSEDIRAEKVKVLKSLRQLKPEEVKKNFVRGQYDQGNIDGKQVKSYREEDRVAKDSVTPTFVSGKLTIDNFRWAGVPFYIRTGKRMKSKTIQVVVEFKEVPMNLYYETDNLLDSNLLVINIQPNEGISLHLNAKKNIQGIDTEPVQLSYAMSAQDKMNTVDAYENLLFDCLKGDATNFTHWEELKSTWKFVDAIQDQWTMVEPCFPNYEAGTNGPLESDLLLSRDGNHWWDDIH

SEQ ID NO: 44884 - protein, 280 aa, Legionella pneumophila subsp. pneumophila str. Philadelphia 1
MHHLILGYGYCGYYLAQELLGHHQQVTVVSRQLKKELELSKLQHISHDLEYPFHWSEPDSIIYYLIPPPSQGTCDTFLQQFLNQSSLNAKKIIYFGSSGVYGNHQGAWVDELSACIIDSPRQQRRLDAEQQWLAYCQQHNKELSLLRIAGIYGPNRIPADAAKSKIPIIKPTEAPFTNHIFVKDLALIAYLLGQKQTTSAVYNVADGNPTHMGELQQTVANALGIESASYESFEQAWEKASPMKREFMRASKRLKIDLLKTALGEDIQFTSLYDAVKQSL

SEQ ID NO: 44885 - protein, 328 aa, Shigella flexneri 2a str. 2457T
MGQLIDGVWHDTWYDTKSTGGKFQRSASAFRNWLTADGAPGPTGTGGFIAEKDRYHLYVSLACPWAHRTLIMRKLKGLEPFISVSVVNPLMLENGWTFDDSFPGATGDTLYQHEFLYQLYLHADPHYSGRVTVPVLWDKKNHTIVSNESAEIIRMFNTAFDALGAKAGDYYPPALQTKIDELNGWIYDTVNNGVYKAGFATSQQAYDEAVAKVFESLARLEQILGQHRYLTGNQLTEADIRLWTTLVRFDPVYVTHFKCDKHRISDYLNLYGFLRDIYQMPGIAETVNFDHIRNHYFRSHKTINPTGIISIGPWQDLDEPHGRDVRFG

SEQ ID NO: 44886 - protein, 412 aa, Arabidopsis thaliana
  misc_feature (312)..(312): Xaa can be any naturally occurring amino acid
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMASFLXYCKLLQLKKLCLRFMLNYLLYAVLVWWTVRVGGDLELERNEPGTEPMARVLLLRTCLAEHLLEDMGRQGREREGGSGHSLGQSQSQFAGSAREIHWRRRV

SEQ ID NO: 44887 - protein, 280 aa, Picrophilus torridus DSM 9790
MFNNNLLKNRRIIITGGATGLGFSMAETFGSLGASIIIISRNEENLKNAEKNLRDLNIDSYYYKCDIRDYESISKTLGDIENSIGIPDTLVNNAAGNFISKTDDISRNGFDAIVNIVLHGTFYFSQLFGKMIMKNNIRGTILNIVASYAWTGSPYLAASAAAKAGVLALTRSMAVEWGPKGIRTVAIAPGLFYSENTWRNFGISEDIEKIAVEKTPLKRLVTKSEVSNLAAYLISDMASFINGEVITIDGGAWLSGNIINDIFSGLGGDFFENLMKKSRK

SEQ ID NO: 44888 - protein, 428 aa, Burkholderia xenovorans LB400
MQLLTIGINHHTAPVALRERVAFPLEQIKPALDTFKSIWLGPSARTAPEAAILSTCNRTELYCATDDQAAREAAIQWLSRYHNLPIGELAPHVYALPQSEAVRHAFRVASGLDSMVLGETQIVGQMKDAVRTASEAGALGTYLNQLFQRTFAVAKEVRSTTEIGAQSVSMAAAAVRLAQRIFDKVANQRVLFIGAGEMIELCATHFAAQQPKELVVANRTAERGTRLAERFNGRAIPLSELPSRMHEFDIIVSCTASTLPIIGLGAVERAVKARRHRPIFMVDLAVPRDIEPEVGQLEDVFLYTVDDLGAIVREGNASRQAAVAQAEAIIETRVQNFMQWLDARSIVPVIRHMHTQADVLRRAEVERAQKMLARGDDPAAVLEALSQALTNKLIHGPTHALNRASSENRDTLIELMSGFYKHSGSTER

SEQ ID NO: 44889 - protein, 1010 aa, Oryza sativa Japonica Group
MRIRGDGGGDEEEAAMAVVSAPPQHLVFAYYITGHGFGHATRALEVVRHLIAAGHDVHVVTGAPEFVFTTEISSPNLHIRKVLLDCGAVQADALTVDRLASLEKYHQTAVMPRESILRTEVEWLNTIKADLVVSDVVPVACRAAADAGIRSVCVTNFSWDFIYAEYVVVAGHHHRSIVWQIAEDYSHCEFLLRLPGYCPMPAFRDVIDVPLVVRRLHKSRSEVRKELGIKDDVKVVIFNFGGQPAGWKLKKEWLPDGWLCLVCGASETQELPPNFIKLAKDAYTPDLMAASDCMLGKIGYGTVSEALAYKLPFVFVRRDYFNEEPFLRNMLEHYQCGVEMVRRDLLTGHWKPYLQRAMTLHPCYDGPINGGEVAAHILQDTAVGKKYISGKIKLSGARRLRDAIVLGYQLQRAPGRDVGIPDWYSVSEKEIGVRPAPTYHEVNGSAESSFEDFEILHGDIQGLTDTMAFLTSLSGLVGNDPRSPEKQSRERVAASVFFDWEEEIYVARAPGRLDVMGGIADYSGSLVLQRSNPMKQKLWKHTQARQLANGRAVPLLQIVSFGSELSNRAPTFDMDLSDFMDGDKPISYDKAKEYFSQDPSQKWAAYVAGTILVLMTELGVVFTDSMSILVSSSVPEGKGVSSSASVEVASMSAIAAAYGLNIPPRDLAILCQKVENRIVGAPCGVMDQMTSACGEANKLLAMICQPAEVKELVSIPTHIRFWGLDSGIRHSVGGTDYGSVRVGTYMGRKMIKCAASDLLSESLPSCPPIQSGNTNSDEYEEHGVDLLKSEASLEYLCNLPPHRYEAVYARDIPEIITGDAFLEKYGDHNDAVTTVDPKRSYCVKAPTRHPIYENFRVEAFKALLTAAKTVEQLSALGELMYQCHYSYNACGLGSDGTDRLVNMVQEVQHRKTSQDGGPSLFGAKITGGGSGGSVCVIGKNCLKSSEEIFEIQKRYKAATGYLPIVFEGSSPEVDARKLSRIRVILLPDRNEVSLPIWLLPSHKMQVQLSD

SEQ ID NO: 44890 - protein, 370 aa, Chlamydomonas reinhardtii
MASPLAQIAAQLAAPGKGLLASDESTGTIGKRLEKAGLPNTEDIRRSYRELYYTTPGMGQYISGVIMFKETLYQSTKAGRPFVEVLAEQGILAGIKVDEGLEPLAGAADGETHTKGLEGLEANCREYARAGAKFAKWRATLKVTDTLPSALAVERNADELAQYARICQNCGLVPVVEPEILIDGNHSQERFGQVTEQVIGATVAALWRHGVELEGCLLKPQMVIPGADAEGGKVSAADVARCTVAALRRVVPPAIPGIMFLSGGQTEEEATINLDAVNREAQAVGRCPWVLSFSFGRALQASVLKLWSSDQTRVAEAQQLALALARVNSEAALGNYNASSGSHPSTLGTATLHETFRGWNGQPAGNGAAQ

SEQ ID NO: 44891 - protein, 744 aa, Picrophilus torridus DSM 9790
MQSDGIILRVAEANATDPGMARVRLDEESRLALDVDIGDVVSIEKVRPTVGRVFRARPEDENKGIVRIDSVMRNNCGASIGDKVKVKKVFVEEAKKIVLAPIIRKDQRLRFGEGIDDFVQKALMRRPMIEQDSISVPGLTLAGHTGLLFKVVKTIPSKVPVEVSESTQIEIREDPASEVLEEVTRVSYEDIGGLSDQLGRIREIIELPLKHPELFERLGITPPKGVLLSGPPGTGKTLIAKAVANESGANFYAINGPEIMSKYYGQSEQKLREIFQKAEESEPSIIFIDEIDSIAPKREDVQGEVERRVVAQLLTLMDGLKERGHVIVIGATNRIDAVDPALRRPGRFDREITIGVPDKKGRKEILAIHTRGMPLGMTDDEKENFLEKIADLTYGFVGADLAALTRESAMNALRRYLPEIDLDKPIPTEVLEKMVVTEQDFMEALKTIEPSSLREVTVEVPNVKWDDIGGLENVKSELREAVELPLLNPDVFKRLGIRAPKGFLLYGPPGTGKTLLAKAVANESNANFISIKGPEVLSKWVGESEKAVREIFKKAKQVAPSIVFLDEIDSIAPRRGASMDSGVTERIVNQLLTSLDGIEVLNGVVVIAATNRPDIIDPALLRAGRFDKIMYIPPPDEEGRYKILQVHTKNMPLAPDVDLRELAKKTDGFVGADIENLCREAGMMAYRSNPDATEVTQNDFLNALKTIRPSVDESVIKFYNDLAKSMGRDIIERKKSVEDLGLYQ

SEQ ID NO: 44892 - protein, 335 aa, Oryza sativa Japonica Group
MGNCASFTPKWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGGIIGRKKGAVAMYINFSGIRMVFVSCHLAAHENKVEKRNSECQHISHSLFSKNDIQYTKSADITVWLGDLNYRLQGISSIPARKLIEENRQSLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 44893 - protein, 406 aa, Aspergillus oryzae
MPPPRTRAEVQAQKQKEKLAQSYHDLLEEFSSKDLRSVGNYTLGRLIGKGSFGKVYLASHKLTNGSKVVLKSSSREDTNLPREIHHHRQFLHPHIARLYEVLVTEKLVWLVLEYCPGMGRDELYNYLLRHGPLPVDKVKRIFTQLVGAVAYVHSKSCVHRDLKLENILLDKHENVKLCDFGFTREYEGKASYLQTFCGTICYSAPEMLKGEKYAGEKVDVWSLGIILYALLAGELPFDEDDDQVTKTRILTEDPAYNDRFPDDAKTLINLLLSKRPLIRPSLDEILAHPFLAEHAPEQLAILKIPRPAPFTTPLEKTTLQRMKSAGVNIDEVVDSVLAQRCDPLAGCLLCLSCLVYQSQFPSNLQLPATHLHPLTKTLFGLLVLPDTAHYRLPKIEDAQAGQVHCM

SEQ ID NO: 44894 - protein, 517 aa, Burkholderia xenovorans LB400
MLTGLGSIIGSGWLFGAWKAAKIAGPAAICAWVIGAVVILAIALTYAELGAMFPESGGMVRYARYSHGALVGFISAWANWIAIVSVIPIEAEASIQYMSTWPYPWAHALFVDGSLTTHGLLLSAALVIIYFLLNYWGVKLFARANSAITIFKFLIPGATILGLMLTGFHKENFGEVSTFAPYGWSAVLTAVATSGIVFAFNGFQSPINLAGEARNPARSVPFAVIGSILLALVIYVLLQIAYIGAVNPSDVMKGWSHFNFASPFAELAIALNLNWLAILLYVDAFVSPSGTGTTYMATTSRMIYAMERNNTMPKMFGNVHPFYGVPRPAMWFNLLVSFIFLFFFRGWSSLAAVISVATVISYLTGPISLMSLRRAATDLERPLHIPGMKIIAPFAFVCASLILYWAKWPLTGEIILLMVVALPVYFYFQAKSGFAGWGRDLKAAWWLVAYLPVMAILSLIGSKQFGGHDLIPYGWDMLVVIAFSLVFYYWGVNSGYRSEYLDERQEHDEVLEGIGAH

SEQ ID NO: 44895 - protein, 352 aa, Cucumis sativus
MGSGNGFYSTSEFNLDAKWLIDPKHLFVGPKIGEGAHAKVYEGKYKNQIVAIKMVGKGDTPERMARREARFAREVAMLSKVRHKNLVKFIGACKEPMMVIVTELLTGGTLRKFLLNLRPRSLELDVAIGFALDIARAMECLHSHGIIHRDLKPENLILTADHKTIKLADFGLAREESVTEMMTAETGTYRWMAPELYSTVTLKHGDKKHYNHKVDAYSFAIVLWELILNRLPFEGMSNLQPAYAAAFKNMRPSAENLPEDLALIVTSCWREDPNTRPNFSQIIQMLLQSLSRISPRSPVIPPRICASENVVMPPESPCTNSLMAVRHGSGEAPHGMIEETPTTSFFCFNKCY

SEQ ID NO: 44896 - protein, 837 aa, Xanthomonas oryzae pv. oryzae KACC10331
MSKTSGSCLCIFRCALHHSGFFLRTRPSSPLGRWPYGASRLNENILWLHELRLADLARVGGKNSSLGEMIGNLAGLGVSVPGGYATTAEAFKDFIAHNDLSKRIFDKLATLDVEDVNALTLAGKEIRGWVIDAPLQPELDRDIRTAYEQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFSLEAKDAKILVEGRAVGAKIGGGVARVVRSLDDMNRVQAGDVLIADMTDPDWEPVMKRASAIVTNRGGRTCHAAIIARELGVPAVVGSGNATDVLSDGQEVTVSCAEGDTGFIYEGLLPFERTTTDLGNMPPAPLKIMMNVANPERAFDFGQLPNAGIGLARLEMIIAAHIGIHPNALLEYDKQDADVRKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGDGADGKPGLKIIMMCELPSNALLADEFLDIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSES

SEQ ID NO: 44897 - protein, 139 aa, Oryza sativa Indica Group
MATTSFKKERWSLAGATALVTGGSKGIGNEAELSRCQEECNSRGLAVTVSACDVSVRADREALAARVNNVGTSYLKPAVELTPEETSSLMATNFESCFHMSQLAYPLLKASGRGNIINISSAATSLALPSLPVYSAAKG

SEQ ID NO: 44898 - protein, 478 aa, Synechococcus sp. CC9311
MARSFMPKKSAELMGNEQGNRRVQFILRIAISAALGGFLFGYDTAVINGAVSAIQSTFNASAVNLGLAVSSALLGSAAGALGAGWLADGIGRRRSMWLAAILFVVSALGSALAPHLIDLVIWRVIGGVAVGFASVLAPAYIAEISPSEMRGRTGSLLQLAIVLGIFIALLSDYLLVLSTPDQTSLSALGPMAAWRWMLMSELVPAVIYGAMVLRIPESPRYLVQKGRIEQARLVICQTLGEPTQPVIDRIQFSLGNHKGSSIADLFSRRSLLLPIVWTGILLAIFQQFVGINVIFYYSSSLWESVGFSTTDSLVITVVTSVTNVVTTILAILTIDRLGRRPLLLIGSVVITISLGLMSWAFAGAPIVNGAPVLAGASSWVALMSANVFVFAFGFSWGPVMWVLLGEMFNNRIRALALGLSATVNWLANFVISTTFPVFLETSGPSFAYALYATAAAISFFFVLFMVRETKGLELEDMV

SEQ ID NO: 44899 - protein, 401 aa, Zea mays
MGALSRPEEVLALVKLRVAAGQIKRQIPPEEHWAFAYSMLQKVSRSFALVIQQLGPELRNAVCIFYLVLRALDTVEDDTSIPTEVKVPILQEFYRHIYNRDWHYSCGTNHYKMLMDKFRHVSTAFLELGEGYQKAIEEVTRRMGAGMAKFICKEVETVDDYDEYCHYVAGLVGYGLSRLFYAAGTEDLALDSLSNSMGLFLQKTNIIRDYLEDINEIPKSRMFWPREIWSKYADKLEDFKYEENSKKAVQCLNNMVTDALIHAEECLQYMSALKDPAIFRFCAIPQIMAIGTCALCYNNVHVFRGVVKMRRGLTARIIDETNSMTDVYTAFYEFSSLIESKIDDSDPNAALTQRRVDSIKQTCKSSGLVKQRGYHLEKSPYRPMLIMIVLLLVAILFGVMF

SEQ ID NO: 44900 - protein, 208 aa, Wolbachia endosymbiont of Drosophila ananassae
MLGHRGCRLAISHPEIYSMQIRAILSAASELKKEKKIEVEPEIMIPFIMSEKEFILICELAKKESSVISQTQIPASRAGMTSDKAYSIGTMIELPRAALIADKLAKHAEFFSFGTNDLTQTTMGLSRDDSVNFLDSYKKNNIFDNDPFEVLDIEGVGELIKMAIERGKKTRKEIKLGICGEHGADPKSIEFLIESGVDYVSCSPYRVP

SEQ ID NO: 44901 - protein, 669 aa, Salinibacter ruber DSM 13855
MIKLEDITIEFGEDPLFQNLSWTITPEPHRVGLVGPNGAGKTTLLKVIAGDQRVDSGTITREGVSIGYLEQDVQELPEDRTVREEALRAFEEVLALEEQEQEISRELEAIDHESDRHEKLLNRLHRVQERLDAQDAHRIRPRTEATLTGLGFAQDELDRPLRTFSGGWRMRAALARLLLKQPDVLLLDEPTNHLDIESIDWLEDTLETYPGAVILVSHDRSVLDRMVTSTAELVRGRLLHYDGNYSHYLEAREARYERWRRKYENQQKRIEKIQEFISKFRYNAARASQVQSRIKKLEKMDRIPPPPDPAPAMSFEFPEPPRSGVVVLELSAFSKTYDTEHGPETVFTDAGPLTIERGDKVALVGPNGAGKSTLARIIGGREDFAGTRTEGHNVEMAFHAQHQAKTMDPDQTVFDTVREAAPDRPKTELRSLLGRFLFTSEDAFKDVRVLSGGEKSRLSLARTLLSPANLLLLDEPTNHLDIQSREVLIEALQKYEGTFVLVSHDRHVLDAVAEKTWRVGGGTVRTFLGNYSDFRWQVEEGSARPLQDVHEAEPPAEPSPNGHDAATGDTDPPAEDNDPSAPDARPDGPFADLNSYQLKQKLEDTEARILEIEEKQEELEAAMADPDAYDGDGLEARELSDEYNALKKELSGLYEEWEVLTEHVMALED

SEQ ID NO: 44902 - protein, 475 aa, Vitis vinifera
MEGGGGWKRPKTKIVCTLGPASRSVEVIEKLLRAGMNVARFNFSHGSHAYHQQTLDNLRTAMANTETLCAVMLDTKGPEIRTGFLKDGKPVQLKKGQEITISTDYSIKGDDHMICMSYQKLAEDLRPQSVILCADGTITLTVLACDKELGLARCRCENSAVLGERKNVNLPGVVVDLPTLTEKDKEDILEWGVPNKIDMIALSFVRKGSDLVEVRMLLAEHAKSILLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPELAVQTMARICLEAENSLNYGDVFKTIMETAPMPMSPIESLASSAVRAANGSKAALILVLTRGGTTANLVAKYRPSMPILSVITADSFDWSCRSAKASDSESTEEALEFSLQYAKTKEMCKPGDSVVALHRVGTASVIKILTVK

SEQ ID NO: 44903 - protein, 215 aa, uncultured archaeon GZfos34H9
MGRESKRESRKESWKTEEKWTPVTRLGVLVQKGEIRTIEEALKSRYPLKEYQIVDALLPDLSEEVLDINLVQRMTDSGRRVKFRVCVIVGDREGYLGIGLGKDALVRSGIEKAVRVAKTNITYIERGCGSWECNCKDKHSIPFKVIGKSGSVEITLKPAPKGIGLAAGDVPKRVSEFAGVNDIWAKTKGKTRTTFNLAMATYNALRSTTLVKTMN

SEQ ID NO: 44904 - protein, 183 aa, Oryza sativa Indica Group
MTTYRVCCFLRRFRAASNEPSEELGDVFQAYADGGGGVMGEEALRRFLREVQGEAAGGGDDELEATAREVMAFAAEQRLLRKGGAAAAGGGLTVEGFHRWLCSDANAALDPQKRVYQDMGLPLSHYFIYTGHNSYLTGNQLSSGCSEVPIVKALHDGVRVIELDLWPNAAKDAVEVLHGSAYD

SEQ ID NO: 44905 - protein, 385 aa, Oryza sativa Indica Group
MAASIDGFSLAQMIKETFGDMLYVSETENMAEFPSPDELKGKIIVSTKPPKEYLQTKNDADADEAGVWGEEITDDKVAATAMTTEEKCAAAEEAVAAAAVDEEMQEAETDKKTQHGVDNEYRRLIAIPLTRRKHDMDQDLKVDPDMVTRLSLGEKAYEKAIVTHGAHIIRFTQRNLLRIFPRSTRITSSNYNPLMGWRYGVQMVAANMQGHGRKLWLTQGMFRANGGCGYVKKPDILMNNDPDKLFDPTSKLPVKTRLKVTVYMGDGWRFDFRKTHFDKCSPPDFYARVGIAGVEADTRMEQTKVKMDTWIPAWDHEFEFPLSVPELALLRVEVHESDNHQKDDFGGQTCLPVWELRRGIRSVRLCDHRGEPLRSVKLLMRFDFT

SEQ ID NO: 44906 - protein, 468 aa, Staphylococcus epidermidis ATCC 12228
MTQQIGVVGLAVMGKNLAWNIESRGYSVSVYNRSRQKTDEMVKESPGREIYPTYSLEEFVESLEKPRKILLMVKAGPATDATIDGLLPLLDDDDILIDGGNTNYQDTIRRNKALAESSINFIGMGVSGGEIGALTGPSLMPGGQKDAYNKVSDILDAIAAKAQDGASCVTYIGPNGAGHYVKMVHNGIEYADMQLIAESYAMMKDLLGMSHKEISQTFKEWNAGELESYLIEITGDIFNKLDDDNEALVEKILDTAGQKGTGKWTSINALELGVPLTIITESVFARFISSIKEERVTASKSLKGPKAHFEGDKKTFLEKIRKALYMSKICSYAQGFAQMRKASEDNEWNLKLGELAMIWREGCIIRAQFLQKIKDAYDNNENLQNLLLDPYFKNIVMEYQDALREVVATSVYNGVPTPGFSASINYYDSYRSEDLPANLIQAQRDYFGAHTYERKDREGIFHTQWVEE

SEQ ID NO: 44907 - protein, 439 aa, Staphylococcus epidermidis ATCC 12228
MDIKMPKLGESVHEGTIEQWLVSVGDHVDEYEPLCEVITDKVTAEVPSTISGTITELVVEEGQTVNINTVICKIDSENGQNQTESANEFKEEQNQHSQSNVNVSQFENNPKTHESEVHTTSSRANNNGRFSPVVFKLASEHDIDLTQVKGTGFEGRVTKKDIQNIINNPNDQEKEKEFKQTDKKDHSMNHGDFLHQSSTKNEDSPLSNERVVPVKGIRKAIAQNMVTSVSEIPHGWMMVEADATNLVQTRNYHKAQFKKNEGYNLTFFAFFVKAVAEALKANPLLNSTWQGDEIVIHKDINISIAVADDDKLYVPVIKNADEKSIKGIAREINDLATKARLGKLAQSDMQNGTFTVNNTGSFGSVSSMGIINHPQAAILQVESVVKKPVVIDDMIAIRNMVNLCISIDHRILDGVQTGKFMNLVKKKIEQYSIENTSIY

SEQ ID NO: 44908 - protein, 485 aa, Bacteroides fragilis YCH46
MLLKQTKIVASISDRRCDVDFIKELFDAGMNVVRMNTAHASREGFEALIANVRAVSNRIAILMDTKGPEVRTTANADPILYQIGEKVKIVGDPDRETTRECIAVSYPNFVHDLNVGGTILIDDGDLELRVIDKTTEYLLCEVQNEATLGSRKSVNVPGVRINLPSLTEKDRNNILYAIEKDIDFIAHSFVRNRQDVLDIRGILDAHNSDIRIIAKIENQEGVDNIDEILEVADGVMVARGDLGIEVPQERIPGIQRMLIRKCILAKKPVIVATQMLHTMINNPRPTRAEVTDIANAIYYRTDALMLSGETAYGKYPVEAVKTMTKIAAQAEKDKLEENDIRIPLDENSNDVTAFLAKQAVKATTKLKIRAIITDSYQGRTARNLAAFRGKYPVLAICYKEKTMRHLALSYGVEAIYMPELANGQEYYFAALRRLLKEGRLHPTDMVGYLSSGKAGTQTSFLEINVVEDALKHAGDSVLPNSNRYL

SEQ ID NO: 44909 - protein, 473 aa, Staphylococcus epidermidis ATCC 12228
MSEKQYDLVVLGGGTAGYVAAIRASQLGKKVAIVEKSLLGGTCLHKGCIPTKALLKSAEVNHTIKNAHTFGIDVNHFKINFPKILERKDAIVKQLHEGVNQLMKHHHIDIYNGIGRIMGTSIFSPQSGTISVEYEDGESDILPNKNVLIATGSSPQSLPFIKFDHKQILSSDDILRLNTLPQRLAIIGGGVIGLEFASLMNDLGADVVVIEANDRVLPTESTQVASLLKEELTNRGVTFYENIQLTKDHFNQTDKGVTINISDEPVQFDKVLVAIGRKPNTNDIGLNNTQIKTSDAGHIITNAYQQTEDKHIYAAGDCIGQLQLAHVGSKEAIVAVEHMFDCSPIPINYDLIPKCVYTNPEIASIGKNLEQAKKAGIKAKSIKVPFKAIGKAIIEDVTQSKGFCEMVVNKDDDEIIGLNMIGPHVTELINEISLLQFMNGSSLELGLTTHAHPSLSEVVMELGLKANGQAIHV

SEQ ID NO: 44910 - protein, 451 aa, Schizosaccharomyces pombe 972h-
MSTPYEPEFQQAYKEIVGSIESSKLFEVHPELKRVLPIISIPERVLEFRVTWEDDKGNCRVNTGYRVQFNSALGPYKGGLRFHPSVNLSILKFLGFEQIFKNALTGLPMGGGKGGSDFDPKGKSDNEIRRFSQAFMRQLFRYIGPQTDVPAGDIGVTGFVVMHMFGEYKRLRNEYSGVVTGKHMLTGGSNIRPEATGYGVVYYVKHMIEHRTKGAETLKGKRVAISGSGNVAQYAALKCIQEGAIVKSISDSKGVLIAKTAEGLVPEEIHEIMALKEKRASIADSASLCKKHHYIAGARPWTNVGEIDIALPCATQNEVSGEEAAALIKQGCRYVAEGSNMGSSAEAVEVFEKSRASGEGCWLAPGKAANAGGVAVSGLEMAQNAQFSTWTHAEVDAKLAGIMQNIFEQSTDVASKYCDSGSNNIPSLVDGANIAGFLKVATAMQAVGDWW

SEQ ID NO: 44911 - protein, 63 aa, Zea mays
  misc_feature (20)..(20): Xaa can be any naturally occurring amino acid
YRLKCRGRCAVESVNEGLVXARSAVEIVETCHLDQLLHPQFDDPSAYKDQVIATGLPASPGAA

SEQ ID NO: 44912 - protein, 265 aa, Aspergillus oryzae
MAPERWDDEEDSVSPPPVAPRRRFDDEEEDEVLDSWDAAEDSEVEREKAAKAAEAKAKADAEAAAKKKSKSQRIQEHKEERKKKAEEEDSDSEEEDDADKRARLRRAQKDADLKHAEDLFGDIDLNRNRGAPKAIVISDSADPTQAVDLSAMPLFKPTTKEQFARLTSTLIPLLTPHSKKPHYSLWAQEFAKQLVKELNSADVKKIASAMTTMSNEKMREERAADKGSKKSKAAKTKVSLVTSRDNKLDADYDNGDDGLGDDDFM

SEQ ID NO: 44913 - protein, 292 aa, Nostoc sp. PCC 7120
MLTLNSYIKHNPTLMKLISPIINIRRYFLRKNSDFRIKAYNQLCEILVTDPVIHVDEFNGNFLIDKRSTLLRRILLEGYYEPKLVEYCSKYIDFNKDIIDVGANIGFYSVLCAKKINQRNRVLSIEPTKNAFEKLIHNLELNEVNLKVISYNGVASNIIGEVEINTVIGKEEYSSLGAMSHPSISRDSYTSCKVESSTIDFLVEKYSLKPGFIKIDVEGAENLVLEGCKKVLTENHPVILMEVSDALLKKNGSSAKSVIDTIYSYKYDIIVPGFPKELPGERDYGDILCIPK

SEQ ID NO: 44914 - protein, 509 aa, Zea mays
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLGSSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 44915 - protein, 202 aa, Shewanella sp. ANA-3
MKLYLLDNFDSFTYNLVDQFRSLGCEVVIYRNDVAADYIANKLLAETEPSALVLSPGPGAPHEAGSMMSLIDKVAGKVPMLGICLGHQAMVEYYGGKVERAPFVVHGKASPTFHNGTGVFANLPSPLPVARYHSLVATKVPDCLEVIATTEEMPMAILHAEHRAVGFQFHPESILTTLGSTLLTQTLRFLTQDIVHNTAGAQ

SEQ ID NO: 44916 - protein, 564 aa, Pseudomonas putida
MPSILTRRTFVKGLAAGSLLGGLGLWRTPVWALNGAAPVNELSGNEFELFIGETPVNFTGSARTAMTINGSLPGPLLRWREGDTVTLRVRNRLTADTSIHWHGILLPANMDGVGSEFHAIEPGGVYVYQFKVRQHGTYWYHSHSGLQEQAGVYGPLVIEAKEPEPFHYDRDYVVMLSDWTDEDPASLMKTLKKQSDYYNFHKRTVGDFINDVSEKGWGATVADRTMWAQMNMNPTDIADVSGATYTFLINGQAPDDNFTWLFRPGEKLRLRLINGSAMTYFDVRIPGLKMTVVAADGLHVKPVSVDELRIAVAETYDVIVEPETEAYTLFAQAMDRSGYARGTVATRAGMSAAVPALDPRPLVSMDDMGMGGMDHGSMDMSAMDHSSMGPMQAHPDSENNNPLVDMQAMVTAPKLDDPGLGLRNNGRRVLTYADLRSTFEDPDGRDPSRTIELHLTGHMEKFAWSFNGIKFSDAEPLRLKYGERIRLVLVNDTMMTHPIHLHGMWSDLEDENGNFQVRKHTIDMPPGSRRSYRVTADALGRWAYHCHLLYHMKRACSAKVRVEE

SEQ ID NO: 44917 - protein, 505 aa, Staphylococcus aureus subsp. aureus MW2
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 44918 - protein, 459 aa, Helianthus tuberosus
MAIGFMVLYTKLSNVLSKKALFYTVILPFIAFFGAFGFLLYPLSNYVHPTALADKLLALLGPRFLGPLAIMRIWSFCLFYVMAELWGSVVVSVLFWGFANQITTVEEAKKFYPLFGLGANVALIFSGRTVKYFSNMRKHLGPGVDGWAISLKYMMSIVVVMGLAICGLYWWVNTYVPLPTRSKKKKEKPNMTTMESLKFLASSPYIRDLATLVVAYGISINLVEVTWKSKLKVQFPSPNEYSSFMGDFSTATGIATFTMMLLSQWIFNKYGWGVAAKITPTVLLLSGVGFFSLILFGDPLAPGLMKFGITPLLAAVYVGAMQNIFSKSAKYSLFDPCKEMAYIPLDEDTKVKGKAAIDVVCNPLGKSGGALIQQFMILTFGSLANSTPYLGGVLLVIVGAWLGAARSLDKQFTALRQEEELEKEMERAAVKIPIVSTNGSLESDSNTNTSTETSSPQNV

SEQ ID NO: 44919 - protein, 157 aa, Sulfolobus tokodaii str. 7
MKMPDQSINLAIVVAEFNYDITYLMLQRAIAHAKFLGANVKVVFKVPGSYDMAIAVKELLKRDDIDAVVTLGAVIKGETKHDEIVATQTARKILDLSVEYGKPVTLGIIGHGVTHEQAVERIEEYSTRAVEAAIKLAKRLRELRKIQTLNEEMVVIE

SEQ ID NO: 44920 - protein, 620 aa, Escherichia coli K12
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 44921 - protein, 299 aa, Escherichia coli K12
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 44922 - protein, 366 aa, Glycine max
MDANGNWEEDDDEEFEFSRNYFLAKELASSSAKKSKHKLTDIDVVDEQELRDAASKIEPNHEYEITLLLDSYKTMYPEWIFALRCGFGLLMYGFGSKKALIEDFASTELTEYSVVVINGYLQTINLKQVVIALAEVLWDQMKAKQRVSHRDLPKSQQSSNSQSMEDLLTFLDQAEIEAGAFFVCVVIHNIDGSGLRDSETQQYLARLAACAQIRVVASIDHVNAPLFWDKNMAHTQFNWCWYHVPTFAPYKVEGMFYPMILAHGSASQTVKTATIVLSSLTRNAQSVFKVLAEHQLSHPDEGMPISDLYSVCRERFLVSSQITLNSHLTEFKDHELVKIKKHSDGQDCLHIPLTAEALQKVVLEII

SEQ ID NO: 44923 - protein, 368 aa, Oryza sativa Indica Group
MAEAAGNGGWPEPVVRVQALSESGAATIPDRYVRPETERPSSSSEANAVANINIPVVDMSSSPGTAAAAVAEACREWGFFQAVNHGVPAALLRRARGVWRGFFQQPMEVKQRYGNSPATYEGYGSRLGVDKGAILDWGDYYFLHVRPPHLLSPHKWPHLPPDLRETTTEYSEEVRRLCERLMAVMAVGLGVEEGRLQEAFGGGEGAGVCVRVNYYPRCPQPDLTLGLSSHSDPGGMTVLLVDDRVKGLQVRHAGAWVTVDPVPDAFIINVGDQIQVVTNALYRSVEHRVVVNAAEERLSIATFYNPRSDLPVAPLPELVSPERPPLYSPMTFDDYRLYIRRNGPRGKSQVDRLAAAAATIPNSTTTTQ

SEQ ID NO: 44924 - protein, 316 aa, Solibacter usitatus Ellin6076
MSAMDVVILGRIGYDLYSEEPHVPLPQVRRFSRYLGGSSANMAVGLSRLGARAGMVSCLGDDSLSRFLVDFLQAEKVETSHVKTAPGFLPSLCLTEVSPPDRFPQVFYRRDPVDTMLDATDDDLDYAASGTMFVTNGTTLCGSPSRESAYRALERAKNAGCRVVLDVDYRSMSWRKPEEAGLAARLALPFVDVLIGNQLELKLVANVDDLDEATGKLQAAGVPMLVSKLGELGTRVLAGGESVYLPPYSVDVCTTIGAGDGFASGFLYAMLKGLPVAECLHYGNAAAAIVVSRLSCSEAMPVLAEVEEMIRQQRKA

SEQ ID NO: 44925 - protein, 203 aa, Vitis vinifera
EKPPVEPGSVNDNVTQAASSSTDPGLPEFPSKDINRRIAVVSSLAAVGLFLSKRLDFGVSLKDLSAAALPYEEALSNGKPTVVEFYADWCEVCRELAPDVYKVEQQYRDRVNFVMLNVDNTKWEQELDEFGVEGIPHFAFLDKEGNEEGNVVGRLPKQYFQENVEALAHGEASIPHARVVGQYSSAESRKVHQVVDPRSHGRG

SEQ ID NO: 44926 - protein, 174 aa, Coprinopsis cinerea okayama7#130
MSITHISSLSQLNGILGESKSKLTVIDFHATWCGPCHAIAPKFEALAREYKNVNFLKCDVDQARDVASEYRVTAMPTFIFLKGHTKVDQVRGADARGIEAALRKHSTSSGGTTAFSGKGHTLGGGPAPTDVKGEAKRAVDNAANAASAGLAGIDPQVKVLVGLIGLYVLFWYLG

SEQ ID NO: 44927 - protein, 126 aa, Oryza sativa
MSAPNPKAFPLANAQLTNQILDLIQQASHYKQLKKGANEATKTLNRGICEFIVLTADVEPIEIVLHLPLLCEDKNVPYVFLPSKTALGRACGVSRAVIAASVTTNEARELNAQIQAVKNEIEKLLI

SEQ ID NO: 44928 - protein, 293 aa, Staphylococcus epidermidis ATCC 12228
MKKLQMNKLINIINTSLNKSIQSSPLKTNLEESMKYSLNAGGKRIRPVILLLTLKMLNKDYQQGLNSALALEMIHTYSLIHDDLPAMDNDDYRRGKLTNHKVYGEWKAILAGDALLTKAFELVSNDTTIEDSVKVSIIKRLSKASGHWGMVGGQALDMESEGKSIRLETLESIHETKTGALLNFSVMAAVDIAQVEQNIAKNLDEFSHHLGMMFQIKDDLLDVYGDESKLGKKVGSDIVNHKSTYVSLLGKEGAEEKLNNHQYLAMNCLNQISDQYDTSELSDIVDLFYNRDH

SEQ ID NO: 44929 - protein, 597 aa, Schizosaccharomyces pombe 972h-
MTENYGSMEHRKKSFRNNENLEQQFHPLREELDNAGPINDRTSELSLEGVSKAEAIASTWSKRSIIVAYLGLYLLSFASSLEQQTTYSLQRYATSNFSAHSNLATINLVGNILLAVVRAPMVKAADVFGRSESLSLALGMTVLGYLSLAFSRNIQMFTVAYILYICGQTGLGLLSQLIIADTSSLLNRGILSAIPELPYLATVWIGPVLAQAFHPEKNYGWRLGYGIWAFILPTVSLPLLASLFLNQRKAKAAGLYREHHNLINHSTPEKLRLFYLFWQELDGLGIVLFVSGFTLLLLPFSHSSQVVSPDSTILTLFTITLSIALLVTLCFYDVKYARYPVFALKSLKDRTILGSCVLIFTYFMSYYIFSNFLTSFLQVSYGLSIDMSSLTLNVFVFSMTTTAILSGFLMKRFGRFKMLLMISVPMYVLGILGIILFGINDNHYTRPLVLVLILAGMGGGLLTLSAQIAVQSVSSHAKLGMNLTLYLTFSSVGGAFGSAIAGGVWSKRLSSRLLHDLKDHLPVPEIESIFRDLRTALSYPQGTQIRNIINVAYTATEKDLFHISLVASLFMFAGLVIIRDVPLSTENHDTAVETPSE

SEQ ID NO: 44930 - protein, 307 aa, Schizosaccharomyces pombe 972h-
MTETGRTSKYRVEIQQMMFILGEVQDPLPETTQLVEELIRGQVMEMLIQANELALRRGSRSITVEDLFFLIRHDRAKVNRLKTYLSWKEVRKKAKEQDANPADTKDLFEEVDSKTRSMNAVAMPWEVKNMFTEPVPETEEFEEDNDTMEMAYATRQRLKMADERTKKMTREEYVHWSECRQASFTYRKGKRFREWCGMSILTDTRPDNDIVDILGFLTFEIVATLTEEALAVKDRMDRIQNSSGSGGSHAAHHPKNCSLFDGLTEGRTPLQVSHVLEAFRRLQIPDKTHTAMRSFHGGLVKSRVYLI

SEQ ID NO: 44931 - protein, 245 aa, Staphylococcus epidermidis ATCC 12228
MKNIIVIKLGGIAIENLNDAFIQQINAWHLENKKIIIVHGGGQVISNLLTKNNHSTIKIDGMRVTAKNDLPIIYDALINIVGHQLLERLKESNLEFFQFKEKIKELVSAEFLNKNIYGYVGKVKEINTMLLEKMLSRDIIPIITSLGVNEQGEYLNVNADHLATAIAKKLKVEKLVYMTDVPGVIEKDKTLATLTINEAKTKIENKIITGGMIPKIESAIQTLESGVESILIANNLQKGTIIRGD

SEQ ID NO: 44932 - protein, 651 aa, Candidatus Kuenenia stuttgartiensis
MIRFHNVCLNFGSTVIFDELSLQIRLNDRIGLIGPNGAGKSTFFKLICKYIEPSSGSIIYAKGVKTGYLPQECFAFSKKTVFEEAGSAFEDIHHLNRQIDAVHKDLDSPSLTDEDRQLLLERHTHLLHQLSVVNANKMNAEIEKVLKGIGFKDADFRKDIDALSGGWRMRVALARLLLQEPDILLLDEPTNHLDVDSILWLEQYLKELNGGLIIISHDRAFLDRNVSGIWELEKGNITEYHGNYSFYETEKEKRSGLQTSRYVNQQKKIKEVERFIERFRSKNTKASQVQSRIKMLGKMEKETLPENTVHRVTFRFPPAKQSGASVLEVKDVSCKYADQWVFQGVCLSIERGEKVALVGQNGSGKSSLLRIINRLHTPQSGTATFGHNVLADYFAQETAESLQGDNTVLEEVESIAPFSMMPHVRHLLGAFLFSGDDVFKTVNVLSGGEKSRLCLAKTLLKPTNFLVLDEPTNHIDITTKKVLKEALLNYPGSLLIVSHDRDFLDGLVSKVYELKDGNLFIHLGSFKDFLEKREAELRSGTHKTAGQEAPELKSSGITTQKQIFLQKKEQNAKRRKFTKELQKIEERISYLETQKKELDQTLLDTELYNDKERHIIINKQHKSVSAELNDLYKKWEVLHTELGAVDAGIAV

SEQ ID NO: 44933 - protein, 354 aa, Arabidopsis thaliana
MSNFTYTSAFNLSDNSPFNPAIGSSSSSSSALVVASDDDNNTDDACSICLEPFTLQDPSTEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQVSDFSRTSQTKNLCSKCYNDFLKDESARYLATFNVNTKAAEEVTAQEATVLGSKGGCGEEEG

SEQ ID NO: 44934 - protein, 445 aa, Aspergillus oryzae
MSSSSSNVVGVHYRVGKKIGEGSFGVIFEGTNLLNNQQVAIKFEPRKSDAPQLRDEYRTYKILVGCPGIPNVYYFGQEGLHNILVIDLLGPSLEDLFDHCNRRFSTKTVVMVAKQMLSRVQTIHEKNLIYRDIKPDNFLIGRPNSKAANVIHVVDFGMAKQYRDPKTKQHIPYRERKSLSGTARYMSINTHLGREQSRRDDLEALGHVFMYFLRGGLPWQGLKAATNKQKYEKIGEKKQTTAIKDLCEGFPEEFTKYLTYVRNLGFEDTPDYDYLRDLLTQALKNAGEVEDGEYDWMKLNNGRGWEYKSYSSQQHLHNNALPNSSARELHAQQLRSSQRPGVTADRLNAAQPPPPSPAKPGAGKTRERQNVQGGMPPKRQSGGMETTPTVSTQAQFQNSNANIPGRMGSPANPTKNSQQGPGAQGINEPQPTFVQKVMKALCCGR

SEQ ID NO: 44935 - protein, 610 aa, Chlamydomonas reinhardtii
MEANGFHVVLVEDDNICLKVVEQLLRKLSYRVSTASDGAAALKVLADCKQRGDKVDLILTDILMPEVTGFDLINEVVHGETFADIPVVASGTFLGFGRRTVRTVAWSRCQVMSSQDSQESVLQAFQAGAADYLIKPIRKNELATLWQHVWRANRAKGGQTSSGAAHGSSANGPANHGAAGTGLQSAGMAGSTAAGAAAPAVLAGAGAAAANGGANAAAHTAGATGRESGQAAGAATGGIAAAGTVIGWSHADMDVDGGEAGAQDEDDEDEDDGVEAPAGTQNRKRAADDSGCDGAAANNNGNTAAKAGAAAIAAGGPGSSGRAKATDGARAEIRHNGPPSARPSASLADTGGDGPAAATAPETRADGPSGPATTQGPKRDAVAAATAGGGKPSDAATYAAAAAAGLVPYPGFAPARPGPFPPPPGSGGPGAPPVYIPESVLQLIAHLSGRAAAEIPAVPAESVTAAPVVVQKSGGPASAARLAAVAKYLEKRKHRNFQKKVRYESRKRLAEARPRVRGQFVKAGTAGAATASGAAGKPELQGPDTAEEAAAATLLSAAAAMAAAAAGTSGPSGSGSGAMDVDGADPEADADVMDEDDGEDDGSDESAGEP

SEQ ID NO: 44936 - protein, 186 aa, Zea mays
MAEYLASIFGTEKDRVNCPFYFKIGVCRHGDRCSRLHNRPTISPTLVLANMYQRPDMITPGVDAQGQPIDPEKMQEHFEDFYEDIYEELGKFGEIENLNVCDNLADHMIGNVYVQFREEEQAAVAYNALQGRFYSGRPIIVEYSPVTDFREATCRQFEENSCNRGGSEVPWEKPKPKPATTKEGPP

SEQ ID NO: 44937 - protein, 485 aa, Nostoc sp. PCC 7120
MTLAETFNTENHGNPLITLNYEPALESLGNDYYDEVTAAEFPQLTLRWRNDAILPRLGLNPQIVTDEDFITAFGLFQGRKPLLALRYHGYQFGEYNPNLGDGRGFLYGQVRGTDGELYDFGTKGSGRTPYSRGGDGMLTLKGGVREVLAAEALHQLGVRTSRCLTMIETGLGLWRGDEPSPTRSSVMVRMNKSHIRFGTFERLHYFQRSDLIKKLLDHVIEHYYRHLAHESDKYALFYAELVKRVAELVAQWMAAGFCHAVLNTDNMSITGESFDYGPYAFIPTYNPYFTAAYFDYYGRYCYIQQPSICQWNLEMLQVPLRAVIDKADMEAGLAKFSEYCHAEYNSLMLKKLGFEELKTPEAEELLSLTLKFLQESQVGYHQFFYEMARTFSIKWRDEPGLVLSGSDIVPPSGTDANFDNWCVLYHKILNNFDYEQVKIIAQNLTHYNPKTSLLRPTIEEAWEPIVQEDNWQPFYDLVKSIQSRG

SEQ ID NO: 44938 - protein, 344 aa, Zea mays
MEFSLQDDDFGGDFSASNATRAASGSKRSFGDLEDDEDDIFGSKKVRTKAEEAAPGVATGMILSLRESLQNCKDDLASSQNELESAKAEILKWKSAFQNESFIPAGKSPEPRFLIDYIQNLKSSERSLKEQLEIAKRKEASYIVQYAKREQEMAELKSAVRDLKSQLKPASMQARRLLLDPAIHEEFSRLKNLVEEKDKKVKELQDSLTAFTFTPLSLKGKMLMEKCKTLQEENEEIGHQAAEGKIHELAMKLSMQKSQNAELRKQFEGLYKHMEELTNDVERSNETVIILQDKLEEKDKELERVKKGMEVVVSDVAEKKDDGEDKDPKYSALQTMFTSIQSER

SEQ ID NO: 44939 - protein, 244 aa, Moritella marina
MSFSSKTVLVTGASRGIGRAIAEHFAKLGATVIGTATSAQGAERIGAYLGDAGFGLELNVTSQDSVDALYAEIKTQVGHIDILVNNAGITADNIFLRMKEDEWCNVIDTNLTSLYRLCKPCLRGMMKQRHGRIINIGSVVGTTGNGGQANYAAAKSGLLGFTKSLASEVASRGITVNAVAPGFIETDMTAELTEEQKQTILAQVPTSRLGSTTEIAETVGFLASDGASYITGETIHVNGGMYMA

SEQ ID NO: 44940 - protein, 239 aa, Ficus pumila var. awkeotsang
MAAIFENESLATEARYAPVTSERKVRSDLELTLPKPYLPRALAAPDTYHPTGTPGHRHYNLSVLQQHVAFFDQDDNGIIYPWETYAGLRAIGFNVIVSLVMAIVINGALSYTTLPGWFPSPFLPIYIHNIHRAKHGSDSGTYDTEGRYVPVNLENTFSKYARIVPDKLSFGELWDMTEGNRLAFDPFGWIASKLEWGLLYDLARDEEGFLSKEAVRRAYDGSLFEYCAKMNLGPEDKMG

SEQ ID NO: 44941 - protein, 766 aa, Oryza sativa Indica Group
MSTLSHQHHHVLVLQLILLLPLLHLVVPGTPAAAGKFSDVLASGRNVSDGDVLVSPGGSFTLGFFSPAGATTRRRYLGIWFSVSPDAAVHWVANRDHALNDTSGTLTLTDAGVLLLLDGSGKVVWSSSTTAPPSATTSAAARLLDSGNLVVHGQGSGTALWQSFDYPTNTLLPGMKIGKNRWTGAEWYLLSWRSPADPSPGSYRYVTDGDEALPENVVLDGNGTEVYRTGVWNGRRFNGVPEMASFADMFSFQLTVSPGEVTYGYVAKAGAPFSRVVVTDDGVVRRLVWDAATRAWKTFFQAPGDSCDSYAKCGAFGLCDSNAGATSICRCVKGFSPASPAEWSMREYSGGCRRDVALDCSTDGFAVLRGVKLPDTRNASVDMGVKLDECRARCVANCSCVAYAAADLSGGGCIMWTKPFVDLRFIDNGQDIYQRLAKSETGRPPHWKFPVVITVAVVLVIIVVFVLVWAVKRKSREGGIRRSVSPGITSIDRITSIDRVTLQNATGNFAKKNLIGEGNYGRVYKGILPAESTITGSRQENEIVAVKLLQPSGTGTFVAELEAMFNAIHVNLVRLLAFCSDNDDRHTGEKFRALVYEYMPNNSLHHYIFAQNSELRAMLDWPLRLKIVDGIVEGIRYLHVGSNTPIIHRDLKPSNILLGRDWTPKISDFGLARGYTAPECWQLGRVEPESDVYSFGVILLEMISGKPNGLMQQLLPHIFSGIGVFHNSTILLSVTPPKIISLYNDLIEKLPDLVKAHHVHRNATQG

SEQ ID NO: 44942 - protein, 93 aa, Secale cereale
MASGQQERSQLDRKAREGETVVPGGTGGKSLEAQENLAEGRSRGGQTRREQMGEEGYSEMGRKGGLSTMDESGGERAAREGIDIDESKFKTKS

SEQ ID NO: 44943 - protein, 469 aa, Photorhabdus luminescens subsp. laumondii TTO1
MKKTKIVCTIGPKTESEEKLAELLNAGMNVMRLNFSHGDYEEHGQRIQNIHSVMTKTGKQAAILLDTKGPEIRTMKLEGGNDVSLTAGQTFTFTTDTSVIGNKDRVAVTYRGFPADLAPGNTVLVDDGLIGMTVKEVTKSEVICQVLNNGDLGENKGVNLPGISISLPALAEKDKQDLIFGCQQGVDFVAASFIRKRSDVLEIREHLKAHGGENIQIISKIENQEGLNNFDEILEASDGIMVARGDLGVEIPVEEVIFAQKMMIQKCNIARKVVITATQMLDSMIKNPRPTRAEAGDVANAILDGTDAVMLSGESAKGKYPIEAVTIMATICERTDRVMPSRIEAVHCRNLRVTEAVCRGAVETAEKLEAPLIVVATYGGKSAKSIRKYFPDAPILALTTNEVTARQLLLVKGVFTQIVKEIASTDDFYRIGKEAALASGLAKKGEIVVMVSGALVPSGTTNTSSVHVL

SEQ ID NO: 44944 - protein, 513 aa, Solibacter usitatus Ellin6076
MNRLEELRRRHAAAEQGGGPERKARQHKEGKLSARERIELLLDEGSFEELDKLVTHRCLDFGMEKEIVPGDGFVTGYGRIEGRLVYVFAQDFTVFGGSLSETNALKICKVMDLALKTGAPVIGLNDSGGARIQEGVVSLAGYADIFLRNTLASGVVPQISAIMGPCAGGAVYSPAITDFVFMVDHTSYMFVTGPDVIKTVTHEDVTKETLGGSMTHNSVSGVGHFIAADDAECCRMIRELMTYLPQNNREDPPRRATNDPIERMDAALDTIVPAESNLPYDIKDVIHRVVDDGEFFEVHEHFAKNLVVGFARMDGRSIGIVGNQPAFLAGCLDINSSVKGARFVRFCDAFNIPILTFEDVPGFLPGTAQEFGGIIRHGAKLLYAYAEATVPKITVITRKAYGGAYCVMGSKHIRTDINLAWPTAEIAVMGPEGAVNIVYRRELAAAKDQAAVRREKTEEFRERFANPFIAAERGYVDDVIEPRETRPRVIRALRMLENKVDTMPRKKHGNIPL

SEQ ID NO: 44945 - protein, 93 aa, Secale cereale
MASGQQERSQLDRKAREGETVVPGGTGGKSLEAQENLAEGRSRGGQTRREQMGEEGYSEMGRKGGLSIMDESGGERAAREGIDIDESKFKTKS

SEQ ID NO: 44946 - protein, 224 aa, Streptomyces avermitilis MA-4680
MSSGVGPDAGKKPGRGRRVILWRHGQTSWNVERRFQGTTDVELTETGVGQARRAARLLASLKPDAIVASDLRRAAATATELAALTGLDVTHDEGLRETYAGVWQGLTHEEIIAQFGDQYAAWKRGEPVRRGGGELETEVADRAAPVVLRHAEKLPEDGTLVVVSHGGTIRTTIGRLLGLESHHWEGLGGLSNCCWSVLGEGARGWRLLEHNAGTLPEPVLGDDD

SEQ ID NO: 44947 - protein, 93 aa, Secale cereale
MASGQQERSQLDRKAREGETVVPGGTGGTNLQAQENLAEGRSRGGQTRREQMGEEGYSEMGRKGGLSTMDESGGERAAREGIDIDESKFKTKS

SEQ ID NO: 44948 - protein, 412 aa, Photorhabdus luminescens subsp. laumondii TTO1
MTFSVKKVRQDFPVLTQQVNGHPLVYLDSAASAQKPVSVIERESEFCLHQYAAVHRGIHTLSSAATRMVENVRYQIAQFIHAQSHEEIVFVKGTTEGINLIANSYGRKFINNGDNIVITEMEHHANIVPWYMLAEQIGFEIRVWPLNENGELDQAILASLIDSRTKLLSFTHLSNVLGTVNPVRQIIKQARKLADEQEGRLHILVDGAQAIMHKQIDVQDLDCDFYVFSSHKLYGPTGIGVLYGRKSLLDAMPPWEGGGAMIKQVSLQKGITYAEPPWRFEAGTPNITGIIGLGAAVDYVTSLGLDEIQQHEQALMDYAMARLKEVKTLKLYGPEQRQGVIAFNLGRHHAYDVGSFLDQYGIAIRTGHHCALPVMEHYHVSSMCRASLAIYTTQEDIDALVVALQRIEQLLG

SEQ ID NO: 44949 - protein, 3302 aa, Lyngbya majuscula
MAKLNLNQDLGNGNSEVVQLAELGDGIVQITMNDEKNRNSFSKNFIDKLFRCFELVNQNPIYKVVIIAGTSHYFSTGATQEQLQSIFREEIKFTDFYEILTLALDCPLPVIAAMEGHALGGGLNLGLYADFLVLSRESFYANNLMKYGLTPVGSTSLILPKKLGAELGQEMIYTGRQYRGEELAQRGIPFPVLPRKEVLNSARKLAKEIAEKPRLSLLALKENLTAEIRTKLPEVVSKELEMHEKTFQQVKVASQAIHQTTSQPVQLKIASYGLLKNLTWVSLENQVPGVGEVKVQIQAVPVNFRDILNALGMLQEHNQTKLGITSVDHLTFGFEAVGVIVGVGLGVSQWQIGDEVMVIGCHDAFSSFIICSPNNLVAKPANLKLIEAATIPIPFFTAYHGLYNLAKIQSGERVLIHAASGGTGQAAIQLAQFWGAEVFATTSPQKMAVLREQGIKHVMNSRTTEFANEIRELTQGKGVDVIFNSLTHGEYIQKNLDVLALEGRYIEISKRKIWSHSQVAQKRSDIKYFPFDLLEEFNRDNQLYYQIWKKLIQCFENKELHPLVYKTFPNEDIVEAFRYLQRSKHIGRVVVTMPEIYSHKESSSYRLPNQGQMSQQEEVLQQLQSGEVSLEDAEKLLLEVTGEEVQQKILFKQINNGQNQQIKKDKSENILALLSSGEISLENAEKLLLEPESTKETEKETDAITPAQNTDIAIIGISCRYPGAKNYREFWENLQNGVDSVTEPPPGRWEGQNWYHPDPEHPDTSYCKCAGFIDDIDKFDPSFFQISPGEAQFIEPQQRIFLEEAYHAIEDAGYAPDFLKGRQCGVFVGAVKSDYSKLLSDSGLGTHRLALSGNQLSIVPARIAYFLDLRGPVMTVETACSASLVAVHQACESIKRGESELALAGGIHTMLTPDFQILSSQFQMVSPAGRCKTFDAEASGTVWSEGCGVLLLKSYEQAIRDQDHIYGVIKGTGINYDGNTNGISAPSSQSQTRLEETVYQKFGISPETISYVEAHGTATSLGDPIEVEALTETFAQWTNRKQFCAIGSVKTNIGHASTAAGVSGLIKTILCLKHQKLVPSLHFNQPNPHIDFANSPFYVNTEFQDWEAQEGKPRRAAVSSFGFSGTNAHIVIEEALREGNRQQATGNSEDYRKGNRQQATGNSEDYLERPVHLLTLSAKTETSLAELVRAYQNYLKTYPGLGLADICYTANTGRTHFNHRLAVVAADQQELVEKLQQHQQGDEVAGIYSGQQEYNTTTAKIAFLFTGQGSQYVNMGRELYQQAATFREAINQCDDILKTVETFRDKSLREILYPADDSSDSSLLNQTAYTQPVLFAIEYALCQLWKSWGIEPDAVMGHSVGEYVAATVAGVFSLEDGLKLIAARGRLMQQLPAGGEMVSVMANEAKILETLNAMSRSDKVAIAAINGPQSIVISGEGEAVRAIATHLESAGIKTKQLQVSHAFHSALMEPMLAEFEAVANQITYHQPWIPLISNVTGKLVDTGITSAEYWVNHVRQPVRFAQSMTTLDQEGYELFLEIGPKPILLGMGKQCLPEEVGVWLSSLRPGVEEWQQMLSSLGQLYVEGTKVDWLGFEQDYACQKVALPTYPFQRERYWLETNNGLPKKQYLSTSQNIHPLLGQKLNCASEQQIFQSVLGEGSPAYLSQHRVFDQALFPTTAYLEMATAAGNYQLKTSHLVVEDFLIRQGCILPPGELVSAQTILTPADNQGYQFQIFTQQEQKKQEEQKWVLHATGKIRSDQTETTPTPVDLEKYQRECNHSIEISQHYQQCRQIGIDYGSSFQGIQKLWSGSNQALAEIKLPEELLGETIDYQFHPALLDAALQVTFSALPQTDSDKTYLPVGIEQFKVYRSPGLSLWAYASVMTPVEESQESLTTQVTLVSPSGEIIATVKGLQVKLATQQTLLKTEVESITNWLYGVEWRNKGRLGRLLPPDFLLAPVEVSQQLTPSLAELVTQVDNARTAEIGKSIEALSVDYIVQALSSMGWSYQPTESFDLQAAVQRLAIVPSQRRLFQRLLEILAEVGILQSQQQRWQVQQTLEKVNPTQKSQSLLSQYPEEAATLTLLDRCASQLSGVLRGAIDPVQLVFPKGDLTTAAELYKNSTVAKVMNTIVQQTITKAIDKLPPSRGVRLLEIGAGTGGTTNYILPYLNPNQTEYIFTDIGALFTSKAQDKFRDYRFLGYQTLDIEVDPTSQGLESHQYDVIIAANVLHATTSLKQTLSHVRQLLAPGGMLVLYEATTRTRWVDLIFGLLEGWWKFSDYELRPDYPLLSRQQWKKVLSETGFTQVVTLPEVEGMAKALSEQTVIVAQAATTTLEQTKETSKGWLILADTQGIAQHLASQLRSVGDVCTLVFAGESYQQLAPEEFTINPDNLSEFEQLIETLTAKSPSLSGVVQCWTTEAGLGKTINSEELENLSRLGCGTTLSLVKALVKAGLSQSPRLWLVTNGAQPVPSNHPVIPGVAQSSVWGMGKVISLEHPELNCTRIDLDPEETIEGQADALFNEIWSEDSEDQVAWRGDGRYVARLVGSRHRQPVTQQLVPSQPFKLGSSEKGSLDNLILEPVTRRSPGAGEVEIRVKATGLNFLDVVSALGLVPEQVDGMSQKHLVEMDSFGAECAGEVVAVGSEVTGFHIGDTVMAMAHGSFSQYVTVDATYVVIKPENLSFEEAASIPANFLTAYYALHHVAKIQAGDRILIHAGAGGTGMAAVQIAQQAGAEVLATASPPKWEALRNLGVKHIMNSRTLEFADQVMEITQGQGVDVVLNSLTSGEFISKGLSVVSSGGRFVEISKRGVWDSSQVAALRPDVSYFVVDLVKESIEQPGLINSMLQGLKDKLSNGLLQPPPIKVFPIEEVIDAFRYMQQAKHIGKIVVSQTQLADGTTQKPLSFRSGASYLITGGMGGLGLLVANWMVSKGAKHLVLLGRRSPDDATRKKITELEMAGAEVVVEKADVSDLESMTRVLHKIEQSNIPLTGVIHSAGMLSDGVLQNQSWSSFEQVMDPKVQGAWHLHQLTKNKPLDFFVLFSSVASLFGSPGQGNHSAANGFLDGLAHYRRGMGLSGLSIHWGAVAQVGEAAERGADMRASKQGMGVISPTQVLESLELLMSGEDVEVGVVPLEWSAWQERLAQWPFLADWQETIQTTSETSKSEFLLKLEATAPNERRSLLVAHVRRQLALVLGINNPESIALATGFFDLGMDSLSSVELRNKLQNSLDYSLPSSLAFDYPTVEKLVDYLVGKVVAKESYDTLVPKPTENKNDQKQEKLLADTKELSEEQLEELINQELNLIINE

SEQ ID NO: 44950 - protein, 177 aa, Triticum aestivum
  misc_feature (155)..(155): Xaa can be any naturally occurring amino acid
  misc_feature (167)..(167): Xaa can be any naturally occurring amino acid
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRXQVQCVSFIAFRXPPGCEESGKA

SEQ ID NO: 44951 - protein, 3935 aa, Lyngbya majuscula
MEPTTNKDQLSLSKQMFLALKQAETKLEMMELAKSEPIAIIGIGCRFPGNANTPESFWQLLANGEDGVREIPPERWDIDSHYHPDPDTPGKMYIRHASLVEQVEQFDPEFFGISPREAHSLDPQQRFLLEVTWEALERAGINPQQLENTQTGVFLGIGQNDYADLGLSQLENISPYDGTGNGFCFAAGRLSYFLGLQGPSIAIDTACSASLVAVHEACQSLRQRESNLALAGGVQLILSPYVTTALSRLKALSPDGRCKTFDAAADGYGRGEGCGMVVLKRLSDAVKNGDQIWAVIRGSAVNHDGPSSGLTVPNKLAQEKLIEQALKAAKVEPSQVGYVEAHGTGTSLGDPMEVRALATVFEQGHNQENPLRIGSVKTNIGHLEAAAGIAGLIKVVLQLQHQKIAPSLNFVNPNPYIEWENLPLEVPTQLKPWLSSGDKRVGGVSSFAISGTNAHVVLEEAPREGNRQQATGNSEDYLERSVNLLTLSAKTEIALAELVSSYIYYLETDTELAREHPFRFAIANVCYTANTGRAHFKHRLAVIASDHKELAEKLLYQKTGEEVVGLFAGQFDSASQSPPKIAFLFTGQGSQYVNMGRELYETQPTFRQALEQCDQILQPYLEYSLLEILYPQNAQPSSSSLLDQTAYTQPALFAIEYALYKLWSSWGIKPKAVMGHSVGEYVAATVAGIFSLEDGLKLIATRGRLMQQLPSGGEMVSVMASESKIRELITPYTEKVAIAAINGPESVVISGEAEAIAAIVHKLESDGVKTKRLQVSHAFHSPLMEPILAEFEALAKQITYHQPKIPLISNVTGTKVDNSIATANYWVNHIRQPVKFAASMATLHQQGSEIFLEIGAKPILLGMGRQCLPEDSGTWLPSLRPGVDEWQQILSSLGQLYIRGAQIDWSGFDRDYSPQKVVLPTYPFQRERYWVETAKDWNGKAISATKLHPLINQKFCSPLAKEIFFESHFSTTNLPFLADHRIYEKVVVPGASHISLLLAAASLTLPTTACQLEDILFPQALAIPEQGARTVQVALTPQDSSYSCQVISFDDSLDSQTHELSNNGNQADSWAVHATGKLALTKAEQSLIPLEEIQDRCLTKIDNTEVYQYIWDRQIQLGQSFRWIEQVWLGEGEVLCQMKVPQTVWDATKYQLHPALIDSCFQSIVALDLSQSDDNNETFVPFSVEKFIFYNRPQPGLLWCFTRASQDKQAKERLKADIQLFDQDGQLVAQVIGLQARKANPETLLMTLEADLSNWFYEINWQTQPLPSTSPSNGNQTGNWLVFALTSELTECIGKELAQKGHNCIWVSPGSEYQQLDAQHYQINPTVAEQFSQLLQDNADIKGIVHLWGVDETKESVGELAKAQELGCATALHLVQGLTQAGLTQVVPMWLVTQGTQTVLAETEVVQPQQGSLWGLGRVMRLEHPELTCCRVDLDPKSPVADTLPILVDELLFNNQEDQIAIRQGVRYVARLVQQQKQKFTSQQQLPIPETQPLELKLSEYGLIDNLNWQPMQRRPPEAQEVEIQVKAVGLNFRDVLNALGLLKEYYAQHLGITSVEQLTLGLECVGVITSVGETVSHWQIGDEVMAFVPNGFSSFVTTAAEFVMAKPKQMSFPEAATLPLTFFTAYYGLQHLAKIQPGERVLIHAAAGGVGQAAVQIALQAGAEVFATASPPKWDFLKSLGVQQIMNSRTLDFASEIMHLTQGGGVDIVFNSLNGEFIDKSFAVLATQGRFVEIGKIGIWTPEQVKQKRPDVDYFPFDIGEVMTQQPNLIAKISEELTQQWNQGKLQALPYKVFPSTEVAAAFRYMQQAKHIGKVVVAMPEASCEQKSIQAEASYLITGGLGALGLEVAQWMVKEGARNIVLTGRSAPKEAAQKTIRELETAGASVNVLLGDVSTQEDVTKIFQQMVEASLPPLKGVIHAAGVLDDGVLQKMSWERFTKVMAPKVSGTWYLHQLTQDLPLDFFVCFSSMASMLGNYGQGNYAAANGFMDAIAHYRRGQGLPGLSINWGAWATAGMAARLAREHQNRMQSSGVVAIDPESGMQALGSLLSGSQSQVGVFPVNWPEFFRQMPGMAKLPFLEAFTTKSVEQSQKDRILEQLNVASDREQEKLLTSYLQSRVAHFMGMTLSQIELEKSLTVMGLDSLMAVELRNQIQTELAVDIPATRFMEGITIIALATEIKQQLIIKTDKNQTIESNNQGQLDQNKDSNWIGGRTMNLVEFLQDISLKGVKLWCDGEKLRTGGSQEVLTPDVIAQLKQHKSEILQLLKENPGIFQVHPLSYGQKGLWFLWLLSPQNHNYNVSFSVRIYSKVDITIWQQVFQALRERHPLLRSTFPNLAEQPVQQLHQHQELDFLQIDASSWSEEELNKKVIEAHRHPFNLETESVMRVRWFTCSEANHIMLLTIHHIALDGWSCNLIAKELPQLYQAQQYGVETSLPPLNNSYQDYVRWQKELVEGQKGEQLWNYWQQKLVGELPVLNLPTDRPRPPIQTDNGGSYPFKLSEKLTEQLKKLAQTEGVTLYMILLATFQVLLYRYTGQVDILVGSPTYGRTKAEFASIVGCFVDSMVMRADLSGNPVFRDFLSQVRQTVLEALAHQDYPFPLLVDKLQVERDSSRSPIFHTYFILHKFQESKGWQNVFFSSKKTLMNWGGLEVEPFTLDQQEGLYDLDLEMLEEDSYLLGFLRYNTDLFDGSTIERMAGHFENLLSGIVENPSQKVSELPILSAAERHHLLVEWNDTAVEYPKDKCIHQLFEEQVEKTPDAVAVVFEGEQLTYQQLNQQANQLAHYLRSFEVGPGVLVGISVEPSLEQVVSLLSVLKAGGVYVPLDPNYPQERLAFMQEDSKVQVVLTQEPLLEKISLQHSRMVCLDRDQDVIGRESSENLACHTTPDDLAYAIYTSGSTGKPKAVLGRIRSTVNRLHWMWEMLPFAADEICCQKTSINFVDHVAEIFSPLLKGIPLVIVKDDIRGDVPQLMSLLRDKKITRIVLVPSLLKTMLEYGSEQFTQLRYLKYVFCSGETLPLNLAQAFQQKISSARLFNLYGSSEVAADVTCFEVNLWQTRQKILQYFKPQVIHNFNDNQVPGLDQKPFTKPGVSTETLAPKFQRSELPLYPLKVEDYYDKLSQEVLPYVIDTGSPKFIGHMTSALPDFMHDMSKLISRLNQNLVKIETSKSLILLERETLAILHRLVYHFADEFYQDNIQQKNRNLGIVTTGGTTANISALLCARNRGLLSKENSLELSKESIYHVLSKKGYQDIVIIGSRLMHYSINKAASILGMGTKNVVYIDSSSDGKLDLDLLVENISECRNKHMYVLAIVGIAGTTETGEIDPLVEMGNIAQEFGIHFHVDAAWGGATIFSERHKGKLKGIEKADTITICGHKQLYLPQGISVCLFKDPQMLNFAETTARYQAQRDTFDVGRFTIEGSRSALSLCLHGSLHIIGKRGYEILIDDGIEKAQYFSRLIQMLEPFELIMEPALNIVNYRYIPADLRSKVKQKSLTDSEIERINQLNTQIQKEQFEWGMTFVSKTTLIDTGHDQGKEIVVFRTVLSNPNTTTADLHSVLEDQLRIANQIETSETRSKHKLIDFSTPDAVTMDKEMIYLHLADDPKANLEEALEEYLKKNTVPIGKPISNTQIYILDKYGNLLPPGIPGELYVGGDGIAQGYLSHPELTQEKFILNPFTKDKKSQNTEANRLYKTGDLARWLPDGNIEFVGRIDNQIKLRGFRIELGEIEALLNGHSQIQQAVVIAREDIPGNKRLVAYIVASDESLSTKELREFTKQKLPEYMIPSAFVTLDSLPLMPNGKIDRKALPTPDGISPEQEYVAPKTEIEQHIAQIWQDVLQIEKVGIYDNFFEMGGNSLLLVKVSSKLQELFKMELQVVELLKYPNISYLSQYIKSETPKTKNLTEARNVRDYKLKEGKKNMRQRLEGRQRHRSKNKIRE

SEQ ID NO: 44952 - protein, 437 aa, Sinorhizobium meliloti 1021
MPGLYARESRSVSKMAHLRFFPQAVVGGSGAYLTADDGRQLLDFSASWGAASLGHSHPAIREAVGRALSDQAGASYLSSANEACVLLAEKLLSLVPERARGRVWFGHSGSDANETVARIVVAATGRPRILAFHGAYHGGTIGSMGVSGHPAQQGSRAEGLTLVPYPNSYAAGSPEAARDAALAHLERLFATEVPPEEVAAFFIEPIQSDGGMLVPPDGFFKAVEALCRRHGILIVSDEVKVGLGRSGRFNAFEHSGIEPDIVVFGKGLGGGLPISAVVGPEAIMNHSVAFSLQTVHGNPVCAAAALAVLQTIERDHLILNADRSGKVLREALDRLTARHTLIGDVRGRGLALGIELVTDPASREPASRQAALTVYRAFQLGLVLYYVGVQSNVLELTPPLTLTPAEAESGVAMLGQALADVAAGRIDEALLGDFAGW

SEQ ID NO: 44953 - protein, 339 aa, Anabaena variabilis ATCC 29413
MALSADSRLQFTSDLNICRILNGMWQVSGGHGKINAPAAIKTMFQYVDAGFTTWDLADHYGPAEDFIGEFRRQLVANRGKEALANIQAFTKWVPRPGRMTKKLVEENIDISRRRMDVESLDLMQFHWWDYQDKNYLDALKYMAELQTEGKIKHLALTNFDTEHLQIITEAGIKIVSNQVQFSLVDRRPEVNMVKFCQQHDIKLFTYGTLCGGLLSEKYIGKPEPRGFDLGTTSLRKYKNMVDAWGGWHLFQELLSTLKQIADKHGVSIANVATRYILDKPAVGGVIVGARLGISEHIADNAKVFSFTLDAEDSNVINTISSQSRDLYQLIGDCGDEYRR

SEQ ID NO: 44954 - protein, 400 aa, Bacteroides fragilis YCH46
MKKVVFLGLGYIGLPTAAVAAGHGYEVVGVDVNPSVVETINQGKIHIVEPELDQIVKEVVRTGNLRAVSKPEQADAFFVVVPTPFKQNHRADITYVESATRSVIPYLREGNLFVIESTSPVFTTERMAEVIYKERPELKDKIYIAYCPERVLPGNTLYELVHNDRVIGGVNPESTAKAIEFYSAFVQGKLHPTNARTAEMCKLTENSSRDSQIAFANELSMICDKAGINVWELIELANKHPRVNILQPGCGVGGHCIAVDPWFIVSDYPEQAQIIKRARETNDYKADWCANKVMEACQQFVEKNDREPVVACMGLAFKPNIDDLRESPAKYIASRIVSESRAEVLIVEPNVASHASFHLTDYREAYQKADIVVWLVRHTPFVELPREESKLELDFCGVRK

SEQ ID NO: 44955 - protein, 130 aa, Glycine max
  misc_feature (93)..(93): Xaa can be any naturally occurring amino acid
  misc_feature (102)..(102): Xaa can be any naturally occurring amino acid
IADADATIDYRAGALVHTSFTGLKAMAGFPTMRTNNDITSIASNRGRVQCMQDWPPFGKKMSVTLSYLPDLDDAQLAKEVQYLLMNGWILWLXEFGAEHGFXYRERNRSPGIYHGRYWTMCTLTMTGCTD

SEQ ID NO: 44956 - protein, 414 aa, Bacillus clausii KSM-K16
MTTHLQDIIRANQQIKDVVTHTPLQKDQVLSERYDCTVYLKREDMQVVRSFKIRGAYYQISSLSKEELAAGVVCASAGNHAQGVAYSCRALKVKGVIFMPTTTPKQKVAQVKFFGRDYVDVRLIGDTFDDSYADAIQYCEEQEMTFIHPFNQDKVIAGQGTVGLEIMNDIEETPDFVFSSIGGGGLISGMATYIKSVSPSTKMIGCEPAGAASMTESIKQGNVVELDEIDKFVDGAAVKKVGDKTFEICKELLDDIIVVPEGKICTTILNLYNENALVAEPAGAMPIAALDLYTEQIKGKVVVCIVSGGNNDIGRMEEIRERSLIYEGLQHYFIVEFPQRAGALREFITDVLGPEDDITRFEYTKKNNKSNGPVLIGIELKCSKDYDGLIERMEKIGFAYNEVNKDENLFSLLI

SEQ ID NO: 44957 - protein, 106 aa, Anabaena variabilis ATCC 29413
MTVYQVRLINSAIALDCIISVPDDQYILDIAAEAGIRLPSGCKQGDCSACVAKLISGEVDQSEQQFLRPDEIQQGYVVTCVTYPLSDCTLETHQEQVLYNSSLYQP

SEQ ID NO: 44958 - protein, 226 aa, Oryza sativa Japonica Group
MKLEVMPKQRAMEAEQREEAMEMSGLELWKHEKPASMVVFLPPPPPPPPLVPAAAAAAAAACGEEATLVPPLNFAMVDDGIFRSGFPAAANFRFLKSLNLRSIVYLCPEPYPETNAEFLAKNGIKLHQFGIEGRKEPFVNIPDDKIREALKVVLDVKNQPLLIHCKRGKHRTGCVVGCLRKLQKWCLSSVFDEYQGFAAAKARSTDQRFMELFDISSLKHLTASHC

SEQ ID NO: 44959 - protein, 497 aa, Thermoplasma acidophilum
MMASVTGMIGSGWLFSAFYASSMAGPYSIFSWLVGTGIVAILALIYADLSGRVPMAGAAAGYPFLTNGTVAGSLNAWSLFLGYASTPPLEVIASISYLSFLVPGLLNNNGLLTTTGILLAVALLVAFFILNATGIRNTSRFNNIISYMKIAIPIITSFFFIFTIFSIRNFTLVGTVKPEGIFTAVPGAGIAFSFLGFRQAVELSGEAKNPQKTVPIAIMLSVAVASAIYMIVQIAFIGSLQWGSIKPGDWAALADSGYSSGPMLVLASTLGLGALATVLLFDGIISPLGTSSIYQTTTSRISYRISEMGFFPKKISTTNSRSVPIFALILDLVVMILFVLPFPSWQSLVSVNSDLTIIAYMSGPISLAIFEKYGIEAKGFRLPASKILAPLGFALSALIVYWSGYPTTLYMSAIAIAGLVLFVFARKNPIRDISQGSYMIAILAILPVVSYLGSYGIGIIPFPLDLIVISAVALAIFYAGTRAAPQSVALMENFISS

SEQ ID NO: 44960 - protein, 515 aa, Triticum aestivum
  misc_feature (453)..(453): Xaa can be any naturally occurring amino acid
MLVTLTTLLLSLIQQWELILLALVSVVTLLLLTRSRSRCSQKEMKLPPGPAPVPFLGNLHQLGRLPHRTLRDLARLHGPVMQLQLGKAPTVVLSSPDAAWEGLKVHDLDCCTRPVSPGPKRLTYDLKNVAFAPFGSYWRNIRKLLVVELLSGRRVKAAWYARQEQVDKLISTLMRAGGKPVALDEHILSLSDGIIGTVAFGNIYGSDKFTQNNNFQHALDEAAEVLSSSSAEDFFPKAIGRLIDHITGAFARRERIFKQLDAFFEMVIEQHLDPKRTKPDNGGDLVDVLITHWKEHRGKLNFTRDHVKALIFDTFIAGVDTSSVTILWAMSELIRSPRVLSKVQAEIWAVVGRNDRVRSEDVSKLEYLKLVVKETLRLHPPAPLLVPRETMRHIQIGGYDVPAKTRIYVNAWAIGRDPTSWPNHPEEFNPERFEGNEIDFKGEHPQMLPFGTXGRRICPGISMGIATVEFTLANMLCCFQWALPDGMEPEDVSMEEEGKINFHRKTPLVLVPTIR

SEQ ID NO: 44961 - protein, 179 aa, Brassica napus
RTRGAGDSRCVISRKGQAYNLSRDHKPDLEAERERILKAGGFIHAGRVNGSLNLARAIGDMEFKQNKFLPTEKQIVTASPDVNTVELCDDDDFLVLACDGIWDCMSSQQFVDFIHEQMNTETKLSVVCEKVLDRCLAPNTAGGEGCDNMTMILVQFKKPVQSTEPSQAEASYNEPSSSN

SEQ ID NO: 44962 - protein, 199 aa, Ralstonia metallidurans CH34
MPLNIPILLTWLRVAMIPLVVGVYYLPEAWLPMHTKNVTAASFFVIAAVTDWLDGFLARRWNQTSAFGAFLDPVADKLMVTAALLSLLALGRVADLIALIIIGREITISALREWMAQIGASKSVAVNFLGKLKTTVQMIAIPLLLFNDALFGVDASLLGGWMIYLAAVLTLWSMFYYMKLAWPQIRERSEVISGARTQK

SEQ ID NO: 44963 - protein, 530 aa, Aspergillus nidulans FGSC A4
MAEYTSDADVELAYTTLQTTFKSGKTKEIAWRKWQLKQIWWLVDDNEALIQEALKKDMNRHPFETTFTECANVKGDVIEHLKNIDKWTADQKPSAGMLGLMLRPTVRPEPLGVALIIGPWNFPFSLLVQPLIAAITAGCAALLKPSEVTSSVQQLFVDLVPKYLDTSAVRVVTGGPAETGCLLQRKFDHIFFTGSVPVARHIAAAAAKHLTPTVLELGGQCPAIVTSSADVDAAAKDIAWIKYLNAGQICLSVNHVFAHPSVERKLIERMAFWLDRFYKGEKDAMTHIVNDKNYARIKQLAEKTKGKIELDGTADAETRSLPVSIVSNVEMSDPLLSEELFGTVCPVIKGSTDDAIKSINSLPRPLALYIFSQDQNEVEHIISSTLSGGVCVNGVLVHAMVPNAPFGGVGDSGHGAYHGEYGFKSFTHYRTIARPAPFFFKMSEWMRPPYSVDNIKKLAVRNSVGIQRNWSLEQEREAIKRGLLLTKSLKSARFLVYLVVLLGLADVGLDRRLGVLKSVRDLLVEVRSLF

SEQ ID NO: 44964 - protein, 525 aa, Photobacterium sp. SKA34
MTTNIHEQRILILDFGSQYTQLIARRIREIGVYCELWSWDVDEADIREFAPNGIILSGGPESVTEAGSPRAPQYVFEAGVPVFGVCYGMQTMAEQLGGKVAGSNEREFGYAQVKIVEPTHFLEGIQDATAEDGTPLMDVWMSHGDKVVEIPSDFIKVAETETCPFAAMANEEKRFYGVQFHPEVTHTRQGMKLIENFVMNICGCEKLWTSANIIEDAIARIKEQVGDDEVILGLSGGVDSSVVAMLIHRAIGDKLTCVFVDNGLLRLNEGQQVMDMFGDKFGLNIVHVQAEDRFLSALAGIDEPEAKRKKIGHVFVDVFDEESKKLKNAKWLAQGTIYPDVIESAASKTGKAHVIKSHHNVGGLPDDMEMGLVEPLKELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGKVSNRIINEVDGISRVVYDISGKPPATIEWE

SEQ ID NO: 44965 - protein, 773 aa, Vitis vinifera
  misc_feature (43)..(43): Xaa can be any naturally occurring amino acid
MGLLNLVFLAFLFWVFFISHTHQMQSSQTQALLQLRKHLEYPXALEIWENYSGDFCNLASTPHMAITCQDNSVSELKIMGDKHVKVSDFSGFAVPNETLSDGFSIDSFVTTLSRLSGLRVLSLVSLGIWGPLPDKIHRLALLEVLDLSSNFMFGSIPPKVSTLVKLQTLTLDANFFNDSVPDWMDSLSNLSSLSLRNNRFKGQFPPSISRIATLTDVALSHNELSGKLPDLSSLTNLHVLDLRDNHLDSELPIMPKGLVTALLSENSFSGEIPAQLGELAQLQHLDLSFNSLTGTPPSALFSMANISYLNLASNMLSGSLPDGLSCGDELGFVDISSNKLMGVLPSCLSIASDRRVVKFGGNCFSIDAQHQHQESYCKAAHIKGKQSKGKEIGVLLGAIAGAVIIVAFLAFVLFILCRRCRKYPSRGSFEQPAMPKLAQENSSTGISPELLANARFISQAAKLGTQGSPTYRLFSLEELKDATNNFDPMTFLGEGSIGKLYKGKLENGAYVGIRTITLYRKYSIRNLKLRLDLLSKLRHPHLVSLLGHCIDGGGQDDSNVDRFFLIYEYMPNGNYHTHLSENCPAKVLKWSDRLAVLIGVAKAVHFLHTGVIPGSFNNRLKTNNILLDEHRIAKLSDYGMSIIMEENEKVDAKKEGGKPWQRKQLEDDVYNFGFILLESLVGPIVTGKGETFLLNEMASFGSQDGRKRIVDPIVLTTSSQESLSIVVSITSKCVSPEPSTRPSFEDVLWNLQYAAQVQATADADQKSDGASQT

SEQ ID NO: 44966 - protein, 376 aa, Photobacterium sp. SKA34
MTDKFIKSKAAIAWGPNQPLSVEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPEISLAKISKEAPLEEVCLLGCGVTTGMGAVLNTAKVEEGSTVAVFGLGGIGLAAIIGATMAKASRIIAVDINEEKFELARKLGATDCINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 44967 - protein, 110 aa, Arabidopsis thaliana
MGVKMLLIFGLLILAMVAKSVNATYPLTKSCINGQGCIGEDDELESLMDSETNRRQLARGRRYIGYDALKKNNVPCSRRGRSYYDCKKRRRNNPYRRGCSAITHCYRYAR

SEQ ID NO: 44968 - protein, 147 aa, Brassica napus
  misc_feature (146)..(146): Xaa can be any naturally occurring amino acid
MCLIMEAAEDHVDGGVLAAPSNFSMVEDGIYRSGFPKPENFGFLTTLNLRSIIYLCPEPYPEENLKFLEANNIKLFQFGIEGKTDPPTLMPKDTVLDALKVLVDVRNHPILIHCKAGKHRTGCLVGCLRKVQRWCLSSVLEEYQKXA

SEQ ID NO: 44969 - protein, 280 aa, Thermus thermophilus HB8
MGTMRIAFQGTAGAYSEEALLKVFPEAKPVGFPTFHQVFEAVEAGEAELGVVPVENTTAGSINQTYDLLLESDLHVVGEIVHRVEHCLLAPKGTTLKDLHAVKSHPQALAQCDGFLARMRLTPIPVFDTAGAAKELAEHPEPGLAAIASRRAAELYGLEVLAENIEDYPHNYTRFFVIGHKEPPRGQGPYKTSIVFAVRHRPGGLLEALSVFAEAGVNLTKLESRPRRDKPFSYLFYLDLEGHLEDPGPAQALLRLLRRVAFLKVLGSYPAHANGGVSAP

SEQ ID NO: 44970 - protein, 373 aa, Coccidioides immitis RS
MTTMDLRVGNKYRIGRKIGSGSFGDIYLGTNIISGEEIAIKLESVKAKHPQLEYEARVYKSLAGGVGIPFVRWFGTECDYNAMVIDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAVYLNYTRSLRFDDKPDYSYLRKIFRDLFVRESFQYDYVFDWTVYKYQKNAQAIAQASGNAGNNAQEEDDKPRGQVSTGGAPAGVPGGSLKPVPLGSHRRKLVERTAGESHDTNRAVGSDRM

SEQ ID NO: 44971 - protein, 93 aa, Secale cereale
MASGQQERSQLDRKAREGETVVPGGTGGTNLQAQENLAEGRSRGGQTRKEQMGEEGYREMGRKGGLSTNDESGGERAAREGIDIDESKFKTRS

SEQ ID NO: 44972 - protein, 171 aa, Brassica napus
  misc_feature (85)..(85): Xaa can be any naturally occurring amino acid
MASGGSKSAAFMLLLLNLGLYFVVTVIAAWAVNHGIERARESASVLSLPAKIFPIYFPVGNMATGLFRNILVESPGVVGMATSLXGIMNVLEWDSPNLHSAAASSLVSWSLTLLAMGLACKEINIGWTEANLRTLEVMTIIVSGTQLLCTGAIHVGVGETVAAERPHAGRV

SEQ ID NO: 44973 - protein, 90 aa, Secale cereale
MASGQQERSQLDRKAREGETGGTGGTNLQAQENLAEGRSRGGQTRKEQMGEEGYREMGRKGGLSTNDESGGERAAREGIDIDESKFKTKS

SEQ ID NO: 44974 - protein, 396 aa, Coprinopsis cinerea okayama7#130
MPQGLTCAPPSSNVAGFGTATVTQSDDEQQVHKKDHPHQSISQVPHRPSPGDDYQLLHAIGEGAYGTVAAALHKPTGRQVAIKKVLPFDHTLFCLRTLRELKLLKFFSETCVNENIISILDIIKPPSLEEFKEIYFIQELMQTDLHRVIRTQHLTDDHCQYFVYQTLRALKSIHSADIVHRDLKPANLLLNANCDLKVCDFGLARSVKTSVPAGKEVGLMTEYVATRWYRAPEIMLSFKMYTKAIDIWAVGCILAELLTGRPLFPGRDYSHQLDLILDVIGTPSLDEFYAITSRRSRDYIRALPIRKKRPFPTLFPHASQEAIDFLTKTLTFDPKKRMTVDEALEHPYLAAYHDPEDEPVVTPLSPDYFEFDMHKDDLSKDQLKGAREFDIPSTAA

SEQ ID NO: 44975 - protein, 304 aa, Glycine max
MANLPNSKLQRVGPPPPEQELEDEESFSRAMLLCSSVVVSMALQSATELGVFDVLQEAGAKLSAKEIASKLSCDNNPEADSMLDRLLALLASHSILNCSLILDHQNLGTFQRLYTITPVARFFARNSDGVSLGPLMALLQDKIFLHSWSELKDSIREGGIPFNRVYGTHAFEYPRLDARFNQVFNTAMINHTTIVMKKVLECYKGFENIKMLVDVGGGLGININLITSKYPHIQGINFDLPHVLEHAPSYPGVEHVGGDMFENVPKGDAIFMKWILHDWSDEYCLKLLKNCYDAIPDDGKVIVV

SEQ ID NO: 44976 - protein, 93 aa, Secale cereale
MASGQQERSQLDRKAREGETVVPGGTGGTNLQAQENLAEGRSRGGQTRKEQMGEEGYREMGRKGGLSTNDESGGDRAAREGIDIDESKFKTKS

SEQ ID NO: 44977 - protein, 792 aa, Photorhabdus luminescens subsp. laumondii TTO1
MPNNDLTPRNVLWYNQLGMHDIDRVGGKNASLGEMITHLSELGVSVPNGFATTAQAFNDFLEQSGVNQRIYDLLDETDVDDVNQLAKAGAQIRQWVIDTPFTSQLEKDIQDAYQQLSEGEPEASFAVRSSATAEDMPDASFAGQQETFLNVQGIDAVMVAIKHVFASLFNDRAISYRVHQGYDHRGVALSAGVQRMVRSDLASSGVMFTIDTESGFDQVVFITSAYGLGEMVVQGAVNPDEFYVHKSTLNKGKPAIVRRNLGSKKLHMTYADNKEHGKQVRIEDVPASQRNRFSLADEEVEALARQALLIEKHYGRPMDIEWAKDGHNGKLYIVQARPETVRSNQQVMERYQLNEQGQVLVEGRAIGHRIGAGRVKVIHNLNEMDRIQPGDVLVTDMTDPDWEPIMKKAAAIVTNRGGRTCHAAIIARELGIPAVVGCGDATERLQENQSVTVSCAEGDTGFVYQNQLNFTVQSSQVDQLPELDVKIMLNVGNPDRAFDFARLPNDGVGLARLEFIINRMIGVHPRALLEFDQQTPELQQEIKSLMAGYDNPVEFYVGRLTEGIATLAAAFWPKRVIVRLSDFKSNEYANLVGGDIYEPDEENPMLGFRGAGRYVSDSFRRCFALECEAVKRVRNDMGLTNVEIMIPFVRTVAQAEAVIAELASQGLKRGENGLKVIMMCEIPSNAILAEQFLEHFDGFSIGSNDMTQLTLGLDRDSGVVSELFDERNDAVKALLSLAIQAAKRQNKYVGICGQGPSDHQDFAHWLMEEGIDSLSLNPDTVVKTWLGLAKVS

SEQ ID NO: 44978 - protein, 411 aa, Solanum tuberosum
MGTLRAILKNPDDLYPLIKLKLAARHAEKQIPPEPHWGFCYLMLQKVSRSFALVIQQLPVELRDAVCIFYLVLRALDTVEDDTSIPTDVKVPILISFHQHVYDREWHFACGTKEYKVLMDQFHHVSTAFLELGKLYQQAIEDITMRMGAGMAKFICKEVETTDDYDEYCHYVAGLVGLGLSKLFHASGTEDLASDSLSNSMGLFLQKTNIIRDYLEDINEVPKCRMFWPREIWSKYVNKLEDLKYEENSVKAVQCLNEMVTNALSHVEDCLTYMFNLRDPSIFRFCAIPQVMAIGTLAMCYDNIEVFRGVVKMRRGLTAKVIDRTKTMADVYGAFFDFSCMLKSKVNNNDPNATKTLKRLDAILKTCRDSGTLNKRKSYIIRSEPNYSPVLIVVIFIILAIILAQLSGNRS

SEQ ID NO: 44979 - protein, 567 aa, Vitis vinifera
MEDYEVIEQIGRGAFGSAFLVLNKTEKKKYVLKKIRVAKQTEKFKRTAHQEMELIARLDNPYIVEYKDAWVDKGCSVCIVTGYCEGGDMAGAIKKARGALFPEEKLCKWLTQLLLAVDYLHSNRVLHRDLKCSNIFLTKESDIRLGDFGLAKLLSTEDLASSVVGTPNYMCPELLADIPYGYKSDIWSLGCCMFEIAAHQPAFRAPDMAGLINKINRSSISPLPIVYSSTLKQIIKSMLRKNPEHRPTAAELLRHPHLQPYLVRCRNTSSIFLPVKSEHISKDKTPRKPSPIKHSAGKDNRDKEGRVLKMAGSVEPLEENANVQPRNLQNKAKPTPIVQTEENLETKRVDPTSYPEEVSNAVESSKAQKESLDTETSTGSTPNSQPGDEKEQDESESAPKHFAQIQDGDIKNVTSEDDAMESNTQVPAGAETESKSLQPGNHGAMATSSANSTDKAGAKTDNTSCSMVMAKDDMNTMNKAPSEVSLLSTLTAVGGDETKGEWDNPSQQRADALESLLELCARLLQQDKLEELAGVLKPFGEEAVSSRETAIWLTKSLMTAQKFLGGA

SEQ ID NO: 44980 - protein, 1499 aa, Candida albicans SC5314
MSTANTSLSQQLDEKPWVDASDNSSVQEYQGFDATASHNIQDLARKLTHGSTNGDHHSANDLARYLSHMSDIPGVSPFNGNISHEQLDPDSENFNAKYWVKNLKKLFESDSDYYKPSKLGVAYRNLRAYGIANDSDYQPTVTNALWKFTTEAINKLKKPDDSKYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSATILDTTPLIAIYQCSQDAYELFDNVVVLYEGYQIFFGKASKAKEYFENMGWKCPQRQTTADFLTSLTNPAEREPLPGYEDKVPRTAQEFETFWKNSPEYAELTKEIDEYFVECERSNTGETYRESHVAKQSNNTRPSSPYTVSFFMQVRYVIARNFLRMKGDPSIPLISILSQLVMGLILASVFFNLRKSTDTFYFRGGALFFSVLFNAFSSLLEILSLYEARPIVEKHRKYALYRPSADALASIISELPVKLLMTMSFNIVYYFMVNLRRTAGNFFFYWLMCASCTLVMSHMFRSIGAVTTTIATAMSLSTVFLLAMIIYAGFVLPIPYILGWSRWIRYINPVTYIFESLMVNEFHGREFECGQYIPSGPGFENLPVENKVCTTVGSTPGSTVVQGTEYIKLAYQFYSSHKWRNFGITVAFAVFFLGVYVALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPTSGLDSQTAWSICKLMRKLADHGQAILCTIHQPSALIMAEFDKLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKLILVISSSLFIGFSFFKSKNNLQGLQSQMLAVFMFFVPFTTFIDQMLPYFVKHRAVYEVREAPSRTFSWFAFIAGQITSEIPFQIVVGTISYFCWYYPVGLYANAEPTDSVNSRGVLMWMLLTAFYVYTSTMGQLAISLNELIDNAANLATTLFTLCLMFCGVLAGPNVIPGFWIFMYRCNPFTYLIQAILSTGLANAKVTCAPRELVTLKPPMGETCSSFIGPYTEAAGGYFSTNSDGTCSVCRIDSTNQFLESINALFSQRWRNFGIFVAFIGINIILTIFFYWLARVPKGNREKKMKK

SEQ ID NO: 44981 - protein, 189 aa, Brassica napus
MLCRMVVVTGRKKKAGSVPVYLNVYDLTPINGYAYWLGLGVYHSGVEVHGVEYGFGAHEHSTTGIFEVEPKQCPGFTFRKSILIGRTDLDPEKVRAFMEKLAEEYSGNTYHLITKNCNHFCNDVCVQLTRRSIPSWVNRLARFGLFCNCVLPAELNETKVRQVRSKEEKVPEAEEKKLRSRSSRFPPGP

SEQ ID NO: 44982 - protein, 717 aa, Shewanella sp. ANA-3
MSRNIMLIPIGTGVGLTSLSLGMVRALERHGVKVQFFKPISQLRPNDNGPERSTTILSKSPTVNPLEPFDMAHAEALIRADQTDVLMEQIIARAAECASNTETLIVEGLVPTRNHPFADDVNYAIAKAMDADVIFIATPGSDTPTGLMNRLEIAYNSWGGKNNKRLIGAVINKIGAPVDDEGRARPDLSEVFDHQGVQRSDASIMFQMPGKSPLRILGSVPYNLDLVAPRASDLAKHLRARILNAGEMNTRRLRKVTFCARSLPNMVNHIKTDSLLVTSGDRSDVIVSACLAAMNGVKIGALLLTGSYEPEPEILKLCEQAFETGLPVFLIDTNTWQTSLNIQRFDHEVPVDDAVRIDLVQEYVASHIDQSWIESVTKNSPREHRLSPPAFRYKLTELARAAHKTVVLPEGDEPRTIKAAAICAERGIARCVLLGKKDEIQRIAAQQDVVLGEGVVIVDPDEVRDRYVEPMLDLRRNKGLTEVVAKEQLEDNMVLGTMMLAQNEVDGIVSGAVNTTANTIRPPLQLIKTAPGSSLVSSIFFMLMPDQVLVYGDCAINPDPNAEQLADIAIQSAESAKAFGIEPRVAMISYSTGNSGTGSDVDKVREATRIAKEKRPDLVIDGPLQYDAAVMPNVARSKAPNSPVAGQATVFVFPDLNTGNTTYKAVQRSADLISIGPMLQGMRKPVNDLSRGALVDDIVYTIALTAIQASQNDASKA

SEQ ID NO: 44983 - protein, 248 aa, Zea mays
LEGKVALVTGGATGIGEAIVRLFMEHGAKVCIADIQDEAGQQLRDALGGDAQGAMFVHCDVTSEEDVSRAVDAAAERFGALDVMVNNAGVTGTKVTDIRNVDFAEARRVLDVNVHGVFLGMKHAARAMIPRKRGSIVSLASVASAIGGTGPHVYTASKHAVVGLTKSVAAELGRHGVRVNCVSPYAVPTALSMPHLPQGARADDALKDFLAFVGGEANLKGVDAMPEDVAQAVLYRYFFCCCDKCVQD

SEQ ID NO: 44984 - protein, 572 aa, Wolbachia endosymbiont of Drosophila melanogaster
MHSGSQHLFDIIILLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMENNEIFISTTLLIVLGAAFITEQFHLSLALGAFVAGLLVAETEYRHSVEHAVLPFKDLFLGLFFMTVGMSINTELLLNKLPLITLLSIILTVLKTSIIYILCRFFGFKSAPAIQAGLLLSQGGEFAFILFRLADELNVLPSEIAQVLMMVTTVTMAFTPLLSGLGDWIANSFSTEKTILDDEAVETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHVNIVIRLPDLSNVEVYRDLGASKIIPETSEIGLQLGGAALSLSGISESGVTSLKSRFRKGNHSLLKDLGSDKDE

SEQ ID NO: 44985 - protein, 93 aa, Secale cereale
MASGQQERSQLDRKAREGETVVPGGTGGTNLQAQENLAEGRSRGGQTRKEQMGEEGYREMGRKGGLSTMDESGGERAAREGIDIDESKFKTKS

SEQ ID NO: 44986 - protein, 283 aa, Thermus thermophilus HB8
MLRGVKALRALGLLLLLGLALGQKSGGGVGGRPYVPSTPPPMSPGPAPVYPTPAPYYPVPGPVYVYPGGGGSLGTAPVLVFFGLALVAFLMVRGLSRAGEEGPRASVGRLRLALLLSPGVQRALRRLAEEADTTTAKGLADLLDEVALVLLREAPAWRFASYEAREGTEEEVLGQFDAWMLEDRSTYRETFRHFEGKKVEAAYTPKVEPGGRYLVASLVLAVRGSLPPGGPLDRGKAREVLLAFAATTPFTLLAFHLAWTPEKEGEGLTEEELLALYPNLEKL

SEQ ID NO: 44987 - protein, 176 aa, Synechococcus sp. RS9916
MKHTLSVLVEDESGALSRIAGLFARRGFNIDSLAVGPAEADGRSRLTMVVEGDEHTLQQMTKQLDKLVNVLQVLDLSQIPAVERELMLLKVAAPAEQRSAILELVQVFRAKVVDVADDALTLEVVGDPGKLVALERLMAPYGILEIARTGKVALERSSGVNTELLKAAITGGRVPA

SEQ ID NO: 44988 - protein, 492 aa, Bordetella parapertussis
MRISMGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSSVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREVEDSEFEIPADLVLLAIGFVSPVATVLDAFGVDRDARGNVRANTDDYRTNVDKVFAAGDMRRGQSLVVWAIREGRQCARSVDEYLMGASELPR

SEQ ID NO: 44989 - protein, 81 aa, Brassica napus
AGWLGGLGYCENLKTLKLVSCKKIDCGFGLGECLSRSCPALERLHLEKCQLREKDAVKALFKMCEAAREVVFQDCWGLDDD

SEQ ID NO: 44990 - protein, 558 aa, uncultured sulfate-reducing bacterium
MVKKVKKKKKGLRSLGGGSSHGEVSTQRPVYTEKMPPCANACPNHNAIREMLMTISKAEDYEKTREQGIEDAFHIFMETTPFPSICGRICPHPCEGDCNRREKDGAVSINRVERFIGDFGIEKGLKPNKLTDEVRSENVAVVGSGPGGLSAAYQLARRGYPVTVFEAFPKPGGMLRYGIPEYRLPRDILDAEINRILDMGVELKLDTAIGSDMSLDDLRKEYKAIFIAIGAHQGIQLRVEGEDAPNVFTGTDFLHKVNVGEKVEIGNKVVVIGGGDTAIDAARVSRRFGADVTIVYRRTRTEMPAIEEEIVGAEQEGVKIHFLAAPIEIHKNSGTANGMKCQRMELGEPDSSGRRRPVPIDGDTFDLEFSSLIAAISQAPDFEGFDSLIEGKDWFKVDDSYKTKIDGIYAGGDNTNLGLVIDAIAHGRVAATAIHEMVTGEKRPEELNLEVVRIDRMIPAYYQEHKRLPDREMPVDERLKSMAAEVVDTLDSEEAVDEAVRCMSCGMCFDCGTCWSYCQENAIIKPLVKGEAYKFKLEYCVGCAKCAETCPCGYIEMK

SEQ ID NO: 44991 - protein, 393 aa, Glycine max
MLSFVTENMGLLCSRNRRYNDADAEENAQTAEIERRIEVRNERAEKHIQKLLLLGAGESGKSTIFKQIKLLFQTGFDEAELKSYLPVIHANVYQTIKLLHDGSKEFAQNDVDSSKYVISNENKEIGEKLLEIGGRLDYPYLSKELAQEIENLWKDPAIQETYARGSELQIPDCTDYFMENLQRLSDANYVPTKEDVLYARVRTTGVVEIQFSPVGENKKSDEVYRLFDVGGQRNERRKWIHLFEGVSAVIFCAAISEYDQTLFEDENRNRMMETKELFEWILKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLLEAGLL

SEQ ID NO: 44992 - protein, 181 aa, Candida albicans SC5314
MGLSFSKLFANLFGNKEMRILMVGLDAAGKTTILYKLKLGEIVTTIPTIGFNVETVEYKNISFTVWDVGGQDKIRPLWRYYFQNTQGIIFVVDSNDRDRIAEAREELQQMLNEDELRDALLLVFANKQDLPNAMNAAEITEKLGLHSIRQRPWYIQATCATTGDGLYEGLEWLSTNLKNSS

SEQ ID NO: 44993 - protein, 229 aa, Listeria monocytogenes str. 1/2a F6854
MTKQANLQKVTAQIERACEESNRQAKEVTLVAVTKTIDAAGITELYDLGIRHFGENRADVFQEKTVALADKEDICWHYIGSLQTRKVKDVLPQIDYLHSLDRSSLAKEIEKRATKPVKCFLQVNISGEESKHGFSKEEALSFLQEANFTFIEIVGLMTMAPITNSDIELHHVFHELKQLQQEIHALQLKNIPCTELSMGMTNDYGIAITEGATFIRVGRALVSDDNMEV

SEQ ID NO: 44994 - protein, 175 aa, Glycine max
MGNDDMTERVVFVTVGTTCFDALVRAIDSDNVKKALFAKGYTHLLIQMGRGSYLPTKSEGDDCSLAVDYFTFSSSIADHLRSASLVISHAGSGSIFETLRLGKPLVVVVNQDLMDNHQSELAEELADRKHLYCASPQTLHQTIADMDLSSLLPYSPGDATPVAKHINRFLGFPDD

SEQ ID NO: 44995 - protein, 755 aa, Sinorhizobium meliloti 1021
MRDLSAGPRVLLKRLRELMAEPLEPQERLDRIVRQIAQNMVAEVCSVYVLRSDGVLELYATEGLNKTAVHLAQLKMGQGLVGTIAASARPLNLSDAQSHPAFTYLPETGEEIYHSFLGVPILRTGRALGVLVVQNKAQRNYREDEVEALETTAMVLAEMVATGELKKITKPGLELDLSRPVTIEGNSYGEGIGLGYVVLHEPRIVVTNLLNEDTEHELQRLAEALGSLRISIDDMLSRRDVSMEGEHRAVLETYRMFAHDRGWVRKLEEAIRNGLTAEAAVERVQSETKARMIRLTDPYLRERMHDFDDLANRLLRQLSGYGAKLSAADFPNDAIVVARAMGAAELLDYPRENVRGLVLEEGAVTSHVVIVARAMGIPVVGQAAGAVALAENRDAIIVDGDDAKVHLRPMADLQRAYEEKVRFRARRQAQFRALRDVEPLTKDGKRITLQMNAGLLVDLPHLNEAGAEGIGLFRTELQFMIASTMPKAEEQEAFYRNVMKQTAGKPVTFRTLDIGGDKVVPYFRAAEEENPALGWRAIRLSLDRPGLLRTQFRAMLRATAGAELKMMLPMVTEVAELKSARELLQKEIERQSKLGEQLPRKLQFGAMLEVPALLWQLDELMAEVDFVSVGSNDLFQFAMAVDRGNARVSERFDILGRPFLRILREIVRAGERNNTPVTLCGEMASKPLSAMALLGLGFRSVSMSPTAVGPVKAMLLALDAGRLNELLEAALDDVKSDTSIRQLLVDFAAANGIPV

SEQ ID NO: 44996 - protein, 424 aa, Sinorhizobium meliloti 1021
MARIVMKFGGTSVADLNRIHNVARHVKREVDAGHEVAVVVSAMSGKTNELVGWVENMPKVAGSNAPFYDAREYDAVVASGEQVTSGLLAIALQSMGINARSWQGWQLPIKTDNAHGAARILEIDGADVIRRMGEGQVAVVAGFQGLGPDNRLATLGRGGSDTSAVAIAAAVKADRCDIYTDVDGVYTTDPRIEPKARRLKKIAFEEMLEMASLGAKVLQVRSVELAMVHKVRTFVRSSFEDPDAPGMGDLMNPPGTLICDEDEIVEQEVVTGIAYAKDEAQISLRRLADRPGVSAAIFGPLAEAHINVDMIVQNISEDGSKTDMTFTVPSGDVDKALRVLGDNKEKIGYDVIQSESGLVKVSVIGIGMRSHAGVAASAFRALADKGINIKAITTSEIKISILIDGPYAELAVRTLHSVYGLDKS

SEQ ID NO: 44997 - protein, 160 aa, Brassica napus
  misc_feature (138)..(138): Xaa can be any naturally occurring amino acid
  misc_feature (151)..(151): Xaa can be any naturally occurring amino acid
METAICGRLALAPTTLFNSISGDKHSVSKGPCVNNRGVLITMSTSVVGKGGGVLDKPIIEKTTPGRESEFDLRKSKKMAPPYRVILHNDNFNKREYVVQVLMKVIPGMTVDNAVNIMQEAHINGLAVVIVCAQADAEXQHCMQLRGNGLLXSVEPDGARC

SEQ ID NO: 44998 - protein, 821 aa, Aspergillus oryzae
MSLRARQKIRAPRRGLNTNKTDDFETNWEGLSTSLKKIHTKDASNLSFEQLYRNAYNIVLMMRGDELYERVKKLEQEWLDTEVQKRVTAAISSILLQAKDQAEIQDQENERRDTGEKFLNVLREAWEDHQISMGMITDVLMYMDRVVSADHKKPSIYVASMALFRDFVLRSAVRADAESMVADVLKSTVLFMIQLERSGQMINRPLIRHCIYMLEGLYETITEEESSKLYLTMFEPAFIETSKVFYRAEGRRLLETGDAATFCKAASDRIAEEGARCLSTLSPLSEPKIKDVLDKELIGSNIAEVINLEGTGVKNMLDNDRMDVLRNVYVLSARVDSKKIPLTAAVQKRIVEMGDEINKSAAAAAQAQPTKSAEKTAEGGKKPAEKPVNQQTVSAIKWVDDVLGLKTKFDKIWEESFRSDPTMQSAITTSFSEFINSNTRSSEYLSLFFDENLKKGIKGKTETEVDALLDNGITLLRYVKDKDLFEAYYKKHLSRRLLMKRSVSMDAERQMISKMKMEVGNQFTQRLESMFKDMTVSEDLTASYKEHIRGAGDPDQKPVDLEINVLTSTMWPMEAMSSIKGDEVQLPCIFPKEIDHLRQSFEQFYLSKHNGRKLSWQASMGTADIRATFHRSNGKVQRHELNVSTYAMVILLLFNDVPQGEPLTYEEIQARTRIPDHDLIRNLQSLAVAPKTRVLKKDPMSKDVKPADRFVFNNDFQSPFMKVRIGVVSGSANKVENQDQRKETEKRMNDERGASIEAAVVRIMKQRKTLVHSKLMSEVLSQLSARFVPDVNMIKRRIESLIDREYLERVGEDPPTYGYVA

SEQ ID NO: 44999 - protein, 278 aa, Phaseolus vulgaris
FYSSSCPRAESIVKSTVQSHVKSDSTLAAGLLRMHFHDCFVQGCDGSVLISGANTEKTAFANLGLRGFEVVDDAKTQLEAACPGVVSCADILALAARDSVVLSGGLSYQVPTGRRDGRISQASDVSNLPAPFDSVDVQKQKFTAKGLNTQDLVTLLGAHTIGTTACQFFSNRLYNFTANGPDSSIDPSFLPTLQSLCPQNGDGSTRVALDTGSQKLFDLSYYNNLRKGRGILQSDQALWSDDSTQKVVQRYLGLIRGLLGLKFNVEFGNAMVKMGNIG

SEQ ID NO: 45000 - protein, 229 aa, Picea sitchensis
MDAELWAARVTAAKRHHAVHHYHHHTDRQFNFDELEGDDDVRADFTCPFCYEDFDIALLCCHLEDEHCIETKNALCPVCAAKVGKDMVGHITLQHGHLFKMQRRRRLRKGGLPPNSTLSFLSKEFREGQLHPLLGGLSSRGVAANSAVPDPLLSSFVYNLSISESTEEQIKPKVSSEESLTKTSPDVRVMGSVESSLTAEEREQKFEEEARQSEFVQQLLLSTILGDNL

SEQ ID NO: 45001 - protein, 184 aa, Picrophilus torridus DSM 9790
MSEMEKITIENIVASTSLAEHLDLSKIALALEGSEYEPEQFPGLIYRLQEPKTAVLIFRSGKVNCTGAKNLDDVKKTIDIIIDKLKKADIEVYDNPDIIVQNIVAVYDLESNLNLTDIAMSLGLENVEYEPEQFPGLVYRVEEPKVVLLLFGSGKVVCTGAKEENEIEQAVIKVKKDLQKVGLI

SEQ ID NO: 45002 - protein, 498 aa, Anabaena variabilis ATCC 29413
MKTPLNCQNYINGQWLNAATETTLNSHNPANKSEIVATFPRSQADDTDRAVTAARQAYGSWRKVPAPARAEYIFRVGELLLQHKEELAQLISREMGKPITEARGDVQEGVDCAFYSAGEGRRLFGQTTPSEMPNKFAMTVRMPIGVCALITPWNFPVAIPCWKAMPALVCGNTVILKPAEDTPACATKLIEIFAAAGLPPGVINLVHGVGEEAGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIVTEGQLKQGYFFQPTILDNVTPQMRVAREEIFGPVVALIEVSTFEEAIAILNDTKYGLSSSVYTRDINRAFVAMRDIEVGITYINGPTIGAEVHLPFGGVKQTGNGHREAGTTALDVFTEWKSVYVDFSGSLQRAQIDNRS

SEQ ID NO: 45003 - protein, 232 aa, Picea sitchensis
MPKRTTHTYSSEDAAPDGPESDLYVYYCKHCGSHVLITDTQLQKMPRRKTDKAYVLDKKQHLARLNIVETGKFLLKRGEGKLEKQFRMACVGCGLFVCYRSEEDLEAAPYIYVADGALSSVAAETNPQDAPVPPCISQLEGGLVQVAIEVEDRAQRSAITRVNADDVRVTVAAPAARGEANNELLEYMGKVLGLRLTQMTLQRGWNNKSKLLVVEDLSARDVYEKLLLAVQP

SEQ ID NO: 45004 - protein, 367 aa, Photobacterium sp. SKA34
MALSSAKEIIDDIRQGKMVILMDDEDRENEGDLIIASEKITPEAINFMATYGRGLICLTLSKARCQKLNLPLMVQENTEQFGTPFTVSIEAAEGVTTGISAADRSRTVQAAVAANATAADIVMPGHIFPLMAQEGGVLTRAGHTEAGCDVARLAGLEPSSVIVEILNEDGTMARRPQLEVFAEKHGLKLGTIADLIEYRNNNETTIERVAECRLPTEFGEFDMITYRDKIDNEVHYALRKGDIKAGEETLVRVHLQDTFKDILQSGATQWTLPAAMKRISEENGVLVILSKQEPTDAMIHKVKNIAAEEAGQPKVKVTQKDPSRQVGVGSQILSDLGVSKMRLLSSSTQRYHSLSGFGLEVVEYICD

SEQ ID NO: 45005 - protein, 298 aa, Triticum urartu
FSLKPLVPRLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 45006 - protein, 156 aa, Photobacterium sp. SKA34
MKVIEGAIAAPNAKVAIVIARFNSFINESLLSGALDALKRQGQVSEDNITVVRCPGAYELPLVAQQVAKSDRYDAIVALGSVIRGGTPHFDYVAGECNKGLAQIALEYNTPVAFGVLTVDSIEQAIERAGTKAGNKGAEAALSALEMVNVLSQIES

SEQ ID NO: 45007 - protein, 298 aa, Aegilops tauschii subsp. tauschii
FSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 45008 - protein, 118 aa, Zea mays
MHAYVLTRSLSAGLPALRARSERVRCSYAKDAKNAAPVSTKGAGASLLAAAGAVTASAGPALALVDERMSTEGTGLSLGLSNNLLGWILLGVFGLIWSLYTIYTSDLDEDEESGGLSL

SEQ ID NO: 45009 - protein, 208 aa, Oryza sativa
  misc_feature (79)..(79): Xaa can be any naturally occurring amino acid
GIRHEGKIDTEITDILIEWGMPATVRAIHPIYFAKCLTKAVHDKHREKMDSPSNGVSIVGYLRPAFIEEESYLRSLFHXNQIDECKREPAPASGTNGLIDDDKSRFDFTNVGSSTDSTIYKLEIMTVELFSIYGKQLMIDPQDFQDAEPDILANSASEIINRIKENDDQCAMALRSLCHRKKGLTVEEASLISRTVRGTVLNVQQRRR

SEQ ID NO: 45010 - protein, 115 aa, Wolbachia endosymbiont of Drosophila ananassae
MIRKEVKPWGFCSIILMSENFLIKYLFINPLSCTSKQFHHYRDEYHIVLSGVGYVSLEDKEYAIAKDHMIEIPREVSHRIENRSISSPLEIVEFQIGEHLSDNDIVRLDDVYGRF

SEQ ID NO: 45011 - protein, 438 aa, Mycobacterium avium 104
MSEVATAPLAAVHLPPAVRGPKLLQGIGFAVSRRTMMRRLSRRYGNVFTLRLPMWGPVVMVSDPQLAKQIFTTSPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRQYDGVIERLIAAEQADPNFAERTDVLALLLRSTYDDGAAMSHKEIGDELLTLLAAGHETTASTLAWAFERISRHPELLARLVEEADNGGNELRQAAILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 45012 - protein, 284 aa, Zea mays
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCTAGGAYIPAMADESVIVKGNGTIFLAGPPLVKVRIFWNHFVYFLNDKILVSKSLIY

SEQ ID NO: 45013 - protein, 621 aa, Photobacterium sp. SKA34
MTLDISKYPHLALANTPDELRLLPAESLPQVCDELRTYLLKSVSQTSGHFASGLGTVELTVALHYVYNTPFDKVIWDVGHQAYPHKILTGRRDDMATIRQKGGLHPFPWRGESEYDTLSVGHSSTSISAGLGIAIAAEKEGLNRKVVSIIGDGAITAGMAFEAMNHAGDVHSDMLVILNDNEMSISENVGALNNHLAHLLSGNFYTSIREGGKKVLSNAPPIKEMVKRAEEHIKGMVVPSTMFEELGFNYIGPVDGHDVHELVKTLKNMRNLKGPQFLHIMTKKGKGYAPAEADPINYHAVPKFDLSQKPLPKAKDASPTFSKIFGDWLCDMAAVDDKLMAITPAMREGSGMVRFSKEFPEQYFDVAIAEQHAVTLATGMAIGGYHPIVAIYSTFLQRGYDQLIHDVAIMDLPVMFAIDRAGLVGADGQTHQGAFDISFMRCIPNMVIMAPSDENECRQMLYTGHRYQGPSAVRYPRGCGMEVDVDPTMTELEIGKGIIRRQGEKIAILNFGSMLSYGLEAAENLNATVADMRFVKPLDEALVLELAKTHDVLVTVEENAIAGGAGSGVIEFLMKEKTLKPVLNIGLPDRFIEQGTQAELHEMLEIDGAGIEKQIRTYLAK

SEQ ID NO: 45014 - protein, 436 aa, Brucella melitensis 16M
MNRTGREFPASSFPAGKAEGTIMDQKNPLTMAYDVEAIRRDFPILSRQVHGKTLVYLDNGASAQKPQSVIDAVTHAYANEYANVHRGLHFLSNAATDAYEKSRETVRRFLNAGSVDEIVFTKNATEAINTVAYGYGMPFIGEGDEILLSIMEHHSNIVPWHFIRERQGAKLVFTPVDDNGVFHIEEFEKRLSERTKLVAITHMSNTLGTVVPIKKIVELAHARGVPVLVDGSQGAVHLPVDVQDLGCDWYVFTGHKVYGPSGIGVLYGRAQMLEKMRPFQGGGEMIEEVTEENVTYNHPPHRFEAGTPPIVQAIGLGAALEYMEKIGRHAILAHEADLRDYAHERLGRINSLRIFGNAPDKGAIISFALEGIHAHDVSMVIDRAGVAVRAGTHCAQPLLKRFGVTSTCRASFALYNTRAEVDALAEALEKARKFFG

SEQ ID NO: 45015 - protein, 181 aa, Triticum aestivum
MDSSNGKRKHRGYLTWTDKMDWALLDVLVEHHNNGNHTANGWKPHAYSAAVKNVREKCNVEITRDHVLSRCKTFDKHCSTISKLLDRSEFGWDRNKSMIVIHNEDAWKVYIQKNKAAACYRNKVIKNWDAISLIFSRDYATSEDESAGAENAQEMALKGAEDVRELIQIHLQHLNLAVKTR

SEQ ID NO: 45016 - protein, 311 aa, Vitis vinifera
MLSDSTEYHDEEDGIAMERQNFLSSKCTFNHDSLSIAGWTEQNLCMKCTKDGQLLVCSSSGCPLVVHENCLGCPPSFDNMGNFYCPFCAYSRAVSEYLESKKKVSLAKKELASFINAGMKHEPVKPKKKHRKKNEKLNESANLVKVCENGHVKEKRQTRANHGDAQVTDQLIRRNVEKHDGVEEQGVANLGVQQEALQQQISDPLEDPASGTSGDENDKPSSSTYYIRFRRQQQQYTFPPIHQLRRKKLAWTAKEEEILKVGVQKFSNDHDKSIPWKKIMEFGGTVFQRGRTTIDLKDKWRNICKGSPKSK

SEQ ID NO: 45017 - protein, 125 aa, Zea mays
MAEVKDHLEIKFRLNDGSDIGPKSFPDATTVAALKETVVSQWPREKENGPKTVKDVRLISAGRILENNKTVGDCRSPVSNLSDAVTTMHVLIQPQVTDKEKKTKKKPKGDLKQNNCVCLCFGRRL

SEQ ID NO: 45018 - protein, 377 aa, Coprinopsis cinerea okayama7#130
MSASAGPSTPSKKRSKWEDGDDDELDHGQPQIHPQKRRVKAKSSSTPAQDSGRGTTTAADHGHSLSKRSRSVYVPERTRHPAIQSSRSVSCYERLNQIEEGSYGVVFRARDRQTGDIVALKKLKLDEEKNGFPITALREIYALMTCQHENVVRIREVVVGDTLTQDLKTSNLLMNNRGTIKVADFGLARRYGDPVGLGGLTQLVVTLWYRAPEILLGATEYSTAVDMWSVGCIFAELLLKEPLFQAKGELELISMIFKLLGPPTKNSWPEYFDLPMAKTIALPSPQPHQFRSKFPYLTTNGLDLLMCLLTYDPERRITAEEALQHPYFTESPLPKHPDLFGSFPSVAAGEKRRVVPDSPSAPARAANYKMITEFDIP

SEQ ID NO: 45019 - protein, 434 aa, Yersinia pestis KIM
MTRILQSINKIALKERLMESKVVVPAEGKKITVDAQGKLVVPHNPIIPFIEGDGIGVDVTPAMINVVDAAVKKAYNGERKISWMEIYTGEKSTHVYGKDVWLPEETLDLIRDYRVAIKGPLTTPVGGGIRSLNVALRQQLDLYVCLRPVRYYEGTPSPVKHPELTNMVIFRENAEDIYAGIEWKAGSPEAEKVIKFLREEMGVKKIRFPEQCGIGVKPCSEEGTKRLVRAAIEYAITNDRESVTLVHKGNIMKFTEGAFKDWGYQLAREEFGGELIDGGPWVKIKNPNNGKEIIVKDVIADAFLQQILLRPAEYDVIACMNLNGDYISDALAAQVGGIGIAPGANIGDDCALFEATHGTAPKYAGQDKVNPGSIILSAEMMLRHMGWFEAADLIIKGTEGAIQAKTVTYDFERLMEGAKLLKCSEFGDAIIKHM

SEQ ID NO: 45020 - protein, 203 aa, Candida albicans SC5314
MSNSNVDDDLVPEKVEGYTVGEKKTIDEYKNLDAEDESLAKWKASLGLTADTKPYPVKPGDKRKVVVTELALEFPEQPDLQPIRINLEDSDGNTIVDKEIKFNIKEKSIYQLVVKFRVQHEIITGLKYLHSVKRGGIRVEKVEEPLGSYAPNTIDKPFYERKFAEVEAPSGMIARGTYSAISKFIDDDDNVHLTVPWSFSITK

SEQ ID NO: 45021 - protein, 97 aa, Glycine max
MAITRSTVVLAILCFILIRAELGIYGEDLHMDAAKNIDCGGKCNYRCSKTSRHKMCIRACNSCCKTCSCVPPGTSGNRDMCPCYASLTTHGGKLKCP

SEQ ID NO: 45022 - protein, 637 aa, Musa balbisiana
MSSPPPSPSATPPSTSPPPPSSLSPPPASNSPPPAPNAPPPPTPPSPPPASSPPPTPPPPADVPPPPVVTSPPPPDPPPPSVSPPPPALSPPPASTPPPPPSASPPPAAAPPPPPFATPPPTNSPPPPPSATPPPTISPPPPGSQSPPARAPSNSTGGTPPAPPKPPSPPSPSPSASHRAPADPISPSSNGSGIPTSDVGQKSGQSSGDGGMKAGPAVAVALVTAVVLLGLVGAITWIVRRKRRKPPANYESGFAMSSPYQSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDNQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDRRLEDAYDDTEMFRMIEAAAACTRHSAAMRPRMGKVVRVLDSLSDVDLHNGVKPGQSEVFNVGQTADIRLFQRLAFGSQEFSSEYSQSNWSRQSDL

SEQ ID NO: 45023 - protein, 305 aa, Picrophilus torridus DSM 9790
MLDPEKFIKDSVSFIEKNVKRGILACSGGQDSTLLAVISSMAKTDILTVFIDTGLLRNNDIKRIKEIFSSYNVNGRILDRSSLFISRLRNVTDPEEKRKIIGRTFIEVFEEEAKNYGAESLLQGTIAPDWIESGGGSRDTIKSHHNVGGLPEKMNLRLVEPLRDLYKDEVREVSRYLGLPEVQPFPGPGLAIRIIGEVTEEKLNILRRATDIVEYESSKLNDKPWQYFPVLLPVRTTGIHGDQRTYGLTIAIRFIDTIDGMSGTFSRPDWSVLENISNRITDEIPEINRVVYDITSKPPATIEWE

SEQ ID NO: 45024 - protein, 183 aa, Methanosarcina mazei
MSESSIKIENVVASTKLAEEFDLTVIESEFEGAEYNKQKFPGLVYRVSDPKAAFLVFTSGKVVCTGTKNVADVHTVVGNLAKKLNSIGIKTIEDPQITVQNIVASADLHTILNLNAIAIGLGLENIEYEPEQFPGLVYRIDEPKVVVLIFSSGKLVVAGGKSPEDCERSVEVVRQQLDSMGLL

SEQ ID NO: 45025 - protein, 298 aa, Hordeum vulgare subsp. vulgare
FSLKPLVPRLSELLGLEVVMAPDCIGQEVEKLAAALPDGGVLLLENVRFYKEEEKNEPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADK

SEQ ID NO: 45026 - protein, 300 aa, Photobacterium sp. SKA34
MTNSSSLSLSLKCYQQRSNDVLAYWLSTQPFADKALLKAMQYGTLLGGKRARPFLTYVTGEMLGLTQDDLDTPAAAVECIHAYSLIHDDLPAMDDDAFRRGQPTCHIAFDEAMAILAGDALQTLAFDILASGQLSQDGNTQRIAMVSELAKASGAAGMCLGQALDLDAEGKHVGLEQLELIHRHKTGALIRCAVRLGALAAGDKGVAILPQLDKYSEAIGLAFQVQDDILDVISDTETLGKPQGSDLALDKSTYPALLGLDGAQEKAQQLYQEALQALAAIPYNTSQLEVFARYIIERNN

SEQ ID NO: 45027 - protein, 299 aa, Zea mays
YSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADK

SEQ ID NO: 45028 - protein, 183 aa, Escherichia coli K12
MTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 45029 - protein, 643 aa, Escherichia coli K12
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEANGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEPEVPRQSFAPVAPTAVMTPTQVPPQPQSAPQQAPTVPLPETTSQVLAARQQLQRVQGATKAKKSEPAAATRARPVNNAALERLASVTDRVQARPVPSALEKAPAKKEAYRWKATTPVMQQKEVVATPKALKKALEHEKTPELAAKLAAEAIERDPWAAQVSQLSLPKLVEQVALNAWKEESDNAVCLHLRSSQRHLNNRGAQQKLAEALSMLKGSTVELTIVEDDNPAVRTPLEWRQAIYEEKLAQARESIIADNNIQTLRRFFDAELDEESIRPI

SEQ ID NO: 45030 - protein, 536 aa, Magnaporthe grisea 70-15
MSAIRMHRNACSASRLVARTSAPRRTVPFLSPSYARLASTQVPKLKDPSLFKQNVCYVNGAFVPAKSGATFAVADPTTGEHIGDAPEFDAADTEAAIAAAENAFKTYRLTTGRERSKLLRRWYDLMIANADDIATLITWENGKTIADAKGEVTYAANFFEWFSEEAPRVYGDTIQPTLAANRVVTRKEPVGVCSLITPWNFPAAMGTRKIGPALAAGCTVVCKAPAETPFTSLALAELAHRAGVPAGVVNFVTSHSNTKTVGEVLCTHQAVRKISFTGSTGVGKTLMQQAAGTLKKCSFELGGNAPFIVFDDADLDAAVDGAIACKFRSSGQTCVCANRIYVQRGIYDAFAERLAKRVKETFKIGSGFDPETTHGPLIHDRAVSKVASQVEDAVGKGAKLLAGGKRLPDLGPHFFAPTVLGDMTPEMSIAREETFGPIAGLFKFDTEAEVVKMANDTEVGLAGYFFSKDIHRAYRVAEALEVGMVGVNTGIISDVASPFGGVKESGFGREGSMYGIHEYQVTKTITFGGMGKELQG

SEQ ID NO: 45031 - protein, 354 aa, Solibacter usitatus Ellin6076
MKTFTIGVIAGDGVGTEVTPQAKRVLEKSAHKHQVTFSFQDFEWGAEHFFRWGRMMPAGAIDLLQPCDAILLGAVGHPEIPDHTTLNGLLLPIRRAFDQYANVRPAYLYPGVQSPLARPKGGDIDFVVVRENTEGEYAQVGGFVYHLQPEEIAIQTSVFTRRGIDRIVRFAFELAVKRNKKRRVTSITKSNAQGYSMVLWDRAFQEIAAQFPEVETESLLVDAAAMNFIRRPESFDVVVGSNLFADILSDISAIIVGSMGLAASANLDPLRRFPSMFEPVHGSAPDIAGKGIVNPLATILSAGMMLDHLGMTEAAKELDAAVAAILADGKVSTPDIGGKSSTEEVTDAVLEKLG

SEQ ID NO: 45032 - protein, 194 aa, Pyrus pyrifolia
MGQQSLIYSFVARGTVILAEYTEFTGNFTSIASQCLQKLPATNNKFTYNCDGHTFNYLVDNGFTYCVVAVEAVGRQVPIAFLERIKEDFTGRYGGGKAATAVANSLNKEFGSKLKEHMQYCVDHPEEISKLSKVKAQVSEVKGVMMENIEKVLDRGEKIELLVDKTENLRSQAQDFRQQGTQMRRKMWLQNMKL

SEQ ID NO: 45033 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKINPETTLFLVASKTFTTQETMRNAQSARDWLLKAAKNESAVAKHFAALSTNAKDVEKFGIDTN

SEQ ID NO: 45034 - protein, 774 aa, Vitis vinifera
MTVTPKISINEGNLVVQGKTILTGVPDNIVLTPGSGGGLVAGTFIGATASHSKSLHVFPMGTLDGLRFMCCFRFKLWWMTQRMGTCGKDVPFETQFMLIESKETTEGGEHDDAPTIYTVFLPLLEGQFRAVLQGNDKNEIEICLESGDTAVETNQGLHLVYMHSGTNPFEVIDQAVKAVEKHMQTFLHREKKKLPSFLDWFGWCTWDAFYTDVTAEGIEEGLQSLSKGGAPPKFLIIDDGWQQIGNENKDNNCVVQEGAQFANRLTGIKENEKFQKNGRNNEQVPGLKHVVEDAKQRHNVKFVYVWHALAGYWGGVKPAAAGMEHYECALAYPVQSPGVMGNQPDIVMDSLSVHGLGLVPPRTVFNFYNELHAYLASCGVDGVKVDVQNIIETLGAGHGGRVALTRSYQQALEASIARNFTDNGCISCMCHNTDGLYSTKQTAVVRASDDFYPRDPASHTIHISSVAYNTLFLGEFMQPDWDMFHSLHPAAEYHGAARAVGGCAIYVSDKPGHHNFELLRKLVLPDGSVLRAQLPGRPTRDCLFADPARDGTSLLKIWNVNKCSGVVGVFNCQGAGWCKIEKKTRVHDTSPDTLTGSVCAADVDQIAHVAGTNWKGDVVVYAYKSGEVVRLPEGASLPVTLKVLEFEVFHFCPLKEIATNISFAPIGLLDMLNSGGAVEQFEVHMASEKPELFDGEIPFELSTSLSENRSPTATIALTARGCGRFGAYSSQRPLKCQVGDAEVEFSYDPNNGLLTFTIPIPEEEMYRWSIAIQV

SEQ ID NO: 45035 - protein, 882 aa, Arabidopsis thaliana
MERSLELLLLLIRTLAIIHISQAQSQQGFISLDCGLPANEPSPYTEPRTGLQFSSDAAFIQSGKIGRIQANLEADFLKPSTTMRYFPDGKRNCYNLNVEKGRNHLIRARFVYGNYDGRDTGPKFDLYLGPNPWATIDLAKQVNGTRPEIMHIPTSNKLQVCLVKTGETTPLISVLEVRPMGSGTYLTKSGSLKLYYREYFSKSDSSLRYPDDIYDRQWTSFFDTEWTQINTTSDVGNSNDYKPPKVALTTAAIPTNASAPLTNEWSSVNPDEQYYVYAHFSEIQELQANETREFNMLLNGKLFFGPVVPPKLAISTILSVSPNTCEGGECNLQLIRTNRSTLPPLLNAYEVYKVIQFPQLETNETDVSAVKNIQATYELSRINWQSDPCVPQQFMWDGLNCSITDITTPPRITTLNLSSSGLTGTITAAIQNLTTLEKLDLSNNNLTGEVPEFLSNMKSLLVINLSGNDLNGTIPQSLQRKGLELLYQGNPRLISPGSTETKSGKSFPVTIVASVGSAAILIVVLVLVLFLRKKKPSAVEVVLPRPSRPTMNVPYANSPEPSIEMKKRKFTYSEVTKMTNNFGRVVGEGGFGVVCHGTVNGSEQVAVKLLSQSSTQGYKEFKAEVDLLLRVHHTNLVSLVGYCDEGDHLALIYEFVPNGDLRQHLSGKGGKPIVNWGTRLRIAAEAALGLEYLHIGCTPPMVHRDVKTTNILLDEHYKAKLADFGLSRSFPVGGESHVSTVIAGTPGYLDPDRLSEKSDVYSFGIVLLEMITNQAVIDRNRRKSHITQWVGSELNGGDIAKIMDLKLNGDYDSRSAWRALELAMSCADPTSARRPTMSHVVIELKECLVSENSRRNMSRGMDTLSSPEVSMIFDAEMIPRAR

SEQ ID NO: 45036 - protein, 360 aa, Oryza sativa
  misc_feature (305)..(305): Xaa can be any naturally occurring amino acid
LRYVSSKTRNQRLRKNRSSHLSEHAASSSNAKVMAINDPFMDLDYLIYLLKYDSVHGRFQGDIKKVEGGIEVNGHKVRVFQEKDASKIPWGTAGADYIGECSGAFTSQEKAALHLQGGAKKAIISAPPKDAVPIYVMGVNHDKYQPDQTVVSNASCTTNCLAPVAKVINDNFGIEEGLMTTVHAVTINQLTVDGPSKGGKDWRAGRAAGANIIPSTTGAAKAVGKVIKELNGKLTGMAFRVPTTDVSVVDLTVRLQKDASYADICKKIREASEGPLNGILGYTEDEVVSSDFVHSPLSSIFDAKXAGIALSPRIVKGGFRLRQRSGASPTDGSTSPETMGQGGRKPSKGSKKLKLRPFVY

SEQ ID NO: 45037 - protein, 480 aa, Coprinopsis cinerea okayama7#130
MSNADIVISPSVESIVNSFATVALDMKDATITSTRQSRNALVYPKKRPSPHGITKSHKSPLLPANGVSRVSPRAAKAAFVQQQRQKAAQLLALRRDGAYLEEEYREEIRRYMHDMERNTMSSTQSMDQQPEIRWHMRPCLVDFLVEIHFTFRLRPETLYLTLNIIDRYVSRRVVYIKHYQLVGCAALWIAAKFEDAKERVPTVQDLCHICRDTYEESAFIQMEGHVLSTIQWTLGHPTAEAWLRLFCTGPVPEDNKVQHVARFLMEITLFYREFVKFSPSTIAMASLTLARYICGKQRRFWEETDECLEVVNILDTRLATNVNDLSETLIKKYSYAFYSKAATLVVQYYLEGGRFYQESFPSLPSFPSLPATPKRTTTSGVSTPMSTSSTSTTSSDLSDDMPVTPTTPSSPPLFETAEPFISSYSSDDKENMPSTTVEPIINKPLPDAVPENLLPHGYVTYSRAALHNLNVCSPRTAIVT

SEQ ID NO: 45038 - protein, 300 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLSLDRRTNALKLADFGLARAFGIPVRTFTHEVVTLWYRAPEILLGARQYSTPVDVWSAGCIFAEMVTQKPLFPGDSEIDELFKIFRILGPPNDQSWPGVSCLPDFKTAFPRWQAQDLAPVVPNFAPAGWALLFKMFRSEPSKRIPARQALEHEYFKALEVVQCPAKCV

SEQ ID NO: 45039 - protein, 259 aa, Oryza sativa Japonica Group
MWQPSHKLEVGPYCKITIHESAMAGRGGGGELRLLGTWSSPWVIRVRVALGMKGLSYEYTEEDLSSKSDHLLRSNPVHEKVPVLIHGGRPVCESLVVLEYIDETWGATGTPQLLPADPYDRATARFWTNYVNDTFFPSWKVLFRSTAAEQRAEAFKNVVPRVEALERAFGECSKGKAFFGGDDAGLVDVALGSHLVWIKVVDEVAGANLLDEAKFPGLAAWAERFLAVDAVRQVMPDAGDVLKQYKGFLAKWTAGAGSS

SEQ ID NO: 45040 - protein, 665 aa, Anabaena variabilis ATCC 29413
MTSLFINNAPTFSGNSRSTLKKRTLLFRYLAEINLIFGLWYLQWRITNSINFDALWLSIPLLLAEIYSYIGGVMFVIGLWRPLVRQIKSLDQLTPPLPPTDWPIVDVFITCYNEPPEMVEQTAQAALAIDYPPTKLYVYVLDDGNSPTMRAMTERLCIADLQSPLLQQEANRIDAERSHLVERLQNLESFTPNIQVAEEWLSKSSSVPSQDTTKTEVLAQSLQQFIRWLSPKHHSVTERLKTERQALAAAIRQKELELVELARLRYIARPKPVGVPHHAKAGNLNYAIFSGETSGELILTLDADHIPKPQFLKRVLPYFYTYNLFNGKYEQNRIAFVQTPQDFYNIPPSDPFGHRASLFYGPLQQGKDGMNAAFYTGTNAILRREALINVGLQYFADDFTKDEKRLDEFQLVGGLSSNSITEDMNTAMRLHGAGWKSVYHHELLAEGLAPDDLSSTLKQRLRWAQGTIQVLVRENPLSKPGLTFWQRLQYFKTMYSYFSGFATLIFISCPIIYFFTEISPVKTYGIDFIVHFLPTFIINRLTFIVAIWGIPASEIWRSEQYAIALFPVFIQAVWSVFTGQKINFQVTPKQRQSGIYLQMIWPQLMFLLLTIIGIVWSLYNFVIGHLNHPWVNLLNSSWAIYNLLLLSGIIRASVWQMPKDHSNKI

SEQ ID NO: 45041 - protein, 868 aa, Oryza sativa Japonica Group
MMVTWPWRALPLAAVLFLFLSPAASVDTVTMEAPLAGNRTIVSAGGTFTLGFFTPDVAPAGRRYLGIWYSNILARTVVWVANRQSPVVGGSPTLKINGNGSLAIVDGQGRVVWASPVMSASVLSAGSAKAQLLDNGNFVLRFASAGVAWQSFDYPTDTLLPGMKLGIDFRTGLDRYMNSWRAADDPSPGEYSFRIDPSGSPEFFLYRWSTRTYGSGPWNGYQFSGVPNLRTNTLLSYQYVSTADEAYYRYEVDDSTTILTRFVMNSSGQIQRLMWIDTTRSWSVFSSYPMDECEAYRACGAYGVCNVEQSPMCGCAEGFEPRYPKAWALRDGSGGCIRRTALNCTGGDGFAVTRNMKLPESANATVDMALGLEECRLSCLSNCACRAYASANVTSADAKGCFMWTADLLDMRQFDNGGQDLFVRLAASDLPTNSVSDNSQTAKLVEIIVPSVVALLLLLAGLVICVIKAKKNRKAIPSALNNGQVTPFGQRNHTASALNNWEITPFWQRNHVAASNDAQDNNSMRPAGQGNHQDLDLPSFVIETILYATNNFSADNKLGQGGFGPVYMGRLDNGQDIAVKRLSRRSTQGLREFKNEVKLIAKLQHRNLVRLLGCCIDGSERMLIYEYMHNRSLNTFLFNEEKQSILNWSKRFNIINGIARGILYLHQDSALRIIHRDLKASNILLDRDMNPKISDFGVARIFGTDQTSAYTKKVVGTYGYMSPEYAMDGVFSMKSDVFSFGVLVLEIVSGKKNRGFYHNELDLNLLRYAWRLWKEGRSLEFLDQSIAGTSSNVTEVLRCIQIGLLCVQEQPRHRPTMSAVTMMLSSESPALLEPCEPAFCTGRSLSDDTEASRSNSARSWTVTVVEGR

SEQ ID NO: 45042 - protein, 648 aa, Glycine max
TLIARSLLGQNKFDRCFTRPSTFLIQTHIFVVISFSAFPNSSQRFTKPFQRLCFSMATSPKDTSSPGSPSVPSSPSSTKAPSNQEQPEFHIQPIQMIPGQAPVPEKLVPKRQQGVKISENPSIATSPREVDTEMDKKIRSIVSSILKNASVPDADKDVPTSSTPNAEVLSSSSKEESTEEEEQATEETPAPRAPEPAPGDLIDLEEVESDEEPIANKLAPGIAERLQSRKGKTPITRSGRIKTMAQKKSTPITPTTSRWSKVAIPSKKRKEFSSSDSDDDVELDVPDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSAGKLSVKYAILHRIGAANWVPTNHTSTVATGLGKFLYAVGTKSKFNFGKYIFDQTVKHSESFAVKLPIAFPTVLCGIMLSQHPNILNNIDSVMKRESALSLHYKLFEGTHVPDIVSTSGKAAASGAVSKDALIAELKDTCKVLEATIKATTEKKMELERLIKRLSDSGIDDGEAAEEEEEAAEEEKDAAEDTESDDDDSDATP

SEQ ID NO: 45043 - protein, 111 aa, Triticum aestivum
  misc_feature (44)..(44): Xaa can be any naturally occurring amino acid
  misc_feature (56)..(56): Xaa can be any naturally occurring amino acid
LTFLRWSETAEAAMAGAKAAAVATVAAAVPTVSSQLAIQFQSSXTHLMNQRVTCTXFQLASVRMLPWARAHLNPSGQALIISTVAGMAYFIVADKTILSMARRHSFDVDAA

SEQ ID NO: 45044 - protein, 307 aa, Vibrio vulnificus CMCP6
MSPFLSFSRATWSELRNSVPMTLSEEDLKALQGINENLTMQEAVEVYLPLSRLLNLYVQARQSRNSVLHQFLNNDEHAPPFVIGIAGSVAVGKSTTARVLCALLSRWENHPKVELVTTDGFLYPKKELDQRGIMHKKGFPESYDMKKLVQFVSDVKAGKPELEVPVYSHITYDITEEVKKVDRPDVLIIEGLNVLQSGMDYPHDPHRVFVSDFLDFSIYVDAESNTIEQWYVERFLKFRKGAFTQPGSYFSHYTQLSEQQAIEKAQQIWRDINGINLTENILPTKERAQLILRKGPNHLVEEILLRK

SEQ ID NO: 45045 - protein, 286 aa, Vitis vinifera
MEGKEEDVRLGANKFTERQPIGTSAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGASVVKGFQGHQYEVLGGGANVVAAGYSKGDGLGAEIVGTFVLVYTVFSATDAKRNARDSHVPILAPLPIGFAVFLVHLATIPITGTGINPARSLGAAIIYNREHAWDDMWIFWVGPFIGAALAALYHQIVIRAIPFKTRA

SEQ ID NO: 45046 - protein, 322 aa, Oryza sativa Japonica Group
MASTDADADAVAVELLPFIRVYVSGRVERLLGTDTVAASLDEPTGVASKDVTVDPATNLSVRLYLPPAVAAGKRLPILVYFHGGGFMVESATSPTYHRYLNALASRARVVAVSVEYRLAPEHPLPAAYDDSWAALAWAVATAAAPGAVDPEPWLAAHGDASRVFIAGDSAGANIAHNVAMRAAAAPLPGGAGITGVLLMHPYFWDASNTMGPALEDRIRREWRFMCGSPDVRVDDPRLSPTVQQGAPSLAALPCRRVMVAVAGDDFLAGKGRAYHAALVASRWHGEAELVDTPGEDHLFHLTRPGTAAAAKMMDLVVDFVTR

SEQ ID NO: 45047 - protein, 336 aa, Oryza sativa Japonica Group
MPLAEGEFALPDEVLAVMPRDPYEQLDLARRITALAVAGRVTGLEREAARLRESAADKDRENGELRERVALLDRALQETNSRLRAALEDNIKLSKERDSLAQTSKKLARDLQKLESFKRHLMQSLRDDSPSPQETVDITTCDQSISSKASSCGDGDSITHTTTNLLSTSLDVGSTVQEVSKPPIQKYALSSHITPRLTPEATPKIMSTSASPRRMSTTATPKLMSGTTSPSKTRIEGYMSMTPWYPSSKQSSAANSPPRGRPNPGRTPRIDGKEFFRQARSRLSYEQFGAFLANIKELNAHKQSREDTLKKAEEIFGPDNKDLYLSFQGLLNRSLP

SEQ ID NO: 45048 - protein, 495 aa, Camellia sinensis
MALLLLLLIAVSTVFADDDAYIGVNIGTDLADMPHPTQVVALLKAQQIRHVRLYNADRGMLLALANTDIKVAISVPNEQLLGIGQSNSTAANWVSQNVVAHYPATNITTICVGSEVLTTLPNAAHVLVSALKYIQSALVASNLDRQIKVSTPLSSSIILDSFPPSQAFFNRSLNPVMVPLLSFLQSSGSSLMLNIYPYYDYMQSNGVIPLDYALFRPLPSNKEAVDANTLLHYSNVFDAMVDAAYFAMAYLNFTNIPVMVTESGWPSKGDSSEPDANLDNANTYNSNLIKHVLNKTGTPKHPGISVSTYIYELYNEDMKPGPLSEKNWGLFDANGVPIYILHLTGSGSVLANDTANQTYCTAKDGADAKMLQAALDWACGPGKVNCSALLQGQPCYEPDTVAAHATYAFDTYYQQMGKASGTCDFNGVATITTTNPTHGSCVFPGSNGKNGTFLNSTAPSLNSTSSGCPARYMRGSASASAIVAVGILSWSLVFL

SEQ ID NO: 45049 - protein, 401 aa, Oryza sativa Japonica Group
MASKRSVGTLTESDLKGKKVFLRADLNVPLDDSQKITDDTRIRASVPTIKFLMGKGAKVILASHLGRPKGVTPKYSLKPLVPRLSELLGVDVVMANDCIGEEVQKLAATLPDGGVLLLENVRFYKEEEKNDPEFANKLASVADLYVNDAFGTAHRAHASTEGVTKYLRPSVAGFLMQKELDYLVGAVANPKKPFAAIVGGSKVSTKIGVIESLLAKVDILILGGGMIYTFYKAQGYAVGKSLVEEDKLELATSLIEKAKSKGVSLLLPTDIVVADKFAADAESKTVPASAIPDGWMGLDIGPDSIKTFSETLDTTKTVIWNGPMGVFEFEKFAAGTDAIAKKLADITAKGVTTIIGGGDSVAAVEKAGLADKMSHISTGGGASLELLEGKTLPGVLALNDA

SEQ ID NO: 45050 - protein, 310 aa, Escherichia coli K12
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENVEQRWQRILHIQQQLAGEQVALSDEVNQSEQTTNFHNRAIAWLLYSAGYLYCDAMEACDVYTRQCSTLLNTIELATLGATLAAGGVNPLTHKRVLQADNVPYILAEMMMEGLYGRSGDWAYRVGLPGKSGVGGGILAVVPGVMGIAAFSPPLDEDGNSVRGQKMVASVAKQLGYNVFKG

SEQ ID NO: 45051 - protein, 356 aa, Brucella melitensis 16M
MQHLCCFPNLAIIRRVAKLCARKFLEAKLTTLSNRSAVEPFHAMDVLAEANRRRAAGHPIISMAVGQPADSTPVVVRQAAERALKDGRIGYTDALGLIELCEAIAAHYADHYGVSVSPERIAVTTGSSAAFNLAFIVYFDPGDRVAITRPGYPAYRNILTALDLEVVEIPTGHGTSSSLTAQALAAAHAEKPLKGVLFASPANPTGAVIDKPELTAIIETARNLGIRVISDEIYHRLSYEADDVTALEVADDVTIINSFSKYYCMTGWRIGWMVLPDNDIRAIERLSQSLYISAPELSQRGAIEAFRATAELERIKDRYRRNRLILLNHLPRMGLDLAAPMDGAFLRLLRCVAFHQ

SEQ ID NO: 45052 - protein, 422 aa, Synechococcus elongatus PCC 7942
MSPETVLAAVDAAIASPFSTDAFDACVMQTYGRFPLALERGEGCRVWDTQGRSYLDFVAGIATCTLGHAHPELVDAISDQIRKLHHVSNLYYIPEQGQLAAWLTANSCADRVFFCNSGAEANEAAIKLARKHGNTVLEAENPIILTAQASFHGRTLAAVTATGQPKYHKGFQPLVQGFRYVPYNDLAALEATLAELDAAGETVAAILLEPLQGEGGVNPGDRAYFQAVRQLCDQRRMLLILDEVQVGMGRSGQLWGYENLGIEPDAFTVAKGLGGGVPIGALLVKASCNILQAGEHASTFGGNPLACRAGLAIAQVMERDQLLANVQARGEQLRAGLQELVDRYPNLLAGVRGWGLINGLVLRNDPNVTPIALVKAAIEQGLLLVPAGAEVVRFVPPLIVSAAEIDEALAMTERALLAIAGE

SEQ ID NO: 45053 - protein, 469 aa, Mycobacterium avium 104
MADDDSHPSDLLVIFGITGDLARKMTFRALYRLERREELEHPIIGVASDDITLDQLLDRAREAIKATGETFDDAVFDRLAGRLSYLSGDVTDTGLYSELAEKIGGDSRPLYYLEMPPSLFAPIVENLAKADLLERARVAVEKPFGHDLESARDLNARLRAVLDEDQILRVDHFLGKQPVEELQYLRFANNALAKLWDRDSISEIHITMAEDFGIEDRGKFYDAVGAVRDVVQNHLLQVLALVAMEPPVGAGADDLNDKKAEVFRAMPSLDPEHCVRGQYRGYTEVPGVAKDSTTETYVALRTEIDNWRWAGVPIFLRAGKALPHKVTEVRMFLHHVPGFSFLPNRRPPEPNQIVLRIDPDPGMRLQLSAQVGDSWHDVHLDSSFAVDLGEPVRPYERLLYAAFNGDRQLFAREDAIEETWRIVQPVLDKPSRIHQYEQGSWGPEAAQALVHGRHAWQQPWLPQSTSTKR

SEQ ID NO: 45054 - protein, 307 aa, Vitis vinifera
MLYIIHNHQRPRVSISLRLHTPLFLNSYLSIPAIMAERGGGGERGGFGRGFGRGGRGDRGRGGRRRSAGRREEEEKWVPVTKLGRLVKDGKIRTVEEIYLHSLPIKEHQIIDTLVGPSLKDEVMKIMPVQKQTRAGQRTRFKAFVVVGDGNGHVGLGVKCSKEVATAIRGAIILAKLSVIPVRRGYWGNKIGKPHTVPCKVTGKCGSVTVRMVPAPRGAGIVAARVPKKVLQFAGIEDVFTSSRGSTKTLGNFVKATFDCLLKTYAYLTPDFWRETRYTKSPFQEHTDLLAKPTKAIYQDDVERVEA

SEQ ID NO: 45055 - protein, 1217 aa, Vitis vinifera
MNSLNKINLKSGNRSSSKSNLNNLRNFIGGSILKPSTPRLCIIGSSSTAHTASIYASQAQLRPIFLEGWMANDIALGGQLTTTSDVENFPDFPDGNNDNEIMDRCRAQSLRFGIEIFTKTVTRVDFSSTPFKVFVNSKTVLVDAVIVAIDTPKPSKHTGDQVCQICNDNVGTTVDGEPFIACSVCAFPVCRPCYEYERKDGNQSCPQCKTKYKRHKGFPPIHGEDVEDGDMDDVAKDFKYSSRDQGEKQKIAERSLSWHMSHGQGEDVVPPNYDKEVSLNHIPLLTNGPSVSGELSAASPERLSMTSPEAGLGVKRVCPLPYAAANIRVGDPGREFGSAGFGKVAWKERVDGWKMKQEKNGAPMSVKNNSSLNSLISEHKTSTGRIRNDEARQPLSRKVSIPSSRINPYRMVIVLRLIILCIFLHYRITNPVPNAFALWLISVICEIWFAISWILDQFPKWLPVNRETYLDRLALRYDREGEPSQLAAVDIFVSTVDPLKEPPLVTANTVLSILAVDYPVDKVSCYVSDDGSAMLTFEALSETSEFARKWVPFSKKYNIEPRAPEWYFAQKIDYLKDKVQPSFVKDRRAMKREYEEFKIRVNALVAKAQKVPDEGWIMQDGTPWPGNNTRDHPGMIQVFLGHSGGLDTEGNELPRLVYVSREKRPGFQHHKKAGAMNALVRVSAVLTNGPYLLNLDCDHYINNSKALREAMCFLMDPNLGKSVCYVQFPQRFDGIDKSDRYANRNTVFFDINLRGLDGIQGPVYVGTGCVFNRPALYGYEPPVKPKHKKPGLFSSCFGGSQKKSSGSSKKDSSKKKSGKQLDPTVPIFNLEDIEEGLEGAGFDDEKSLLMSQMSLEKRFGQSAVFVASTLMENGGVPQSAAPEILLKEAIHVISCGYEDKTDWGNEIGWIYGSVTEDILTGFKMHARGWRSIYCMPQRPAFKGSAPINLSDRLNQVLRWALGSVEILLSRHCPIWYGYGGRLKWLERFAYVNTTIYPVTAIPLLAYCTLPAVCLLTGKFIIPQISNFASIWFISLFLSIFATGILEMRWSGVGIDEWWRNEQFWVIGGVSAHLFAVCQGLLKVLAGIDTNFTVTSKASDEEGDFAELYMFKWTTLLIPPTTLLIINLVGVVAGISYAINSGYQSWGPLFGKLFFAFWVIIHLYPFLKGLMGRQNRTPTIVVVWSILLASIFSLLWVRIDPFTTRVTGPDVEQCGINC

SEQ ID NO: 45056 - protein, 232 aa, Physcomitrella patens subsp. patens
MSVGLGTGHASGMAIAYIGERLRDGTLRDIICVPMSSASAAAAAQAGVPLTTFEDQPQLDVAFDDADMVQEGTLFAVIGRKGVEGRQSILKEKAIMQAAKQLVFIIDEKQFVGKLEGAVPVLIQQEDWLDVAEEIDDMFLGDAEVWRRPSFGEAGPLGGDNPLITPEGHFLLDVIFTTPITTAADVVENLETVPGVMGHGLVMDVAYAAAVASPTGMKLRTSLFKTAFTAME

SEQ ID NO: 45057 - protein, 148 aa, Solibacter usitatus Ellin6076
MDMKKPSRPIEILLVEDNAADAQLVERAFRFSRTPVRLYVVEDGVQALDYLRRTAGYTDSVRPDLIMLDLNLPGRDGHQVLKELKNDPDLKEVPVVIYSGSAMQRDVKLAYRLGGNCYIRKPVDLEEFFGVVASIERFWLNTALLPSL

SEQ ID NO: 45058 - protein, 373 aa, Staphylococcus epidermidis ATCC 12228
MAKRDYYEVLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGHGDLFVNIKVVTPTKLNDRQKELLKEFAEINGEDINEQSSNFKDRAKRFFKGE

SEQ ID NO: 45059 - protein, 287 aa, Vitis vinifera
MEGKEEDVKLGATKFTERQPLGTAAQSDKDYKDLPPAPLFEPGELKSWSFYRAGIAEFMATFLFLYITILTVMGVKKSPTMCASVGIQGIAWAFGGMIFALVYCTAGISGGHINPAVTFGLLLARKLSLTRAIFYIIMQCLGAICGAGVVKGFEGSQSYEVLGGGANVVNSGYTKGDGLGAEIVGTFVLVYTVFSATDAKRNARDSHVPILAPLPIGFAVFLVHLATIPITGTGINPARSLGAAIIFNREHAWDDMWIFWVGPFIGAALAAMYQQIVIRAIPFKSRA

SEQ ID NO: 45060 - protein, 486 aa, Bacillus cereus G9241
MITTEIKRVKNHINGEWVESTGTEVEAVPNPATGKIIAYVPLSPKEDVEKAVEAAKAAYETWSKVPVPNRSRQLYKYLQLLQENKEELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFHEDNYVGPLIRESHKERVLGYINSGVADGATLLVDGRKIKEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERWF

SEQ ID NO: 45061 - protein, 122 aa, Vibrio vulnificus CMCP6
MSITNEQILDAIAEMSVTQVVELISAMEEKFGVTAAAAVVAGGAAAGAAVEEQTEFNVILASAGANKVAVIKAVRGATGLGLKEAKALVDGAPAALKEGVEKAEAEALKKELEEAGATVEIK

SEQ ID NO: 45062 - protein, 214 aa, Zea mays
MDDQENENEHEKHADAGTDVDEEEEDEDGHKRVVVLGPQVPLKEQLELDKDDESLRRWKEQLLGQVDTEQLGETAEPEVKVLNLTILSPGRPDLVLPIPFEADDKGYAFTLKDGSLYSFRFSFTVSNNIVSGLKYTNTVWKTGVKVENQKMMLGTFSPQQEPYVYEGEEETTPAGIFARGSYSAKLKFFDDDGKCYLETSYYFEIRKEWPGPAT

SEQ ID NO: 45063 - protein, 366 aa, Pseudomonas fluorescens
MGFNCGIVGLPNVGKSTLFNALTKSGIAAENFPFCTIEPNSGIVAMPDPRLQELAAIVNPKRILPTTMEFVDIAGLVAGASKGEGLGNKFLANIRETDAIAHVVRCFEDENVIHVSNSVDPKRDIEIIDLELIFADLDSCEKQLQKVARNAKGGDKDAVVQKGLLEQLIAHFTLGKPARSLMKSMNTDEKAVIKGFHLLTTKPVMYIANVAEDGFENNPLLDVVKAIADEEGAIVVPVCNKIEAEIAELDDGEEKDMFLEALGLTEPGLNRVIRAGYEMLHLQTYFTAGVEEVRAWTVKVGATAPQAAGVIHTDFEKGFIRAEVIAYNDFIQFKGEAGAKEAGKWRLEGKEYIVKDGDVMHFRFNV

SEQ ID NO: 45064 - protein, 430 aa, Escherichia coli K12
MMNTEGNNGNKPLGLWNVVSIGIGAMVGAGIFALLGQAALLMEASTWVAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPQVIMPRAFLVAIGVTTLLYISLALVLLSDVSALELEKYADTAVAQAASPLLGHVGYVIVVIGALLATASAINANLFAVFNIMDNMGSERELPKLMNKSLWRQSTWGNIIVVVLIMLMTAALNLGSLASVASATFLICYLAVFVVAIRLRHDIHASLPILIVGTLVMLLVIVGFIYSLWSQGSRALIWIIGSLLLSLIVAMVMKRNKTV

SEQ ID NO: 45065 - protein, 109 aa, Yarrowia lipolytica CLIB122
MLRNVSRLALRSNFARQATMGQRFYSVARPDAEKRIAAVLESFDKISNPAAITPTASFAKDLNLDSLDTVEVVVAIEEEFGIEIPDKEADEIKSVNQAVEYILAQPDAK

SEQ ID NO: 45066 - protein, 356 aa, Rhodopirellula baltica SH 1
MLHAIIMAGGSGTRFWPASRKAKPKQLLSLAGDRTMIQATRDRLSSVIPAERTHVLTSVALVEPIAEQLPELRRETIVGEPCRRDTAPCVGLAAALVAHEDPDAVMLVCPSDHVILQHDKFAEGVRRGEAILAEHPDAIVTFGIKPSYPAESFGYIQRGDVIEGHEAYKVKTFREKPDSATAKKYLDEGTFSWNSGIFLWKAQTILDALEQHEPEMYSHIQAISDAIGTDDYDEVLQKEFAAIEGKSIDYAVMERHSPVVVIEAPFDWDDVGSWQAVSRLHPADEFGNAVVGSHVSVDSTGCIIHGTPGHTIATIDVHDLIVVQTADATLVAPKTSEERVREVVAALQASGSEDRI

SEQ ID NO: 45067 - protein, 217 aa, Brassica napus
  misc_feature (101)..(101): Xaa can be any naturally occurring amino acid
METVRPVVVAPKGKFRRTFAKVLNIHKLTGVAPEEEMKKTNNVKLSESFYKLEEEYERTLTLEALLAKLFATGWSIKAGYAQLQHSQSPYDAIGIQKADNXCNPLENLHLSALNPTHFVAYLQHTVKSTRGFVRLMIEQMKLAKWDISMAVNSIQPGVFYYKQDHKCFAFEHFVSNVMFEAFHLPYFSTAKKASRRWRNRAKQRRNRAEQRRGKCFF

SEQ ID NO: 45068 - protein, 405 aa, Rhodopirellula baltica SH 1
MLFIGSIPMSYRLDGSSPPMSIFLEPSPFQDSSMKVFVVGGAGYIGSHAVALLLDAGHEVVVFDNLSRGHAKSVPEGLLVEGDLNDQAKLTSLLKEHSIDAVMHFAAFAEVGESVRDPAIYYQNNVVATLSLLEAMRAADVKKIVFSSTTATYGQPDTVPIPETTPQNPINPYGFSKLVIEKALADYAHAYGFAYAALRYFNAAGARPDGTIGEHHDPESHLIPIVLQVALGQRESISIFGDDYPTPDGTCIRDYIHVDDLGDAHLRALDRLKPGEGIQVNLGTGRGTSVREIVDACRAVTGHPIPEVMGERRPGDPAELIADAKLAGEVLGWKPRYTDIQDIVKTAWNWHQTHPQVTTPFERPLSPSNRGQDRVFTATRFRRSTYQSEGRVCPVISSDWLSSSN

SEQ ID NO: 45069 - protein, 329 aa, Silicibacter sp. TM1040
MKIAINGFGRIGRTILRQILTSPRGSGIEVVCINDITDAEMCAYLFQYDSTFGPYPGEVSLEAGTLCVDGRRIALHQEANVTNLDLAGVDVLMECTGIARTTDLAQRGLTAGARKVLISGPSPAAEVTVVYGVNDADLAGAQIVSNASCTTNAVAGLVQLVDAVAGIETGHMTTIHCYTNSQPMVDTPRGDFARSRGGAQSMVPTTTSAMHLIDVVLPRLKGRISGAAVRVPTASVSAVDLVATLQSEWDQSDLLMALKASANGSPILGWTEQPLVSSDLRARPESLIIAAPETRMVGTQQLRIFGWYDNEWGFSARMLDVARAMQPQV

SEQ ID NO: 45070 - protein, 161 aa, Zea mays
  misc_feature (150)..(150): Xaa can be any naturally occurring amino acid
SIIARSSLLATPVLLTATASRSSCSASLALLLCCCTCKSATAHREMSTVSRASLDQKLALAKRCSREATLAGAKAAAVATIASAIPTLASVRMLPWAKANINPTGQALIVSTVAGMAYFIAADKKILSLARRHSFEQAPEHLKNTSFQGXTGRPHPAFFRP

SEQ ID NO: 45071 - protein, 326 aa, Solibacter usitatus Ellin6076
MRPQDFRMPAEWEPHLATWIAWPHNRADWPGRFAPIPWVYGEIVRKLSQVERVRILIQSPALEKQARRILEKVGANLDAVEFFECETDRVWTRDYCPLFVKNRRGETALTAWRFNAWAKYDNWQNDSAVPAHLGKRLKLPVFKPGMVLEGGSIDVNGAGVLLTTEECLLSPIQARNPELSRLEIERRLADYLGVDRVVWLRTGIAGDDTHGHVDDLARFVNPETVVLCAEADPADYATLRVAGLKVVKLPMPRPLVFAGQRLPASYANFYIANALVLVPTFNDPNDRAALTILAKQFPDREVVGINCTELIWGLGALHCMTQQQPA

SEQ ID NO: 45072 - protein, 176 aa, Rickettsia conorii str. Malish 7
MSKVKKNDETLSEVLVDVNRVTKVVKGGRSFAFSAYVVVGDKAGRVGAGHGKAKEVNEARGKAKQAAKKRMMKVPLYQNRTIHHDVVGKSGAAKVILRRAKAGTGIIAGGSMRAIFDSLGVHDIVAKSIGSTNVYAMISATFDALNKLASPKSIAMRRDKKVNEISVKSAEIQVNE

SEQ ID NO: 45073 - protein, 548 aa, Oryza sativa Japonica Group
PSSSLITPPIPSSSAAKHLASSAMATATASSLSLLFAHPHSSNPRPFAGGPHLRRPLRAAPHRARCASDAATTATRHRRPAEENIREEAARLRGPGNDFSAWYVPFPPTPEDDPDERYSLDEVVYRSSSGGLLDVCHDMEALARFPGSYWRDLFDSRVGRTAWPYGSGVWSKKEFVLPEIDSDHIVSLFEGNSNLFWAERLGREHLGGMTDLWVKHCGISHTGSFKDLGMTVLVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFDWQVPDWVIVPGGNLGNIYAFYKGFEMCRVLGLVDRVPRLVCAQAANANPLYRFYKSGWTDFQPRVAETTFASAIQIGDPVSVDRAVVALKATDGIVEEATEEELMDAMSLADRTGMFACPHTGVALAALFKLRDQRIIGPNDRTVVVSTAHGLKFTQSKIDYHDRNIKDMLCQYANPPINVKADFASVMDVLQNKLNGKI

SEQ ID NO: 45074 - protein, 435 aa, Solibacter usitatus Ellin6076
MPAELACFEERCRARFPITEVLYNCPHCGGLLEAVYGKPAQSADELKCLWRTRRTSNHPLDQSGVWRYREFIPFLDDYAHAVTLREGCTPLLPGRLAAEYGGLDALVFKHQGFNPTGSFKDNGMTCGASQAMRLGMTRVACVSTGNTSASMAAYASAAGLQPVIFIPHGNISFGKLAQALEYGAKTIQVEANFDQILALVRQVAERLGIYLLNSINPFRIEGQKTIMAEMLDQRDWNVPDWVVLPGGNLGNTSAFGKGLRELKELGLIDRLPRLAVIQAEGSAPFYDLMQGRDRTHLTPVSHPETLATAIKIGDPVSWPKALHEVTTSGGVVEKVSEQEIADAKAVIGRCGIGCEPASAATLAGIRKLTASGIMRSDSDIVAVLTGNVLKDPSYIHQYHTGVLKTDGGSPIRPSFGNPPVVLPNDSAKIADFLSV

SEQ ID NO: 45075 - protein, 578 aa, Escherichia coli W3110
MDATTIISLFILGSILVTSSILLSSFSSRLGIPILVIFLAIGMLAGVDGVGGIPFDNYPFAYMVSNLALAIILLDGGMRTQASSFRVALGPALSLATLGVLITSGLTGMMAAWLFNLDLIEGLLIGAIVGSTDAAAVFSLLGGKGLNERVGSTLEIESGSNDPMAVFLTITLIAMIQHHESNISWMFIVDILQQFGLGIVIGLGGGYLLLQMINRIALPAGLYPLLALSGGILIFSLTTALEGSGILAVYLCGFLLGNRPIRNRYGILQNFDGLAWLAQIAMFLVLGLLVNPSDLLPIAIPALILSAWMIFFARPLSVFAGLLPFRGFNLRERVFISWVGLRGAVPIILAVFPMMAGLENARLFFNVAFFVVLVSLLLQGTSLSWAAKKAKVVVPPVGRPVSRVGLDIHPENPWEQFVYQLSADKWCVGAALRDLHMPKETRIAALFRDNQLLHPTGSTRLREGDVLCVIGRERDLPALGKLFSQSPPVALDQRFFGDFILEASAKYADVALIYGLEDGREYRDKQQTLGEIVQQLLGAAPVVGDQVEFAGMIWTVAEKEDNEVLKIGVRVAEEEAES

SEQ ID NO: 45076 - protein, 465 aa, Musa acuminata
MEVDLGKLFIGGISWDTNEDSLRKYFSAFGEVVEAVIMKDRTTGRARGFGFVVFADPAVTERVVTEKHTIDGRMVEAKKAVPRDDHQFLNKNSSSSIHGSPVPGHTKKIFVGGLSSTITEGDFKKYFDQFGTITDVVVMYDHNTQRPRGFGFITYDSEDAVDKVLLNAFHELNGKMVEVKRAVPKEPSPGPIMRSSIGGYNYGLNRVNSFVNGYTQGYNASSVSGYGMRRLDDSRLGSLAGGRNGFASLSPGLGMGMDYEPPLSSTFVGNPGYDNNLGYGRALNPYHNANSSRYTSLIPYNDVNGNTSSLFSLTSRNVWENVALDHATKSAISNASMVSRSGSLGSLGTGNLNRGSGSSYTSGNLGFGGGGYIGLGRNSFDRRIAPASPNTNLIASSSGYEGSYAKLYGATSVYGDPTWGSSSSEFDATGSFSYKLNNSNSDVTGNGFADYMAGYNVNNNRGIAT

SEQ ID NO: 45077 - protein, 134 aa, Nostoc punctiforme PCC 73102
MHMKRYWSRLLALVLVVSIGLMGCTGSPDSLTGDYRQDTLAVVNVMRQALNLSQDSSDKTAVQAEARQKINDFSARYQRVNSVSGLGSFTTMRTALNSLAGHYSSYPNRPVPEKLKNRLEKELQQVEAALKRGG

SEQ ID NO: 45078 - protein, 187 aa, Solanum demissum
MEQVTGDDGESGGDRHASIFVLGRQLFVAMLMLDTWQYFMHRYMHQNKFLYKHIHAQHHRLIVPYAFGALYNHPLEGLILDTIGGALAFLVCGMSPRTSIFFFSFATIKTVNDHCGLWLLGNLFHIFFKNNSAYHDIHHQLYGTKYNYSQPFFVTWDRILGTYMPYELERRPEGGFEAKPVKDCKEH

SEQ ID NO: 45079 - protein, 328 aa, Yarrowia lipolytica CLIB122
MIRPFSTLTKMTPRHLISIGDLSPKELTKLVDRGLVLKKWIKQENKTETDKLSDLLKGKTVPLIFSKRSTRTRVSTEGAVAFLGGQPMFLGKDDIQLGVNESTYDTARVVSSMTSCIVARVGAHQEILDLSAASSVPVINALCEKYHPLQAITDMITIKETFGDAKNLKLAWVGDANNVLHDLAIAALKSGISVTAATPKEYPVSEDIIQICNDAAKESGATFTTTTDPKEAVKDSDVIVTDTWISMGQESEKQLKMQQFAGYQVTEELGKLAKPTWKFMHCLPRHPEEVSDQVFYSDRSLVFPEAENRLYAAIAVLEAFVVHKGKIE

SEQ ID NO: 45080 - protein, 479 aa, Musa acuminata
MASTAATSFSLLPTSSSRRRVAAVVAPSRLTLRSPSRRLGFAGVAADSLLAAHVAAKIRTVAGRSGKGPRGVAVMAKKSVGDLTAADLKGKKVFVRADLNVPLDEDRNITDDTRIRAAVPTIKHLISNGAKVILSSHLGRPKGVTPKFSLSPLVPRLSELLGIKVEKADDCIGPEVEKLVNALPEGGVLLLENVRFYKEEEKNEPEFAKKLAALADLYVNDAFGTAHRAHASTEGVTKFLKPSVAGFLLQKELDYLVGAVSNPKRPFAAIVGGSKVSSKIGVIESLLEKCDILLLGGGMIFTFYKAQGFPVGSSLVEDDKLELATSLLAKAKAKGVSLLLPTDVVIADKFAPDAQSKVVPASEIPDGWMGLDVGPDSVKTFNDALDTTKTIIWNGPMGVFEFDKFATGTEAIAKKLAELSGKGVTTIIGGGDSVAAVEKVGVADVMSHISTGGGASLELLEGKELPGVVALDEAVVVAV

SEQ ID NO: 45081 - protein, 274 aa, Bacillus clausii KSM-K16
MKMVTLNNGVNMPQLGFGVWQVPDEEATPAVAKALEVGYTSIDTAMIYKNEAGVGKAIKESGIDREKLFITTKVWNADQGYEQTLKAFDASLERLGLDYIDLYLIHWPTPHYDQYIETYKALEKLYNDGRVRAIGVCNFDIDHLERLLDECDITPVLNQVECHPYFAQNELKDFCAKHNIYVEAWSPLDQGGEVLTDEVVEKIAKAHNKTTAQVVLRWHLQNNTIVIPKSVTPSRIEENFDVFDFELSDEEMDAINRLDRNQRRGAKPSEMNTR

SEQ ID NO: 45082 - protein, 722 aa, Vibrio angustum S14
MIYQGETLSVSYLEDGIAEINLNAQGPVNKFNISTLESFNQALNALYQQPDLKGVIITSAKDAFIVGADITEFLGLFAKPEQELSQWLSHANDIFNKLEDLPVPTLSAINGYALGGGCECVLATDFRVADTKARIGLPETKLGIMPGFGGTVRLPRLIGADSAMEIITAGKDKKAQDALKLGLVDAVVETDNLKCAALAMIISAIEGKLDWQQRRQQKQAPLSLNKIEATMSFSTAKGMVAKVAGKHYPAPMAAVATIEKAARCSRDEALVIENQHFVQLAKTDVAQALVSIFLNDQYIKSQAKKAAKTAKPTEHAMVLGAGIMGGGIAYQSALKGTPVLMKDIAEASLSLGMNEAAKLLNKQLERKRIDGLKMASVLSSITPSLHYAGADSVDIVVEAVVENPKVKAAVLADVENQVTDDTVIASNTSTIPINLLAKSLKRPENFCGMHFFNPVHRMPLVEIIRGEKTSKETIDRVVAYAAKMGKSPIVVNDCPGFFVNRVLFPYFAGFSLLLKDGADYIQIDKVMEKEFGWPMGPAYLLDVVGIDTAHHAQAVMAEGFPDRMGKNGKDAIDVMFEAQRFGQKNGHGFFSYSIDRKGKPKKAVSDKTEALLAPVCQPSKAFTSDAIIARMMIPMINEVVRCLEENIIATPAEADMALVYGLGFPPFRGGVFRYLDSLGLANYVALADQYAELGALYEVPKGLREKATKGETYYNHTTNLNA

SEQ ID NO: 45083 - protein, 123 aa, Arabidopsis thaliana
  misc_feature (37)..(37): Xaa can be any naturally occurring amino acid
FVIRLSYKANPSLLYCDNNRRYQGDFFLCLKHRLPSXIDSSNLLRVVSQVLLMVNAIKGVFVSCDIPMTQFIVNMNNSMPPSQKFIIHVLDSTHLFVQPHVEQMIRSAISDFRDQNSYEKPTS

SEQ ID NO: 45084 - protein, 528 aa, Bacillus clausii KSM-K16
MITVANVGLQYGGRKLFEDVNIKFTPGNCYGLIGANGAGKSTFLKILSGEIESQTGHVSMKEGSRLAVLKQNHFEYEHEEVLQTVIMGHARLYEVMKEKDAIYMKAEFSDEDGMKAAELEGEFAELNGWEAESDAAVLLKGLGIGEDQHHKTLSELAESDKVKVLLAQALFGKPDVLLLDEPTNGLDLKAIQWLEDFLINFENTVIVVSHDRHFLNNVCTHIADLDYGKIELYVGNYDFWYESSQLALKMAQDQNKKKEEKIKELENFIARFSANASKSKQATSRKKQLEKITLDDIKPSSRKYPYIHFSPAREIGNDLLLVEGLSKTVDGEKVLNNVSFRMNKDDKIALVGSNDVAKTTLFKILMGEIEPDEGTFKWGITTSQSYFPKDNSAFFEGNELNLVDWLRQYSPEDDSDTFLRGFLGRMLFSGEEVLKQANVLSGGEKVRCMLSKMMLSGANVLLLDEPTNHLDLESITALNNGLINFKGSLLFSSHDQQFIRTISNRVIELTADGIIDEDSYEDYLKHVK

SEQ ID NO: 45085 - protein, 896 aa, Arabidopsis thaliana
MEKYFHGVLCVFIITVAFIHVVQAQDPNGFITLDCGLLPDGSPYTNPSTGLTFTSDSSFIESGKNGRVSKDSERNFEKAFVTLRYFPDGERNCYNLNVTQGTNYLIRAAFLYGNYDGLNTVPNFDLFIGPNKVTTVNFNATGGGVFVEIIHMSRSTPLDICLVKTGTTTPMISTLELRPLRSDTYISAIGSSLLLYFRGYLNDSGVVLRYPDDVNDRRWFPFSYKEWKIVTTTLNVNTSNGFDLPQGAMASAATRVNDNGTWEFPWSLEDSTTRFHIYLHFAELQTLLANETREFNVLLNGKVYYGPYSPKMLSIDTMSPQPDSTLTCKGGSCLLQLVKTTKSTLPPLINAIELFTVVEFPQSETNQDEVIAIKKIQLTYGLSRINWQGDPCVPEQFLWAGLKCSNINSSTPPTITFLNLSSSGLTGIISPSIQNLTHLQELDLSNNDLTGDVPEFLADIKSLLIINLSGNNFSGQLPQKLIDKKRLKLNVEGNPKLLCTKGPCGNKPGEGGHPKKSIIVPVVSSVALIAILIAALVLFLVLRKKNPSRSKENGRTSRSSEPPRITKKKKFTYVEVTEMTNNFRSVLGKGGFGMVYHGYVNGREQVAVKVLSHASKHGHKQFKAEVELLLRVHHKNLVSLVGYCEKGKELALVYEYMANGDLKEFFSGKRGDDVLRWETRLQIAVEAAQGPNEFVTLGLEYLHKGCRPPIVHRDVKTANILLDEHFQAKLADFGLSRSFLNEGESHVSTVVAGTIGYLDPEYYRTNWLTEKSDVYSFGVVLLEIITNQRVIERTREKPHIAEWVNLMITKGDIRKIVDPNLKGDYHSDSVWKFVELAMTCVNDSSATRPTMTQVVTELTECVTLENSRGGKSQNMGSTSSSEVTMTFDTEVNPVAR

SEQ ID NO: 45086 - protein, 420 aa, Bacillus clausii KSM-K16
MTEIKVPELGESITEGTISQWLKEVGDYVEQGEFIAELETDKVNAEIPVDTAGVIKEFKREPGDTVEIGEVIAIIDESGSAGGSSATSESTKEEATAKEEAPQEEKQAEQTQQPEKEEAVSNNRPLASPAARKLAREKGISLDAITPTDPTGKIRRQDIEAHQAKPKQTEAPKAQPSSAPVSEGEAGKPVERQKMSRRRQTIAKRLVDVQHETAMLTTFNEVDMSAVMNLRSRRKDAFSEKHGVKLGFMSFFTKAVVGALKEFPLLNAEIQGDELLIKKFYDIGIAVSTDSGLVVPVLRDADRLSFAGIEKGIGELGKKARDNKLQLADMQGGTFTITNGGVFGSLWSTPILNAPQVGILGMHKIQMRPVAIDNERFENRPMMYLALSYDHRIVDGKEAVSFLVKIKQLIEDPEQLLLEG

SEQ ID NO: 45087 - protein, 414 aa, Matricaria chamomilla
MKPASSSADSGTESCSSKGVAKTGEGLRQYYLQHIHDAQLQVRQKTHNLNRLEAQRNELNSRVGMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCAFIRVSGSELVQKYIGEGSRMVRELFVMAREHAPSIIFMDEIDSIGSARMESGSGNGDSEVQRTMLELLNQLDGFESSTKIKVLMATNRIDILDPALLRPGRIDREIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 45088 - protein, 365 aa, Glycine max
ARGHPLRPYLDYIGYLYQRMDPLPEQERFELGYRDFLQSPLQPLMDNLEAQTYETFERDAVKYIQYQRAVSKALLDRVPDEEASVKTIVLMVVGAGRGPLVRASLQAAEETGRKLKVYAVEKNPNAVVTLHALVKLEGWEDTVTIVSSDMRHWSAPEKADILVSELLGSFGDNELSPECLDGAQRFLKQDGISIPSSYTSFLQPVTASKLYNDVKAHKDLVHFETAYVVKMHNVAKLAPTQPVFTFTHPKHSDKEINQRYKKLNFIIPNDTGSAMVHGFAGYFDATLYKDVHLGIEPSTATPNMFSWFAIFFPLRTPICVDPGSTLEVHFWRCCGSTKVWYEWCVASPASSPMHNSNGRSYWVGL

SEQ ID NO: 45089 - protein, 220 aa, Matricaria chamomilla
MENTNVVLLTTWASGFGMRVQIALAEKGIEYEYKEEDLSNKSSLLLEMNPVHKKIPVLIHNGKPICESNIIVQYIDDAWSNKSPSLLPSDPYLKAQARFWADFVDKKIYDAARKIWTTKGEEQETAKKEFIDWLKVMEGQLGDKPYLIGDSFGYADIALIPFSCWFYTLETIGNMSIEKECPKLVAWVKRCMERESVSKSLADPHKMYEFVLQLKKKLGL

SEQ ID NO: 45090 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAEKFGVTEFVNPKDYNKPVQEVIAEMTDGGVDRSVECTGSIMAMISAFECVHD

SEQ ID NO: 45091 - protein, 309 aa, Zea mays
MGSRVLHLDVPADSEAYLMRNVPGSVSSPRTNGEKGLFRNQNAGFTALASPVRREIGNRSSTRSFCVEDNDLEDGKTSKEREGSAQSLRLPKIQNQALLSGLAYCISSCSMILVNKFVLSSYGFSAPVFLMLYQNIVSVTIVSTLSLSGAVPTEPLTWNLIKVWLPVNIIFVGMLITSMFSLKYINVAMLTILKNVANVLTASGETYFFKKQHGTQVWVALMLMIISAVAGGITDLSFHAVGYIWQTLNCVLTAAYSLTLRHVMDSAKQVTKSGNLNELSMVLLNNVLSLPLGIILVLGLNEVEYLLQT

SEQ ID NO: 45092 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKINPETTLFLVASKTFTTQETMTNAQSARDWLLKATKDESAVAKHFAALSTNAKDVEKFGIDTN

SEQ ID NO: 45093 - protein, 146 aa, Zea mays
KSGWTEFQPQVARPTFASAIQIGDPVSVDRAVVALKATDGIVEGGAEEELMNAMSLPDRPGMFACPPPGVALAPLFKLRGQRVIGTNDRPVVVSPAPGLKFSQSKIDSPATKIGAMACKYSNPPVSVKADFGAVMDVLKKRLKGKL

SEQ ID NO: 45094 - protein, 137 aa, Triticum aestivum
LLGIASTNLRKPLPIREVIARIVDGSHFSEFKRDYGTTLVTGFASIYGHRVGIIANDGILFGTSSQKGAHFIELCSQRGIPLVFLQNISGFMVGKDSERDGIAKHGAKLVTAFACADVPKFTVVVGGSYGAGNYGMC

SEQ ID NO: 45095 - protein, 456 aa, Desulfitobacterium hafniense Y51
MPDIKEILVKQRAFFQTGKTKELQFRVDMLNKLRSAIKIHEEEIMAALKADLNKAPFEAYATEVGMVLEELNYTLKHISSWVKPKRVRTPLVHFPSASYLYTEPYGSVLIMSPWNYPFQLTLAPLVGAISAGNCAVLKPSEYSANTSAMIERIVKEIFDESFVAVVRGGREANKTLLNEKFDYIFFTGSIQVGKTVMESAARHLTPVTLELGGKSPCIVDDTADLELAAKRIVWGKFLNAGQTCVAPDYLLVHRTVKEKIIQEIKKSITAFYGHDPLGNEDYPKIINQKHFERLLGLLKSGRVIEGGRSEEKTRRIAPTILDDVTWESPVMKEEIFGPLLPVLEFESFETALSTVNQHPKPLALYLFTRSKVHEAQAIAKTSFGGGCINDTIIHLANPNLRFGGVGESGMGQYHGKGSYDTFSHTKSIMKKSNMLDIPLRYPPFKNHLSLLKKLMK

SEQ ID NO: 45096 - protein, 450 aa, Lactobacillus johnsonii NCC 533
MKQQNHLKRSLGFFSAISIVIGTIIGSGIFFKQASVLQSAHNSTLAISAWIFGGVITLAAGLTIAEIGAQMPYTGGLYVYIEKLYGRILGFLAGWMQVIVYGPAIIAAVGGFTGILIANFFNLNDSWRIPLSIGCMLFITIINFLDNKVGAAFSVITTIGKMIPIAAIIIFGIFWGQNNALGQTISDVKQSSGGFGVAVLATLFAYDGWILIANLGGEMKNPQKVLPQAIILGITIVLTIYTLITVGILRFIPADLIERLGEDTTTYLATKAFGNIGGKLLTLGIIISMLGTLNGKIITFPRIVYAMAKRNDLPFSSYLTYLTPKGKSPIVATIFITVLATLMLVLFDPDRLSDLCVFTIYCFYILAFFGIFKLRRENSNRPFSTPLYPLVPIVAILGGLFIIVSELFNDPAGVVLFLGIVAVGLPIFYYLKRKEKTSRNKAIEINENHD

SEQ ID NO: 45097 - protein, 475 aa, Candida albicans SC5314
MSLEDDEALFEDLYGDDEKQEEKQDTVQKEVESTEKETTVVETASATENASSAEVETTTEGESESVPPPPPPPIPASGDVNAQSNTAQDNATSTAPGSVPAGMPQFPFDPAQFQQYAAANGLQFPGNANQQNFGAAGGVPPPPPPAPTANATSAESAGGPSRKCFIGGLSWDTTEEALVSHFQKYGNIVDYTIMKDSATGRSRGFGFLTFEDAKSVDALLKDRHVLDGKLIDPKRAISKEDQEKVGKIFVGGIDPMVTEEEFDNFFSQFGKIIDCQLMIDKDTGRSRGFGFVTYDSPAAVDKVCVNKYLTLKGKAMEVKRAAPRGQHNQQVMMQQQQQQQQQQAQQQAQQQAMYPYGSYGFQQMNPGAMNPAMSQEYMRYYQWFMYQQAQAAQQQQQSGTSASPEAQPAQPLNPQQQAAEEESEKSDEQARPAIPTGPKRAPPTGPSYRGGGRGGGRGGYRRGRGYHPYSRGGRR

SEQ ID NO: 45098 - protein, 652 aa, Zea mays
MASVSVVLLQRSSSRVRGYIRLQRIASSSVTLVLEGEGHWWWSNSRGRDERFGARTVHHMAGSGEGENGGVPAGGQVAMAPGVVTGGVEDAYGEDRATEDQTVTPWAVCIASGHSLLRDPRHNKGLSFTEKERDTHYLRGLLPPVVLSQDLQEKRMLQNVRQFQVPLQRYTALMDLQERNERLFYKLLIDNVEELLPVVYTPTVGEACQKYGSIFRRPQGLYISLKEKGRILEVLRNWTEKSIQVIVVTDGERILGLGDLGCQGMGIPVGKLALYTALGGVRPSACLPITIDVGTNNEDLLKDEFYIGLKQRRATGQEYSEFLDEFMAAVRQNYGQKVLVQFEDFANHNAFTLLEKYRTNHLVFNDDIQGTAAVVLAGIIAALKSVGGTLADHTFLFFGAGEAGTGIAELVALEISRQANVSVEEARKKIWLVDSKGLIVASREETLQPFKKRYAHEHEPVKDLLGAVKAIRPTALIGSAGVGQSFTKEVIEVMSSINERPIVLALSNPTSQSECTAEQAYTWSQGRAIFGSGSPFDPVKYNDKLFVPAQANNAYIFPGFGLGVVISGAVRVSDDMVLAAAEALAEQVTPEHIEKGLIYPPFSIIRKISANIAAHVAAKAYDLGMATQLPRPKDLVKYAESCMYSPVYRSYR

SEQ ID NO: 45099 - protein, 166 aa, Listeria monocytogenes str. 1/2a F6854
MKIAYLGPAASFTHAAAAKAFPKEEMIAKSTIPDCIMAIEKEDVDVAVVPIENTIEGSVNITLDYLFHFSSVPVVAEIVLPIAQHLMVHPAHVSAWKSVQKVMSHPQALAQCHTFLQAELYGVEREVTPSTAYAAKWVSNNPTELVAAIAPRMAANEYGLEIVKEN

SEQ ID NO: 45100 - protein, 354 aa, Bacillus thuringiensis serovar konkukian str. 97-27
MEKRIVCLAGDGVGPEVMESAKGVLHMVERLYGHHFHLQDEHFGGVAIDLTGQPLPQRTLAACLASDAVLLGAVGGPRWDGAKERPEKGLLALRKGLGVFANVRPVTVESATAHLSPLKKADEIDFVVVRELTGGIYFSYPKKRTDEVATDTLTYHRHEIERIVSYAFQLASKRKKKVTSIDKANVLESSKLWRTVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTADIGGAETTTSFTKAVMQEMEEQALVGRGR

SEQ ID NO: 45101 - protein, 390 aa, Synechococcus elongatus PCC 7942
MAAGVAHAEVIFIAVGTPPLPNGEADMRFVEAVARGIGEHLDGETYRVIVNKSTVPIGSGDWVRMLILDGMLARRQALVPVGAAIADSEDLPQGCFDVVSNPEFLREGTAIYDTFNPDRIVLGGSSDRAFAKMQELYEPIVQRQFAVDRDRPPVPVLRTDLGSAEMIKYAANAFLATKISFINEVANICDRVGADVVQVAKGMGLDARIGSRFLNAGLGWGGSCFPKDVSALVHIAQDYGYPAALLEATIAVNQRQRLILLEKLQQELKILKGKTIGLLGLTFKPDTDDLRDAPSLTLAEQLLRLGAKVKAYDPIVKTAPIAGLEITTSPLDLASGCDALALVTEWQEFQELDYLPLAARMRRPLIIDGRNCLDRDRLQMQGFRYIGIGR

SEQ ID NO: 45102 - protein, 543 aa, Triticum aestivum
MIEQVCTKKQAGTGPEFPGPRASQQHQPTNTAPVPARPATMVATAKIPQRQLFIDGDWRAPALGRRLPVINPTTEASIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLRIEGGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRDRCQRLAEEIDAGCIWVNCSQPCFCQAPWGGNKRSGFGRELGEGGIDNYLSIKQVTEYTSDAPWGWYKAPAN

SEQ ID NO: 45103 - protein, 559 aa, Escherichia coli W3110
MNKIFSSHVMPFRALIDACWKEKYTAARFTRDLIAGITVGIIAIPLAMALAIGSGVAPQYGLYTAAVAGIVIALTGGSRFSVSGPTAAFVVILYPVSQQFGLAGLLVATLLSGIFLILMGLARFGRLIEYIPVSVTLGFTSGIGITIGTMQIKDFLGLQMAHVPEHYLQKVGALFMALPTINVGDAAIGIVTLGILVFWPRLGIRLPGHLPALLAGCAVMGIVNLLGGHVATIGSQFHYVLADGSQGNGIPQLLPQLVLPWDLPNSEFTLTWDSIRTLLPAAFSMAMLGAIESLLCAVVLDGMTGTKHKANSELVGQGLGNIIAPFFGGITATAAIARSAANVRAGATSPISAVIHSILVILALLVLAPLLSWLPLSAMAALLLMVAWNMSEAHKVVDLLRHAPKDDIIVMLLCMSLTVLFDMVIAISVGIVLASLLFMRRIARMTRLAPVVVDVPDDVLVLRVIGPLFFAAAEGLFTDLESRLEGKRIVILKWDAVPVLDAGGLDAFQRFVKRLPEGCELRVCNVEFQPLRTMARAGIQPIPGRLAFFPNRRAAMADL

SEQ ID NO: 45104 - protein, 48 aa, Brassica napus
  misc_feature (23)..(23): Xaa can be any naturally occurring amino acid
MKKPDKGLAHKQLRTHVPLFGSXVVVIRVVPYILSYFSDSKDELKIDF

SEQ ID NO: 45105 - protein, 449 aa, Pseudomonas syringae pv. tomato str. DC3000
MSFIVCMSVLGVLLMLLALTSSYLRWMPVTTSAVCLAFGFGIGPLGLDIINLDFKQSREWLECLTEVAVLFSLFGTGIKLRLPLNCKAWHSAYWLAGPVMLATIAGVSVAAHYIFAIDWGVALLLGAMLSPTDPVLAGMVQVNSAQDQDRLRFGLSGEAGLNDGTAFPFVIFAMLYLSSGGVTGDWAQHWLLKDLIWAVPAGLLIGFGMGRGVGHLMIFLRIKNADSTTSPNDFLALALIALAYVVAEGFGAFGFLSVFAAGFGLRQAEMRVTRSELPSEHVAQPVLGHMTAALDQGTVAKADDLSDSQLAAGVMMGDMLAFGSLVERAMEVLLITLLGAALASYWDWRAIGLGLALFCVIRPASVWLLVSQKLLNARQKALVGWFGIRGIGSLYYLCFALSHGLADDVGNVVIGMTLSVVALSILLHGISIQPLLERYERSTAANPDK

SEQ ID NO: 45106 - protein, 480 aa, Solanum demissum
MMQDVWTQLGPTIAAIMFTWTMYQNYFPHELRGHIRRYTDKLVSYFYPYMHIIFYELETEGWFERSKAYVAIERYLSKNSSTQAKRLKANAVKDGQSLVLTMDDHEEITDEYKGEKVWWISSQKPASRQTISLYREDEKRYFKLKFHKKNRDLITNSYLKYRGGRMWSGVVFEHPSTFDTLAMDPNKKQEIIDDLETFSKSKDYYAKIGKAWKRGYLLYGPPGTGKSSMIAAMANFLKYDVYDLELTSVKDNTELRKLLIDTTGQRETNKKKKEEEDKGKNEEDAVKEKMKKGGEAKEKQSEVTLSGLLNFIDGLWSAIGGERLIVFTTNYVEKLDPALIRRGRMDKHIVLSYCCFESFKVLAHNYLDVVESHVHFPEIRRLLEETNMTPADIAENLMPKSSKENADTCLERLIKALETAKEEAKLKAEEEEKAKAAEKEKEEKDREEKKEVTATEEAENADNVNEKDNGVKENGDVSKD

SEQ ID NO: 45107 - protein, 305 aa, Solanum demissum
MKAQVFNDGRKAHTTKIAVTAMSAMAAETVTFPVDLIKTKLQLHGESLVSSRRISAVRVVAEILRNDGILGLYKGLSPAIIRHMFYTPIRIVNYEFLRNSLVPADHTLSLSSKAIIGGISGVIAQVVASPADLVKVRMQADSRMASQGLQPRYCGPFDAFNKIIRTEGVRGLWKGVLPNAQRAFLVNMGELACYDHAKRFVINNNIANDNIYAHTLSSIMSGLSATTLSCPADVIKTRMMNQAADKQGNCKYRNSYDCLVKTVRVEGLKALWKGFFPTWARLGPWQFVFWASYEKFRQIASLSSF

SEQ ID NO: 45108 - protein, 210 aa, Brassica napus
EELSDEQIADNIIGVIFAARDTTASVMTWILKYLADNPNVLEAVTEEQMAIRKDKGEGESLTWGDTKKMPITSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTQYRWSIVGASDGIQYGPFALPQNGLPIMLTRKSEIDM

SEQ ID NO: 45109 - protein, 91 aa, Synechococcus elongatus PCC 6301
MAVETIQKPETTTKRKIAPRYRVLLHNDDFNPMEYVVMVLMQTVPSLTQPQAVDIMMEAHTNGTGLVITCDIEPAEFYCEQLKSHGLEQQH

SEQ ID NO: 45110 - protein, 387 aa, Oryza sativa Japonica Group
MNRKNTENLTEDLLGGFEYQVQVPYIMYHNAADEITGIWFYDPQECEQVGYLFSRIQKAFSRVSPKAKVSVTESEYEKPEVVPAVPSNEDTLKQPTSSIMLLDNAKYDFLSALLKGAACVGATMDEASAVQSNKSVGMVHSSTHASPHAIPPQSPAIQSNKSFGMVHSSTQAPLAIPPQSPAIRSNKSVGMIHSSTHASPFDIPPQSPAVQSNKSVGMIHSLTHASHLAIPPQSPALHGLHPSQISAVPVMPHDAHRSSSTSTIQPTSLANPLFFPPMPSLQTASHAASSLCSAAPLHPPITVQQLQSAPLHQPFSLPTASSIQPPYGMPLLQPFPPPNPSPFLTSGVSYGRPVITRDQLKDVLLSLCQNDEFIDMIYREFVKRQLP

SEQ ID NO: 45111 - protein, 63 aa, Glycine max
MYNHDIPIDSKDKSLAVLQKDKRLVLTMEDLSKALREYGVNLRHQEYFADSPSTGMDPATREE

SEQ ID NO: 45112 - protein, 131 aa, Brassica napus
QDSRIGRGREELAEDDDDNHIDIETAEDDDDNHIDIETAEDEEKPASPIDEDEREKYSHLLSLPPHGSEVFIGGLPRDVGEEDLRDLCEAIGEIFEVRVMKDRDSGESKGYAFVGFRTKDVAQKAIEELHS

SEQ ID NO: 45113 - protein, 226 aa, Triticum aestivum
LTGAAGIFTGFSTEFVARAWDLDHDAAAKIVSTQPGSGIVKIAAGHRMPEPRAEDRQGVVLNCLEAPLDVDIPGGGRVVVLNTANLPPVKDVGLGSDLVRIDGKSMCSPGFSCDSAYQVTYIVRGGGRVQVVGIDGTRVLETRAEAGCLFIVPRFFVVSKIADDTGMEWFSIITTPNPIFSHLAGRTSVWKAISPDVLETAFNTTPEMEKMFRSKRLDSEIFFAPN

SEQ ID NO: 45114 - protein, 514 aa, Chlamydomonas reinhardtii
MASTSATSTAATASTASIPASSCPPPDYDTALAVRRRHYGPNTSLSYERPIMFVRGAGAYLYDQEGVSYLDCVNNVSHLGHGHAEVAAAVSAQLHTLNTNSRYLHPQLPAYSRQLLHTLNNSTAAACASCATAAAAAAAAPLEVLYLVCSGSEANDLALRVIAAARPGATHMAVMGGAYHGHLTSLIPLSPYKFWGRGGAGRPPHVHVVPCPDPYRCVCAGEHLDGRAAARAVLAAAARAGGRLGGFIAESVLSCGGQVVGHPGTYSRVDAHRVLRAEGVIVVADEVQCGFGRCGRAFWGFQTQGVMPDIVTMGKPIGNGYPLAALATTRALASAFSAGGMEYFNTYGGSTAAAAAAAAVLRVLQRDNLQAHAHRVGVGAWERAMSVLRPMMSVLGDVRGMGLFIGIEIVRDRASKRHAPVTAKWLKERLRSRHALLSTDGPYDNVIKIKPPLAFGRRQADELVERMRWVWRRRGSGAQWRGEGRFQHLGLGEGCCPPYPGRWGVLESSWRVSA

SEQ ID NO: 45115 - protein, 182 aa, Vibrio parahaemolyticus RIMD 2210633
MSSIRSYKGIKPQLGERVYVDSTSVLVGDIRIGDDSSIWPLVAARGDVNHIHIGDRTNIQDGSVLHVTHKNSENPNGYPLIIGNDVTIGHKVMLHGCEIHDRVLVGMGAIVLDAVVIESEVMIGAGSLVPPGKRLESGYLYVGSPVKQARPLSETERAFLQKSANNYVQNKNDYLHEVEDLN

SEQ ID NO: 45116 - protein, 283 aa, Arabidopsis thaliana
MAEHLASIFGTEKDRVNCPFYFKIGACRHGDRCSRLHNRPTISPTLLLSNMYQRPDMITPGVDPQGQPLDPSKIQDHFEDFYEDIFEELNKFGEVESLNVCVNLADHMIGNVYVLFKEEDHAAAALQALQGRFYSGRPIIADFSPVTDFREATCRQYEENSCNRGGCCNFMHVKQISRELRRKLFGRYRRSYRRGSRSRSRSISPRRKREHSRERERGDVRDRDRHGNGKRSSDRSERYDRDGGGRRRHGSPKRSRSPRNVREGSEERRARIEQWNRERDEGV

SEQ ID NO: 45117 - protein, 470 aa, Gibberella zeae PH-1
MGSLTQSSSFDVNKVAIIGAGPTGIAAAKYLIAQGIRDITIFEQQDHVGGIWHYHGFAAGTCPVPQEDPYHPPDEPLKWDSTSPPIFTSPMYENLHANIPKEVMNFSDQPFPEDAKLFPERPMIEDYLIKYSEDIKPLIQFCQRVERVSLKQQDGRDKWEVEAKSTMTGNDGITQAFDAVVVGNGHYSTPFVPDMRNIKEFNEAYPGVITHSKQYRTPCTFKDRKVVVVGNGPSGLDIALQINQECRKPAFLSVRHPTPPDRLHHCGCEEMAEIDEFMVEQKGLRFKDGRVETDIDAVIFCTGFLYSYPFLQDLDHKLVTTGRGVRGLYQHVFDIRHPTLVFPGLNMKAAPWPLAESQAALFAAVWSNNLELPSRGVMEAWNMELEKREGEALHMFGPNGDGLYINELHDWVMTAKRPGKEPPHWDRELMWQRSVFIDAKVKFEQLGCKARTMKEVGFCYEPDNTQTSTA

SEQ ID NO: 45118 - protein, 150 aa, Chlamydomonas reinhardtii
MATEQSYIMIKPDGVQRGLVGEVIKRFEQRGYTLKGLKLMNVEKSLAEKHYEDLSARPFFPALVDYICSGPVVAMVWEGKGVVATGRKMIGATNPLASEPGTIRGDFAIEVGRNVIHGSDSVESATREIGLWFPEGVAQWTPVAKPWIYE

SEQ ID NO: 45119 - protein, 493 aa, Xanthomonas campestris pv. campestris str. ATCC 33913
MSRKQAFQFLDLPRTMPTRIPVELRTSGDWGELYGKFDKADAQYQSGRCLDCGNPYCSWKCPVHNAIPQWLQLVQEDRIIEAAALCHSTNPLPEVCGRVCPQDRLCEGSCTLEEFGAVTIGAVEKYIVDTAFSMGWRPDLGNVQPSGHRVAVVGAGPAGLSCADRLVRAGIEAVVYDRYEQIGGLLQFGIPSFKLDKSVIGKRREILEGMGVQFRLGVEIGKDVSIEQLLGEYDAVFLGTGAYRYTDGGLDGQDLKNVLPALPFLVQNSRIVSGNDPHGRPIAGWEDQIALPDLNGKRVVVLGGGDTGMDCVRSAIRLGAAKVTCAYRRDESSMPGSAREVANAREEGVRFLFNRQPLSIESGADDEAIGVTVVETKLGEPDASGRRNAVPVEGSESLLEADVVIIAFGFSPTVPEWLSSQGVEAGSNGRIVAPAEGNGRLPYQTSNPRLFAGGDCVRGADLVVTAVAEGRDAAGSIVQLLGVKAQVKEPAAA

SEQ ID NO: 45120 - protein, 401 aa, Prochlorococcus marinus str. MIT 9303
MPSTKHPQPGTKIDAVLDPVIPELNELVAKTPGTLSLAQGMVNWAPPVAVKLAMNNALVNQESSLNRYGPVRGDPALLELINQKLMIQNGLDLAESMVMVTAGSNMAFHAIAQVLCDPGDEVILPLPYYFNHFMAIQLAGGVPVPVDAGLIPNPELIEAAITKCTRAIVTISPNNPSGIVFPQTLLAAINGICAQHGLLHISDEAYEDFVFGDVPHWSPGSIPGAGNHTVSLYSFSKAYGMAGWRLGYMSAPIGWSKALAKVQDTVLICPPRFCQQAAIAALADGSDWMRQNVSQFMSRYQYLLNRFAASNDRPWRFLHQPNGAFYCLLEVDCGCNGDTLMRQLVRDYRVATIGGCSFGFKNESCVLRISVGMLEGAELIEAFDRLEAGLLNAVQKGVRNT

SEQ ID NO: 45121 - protein, 187 aa, Fusobacterium nucleatum subsp. nucleatum ATCC 25586
MNLPNRLTMIRFILAIPFIIFLQYSDSSKYGLIFRLISLVIFVIASLTDFFDGYIARKYNLITDFGKIMDPLADKILVISALVIFVQLEYIPGWMSIIVLAREFLISGIRILAAAKGEIIAAGNLGKYKTTSQMLVVIVALAIGPIGFYISDYFFTVAEVLMLIPVILTIWSGWEYTFKAKHYFTEQ

SEQ ID NO: 45122 - protein, 597 aa, Gibberella zeae PH-1
MAALDQHRGYVQDHYQEVKQERSPEYVDENNAAGYQIVREPLWNKGLAFTPEQRANKNLTGLIPHTIESFDTQCARAMKMIQTRQTPIDKYLYLSTLKDQNTDLFYRLLIDNVRELMPLVYTPTIGDVCLQYSSIYTRPEALYISIKQRKSIRAMLRNWPCQDPEICVVTDGSRILGLGDLGINGVGISIGKLALYTGAAGIHPSKTLPIVLDCGTNNEENLQDPFYLGLRQKRPSYPEQQAFMDEFMEATREVFPNMVVQFEDFDSEKAFGYLDRYRDQYRCFNDDIQGTGAVVLGGYIGAVEQSNVPIEEQRLVFMGAGSAGVGVAKQLVEYYTRRGLSEAAAREKFWLVDTKGLVTKDRGDRLAEHKKYFARTDNNGQQFRTLEEVIEYVKPSALVGLTATFGVFTEPVVRALKSSVQEGGLERRPILFPLSNPLTKAECTFEQAIEWTEGTVLFASGSPFNPVKAKFGDETHHTVYHPNQGNNVYIFPGLGLGAILAKASRVTDEMVYTSAAALAGSLNADEVHKGLIYPRIERVRDASVIVAREVMKAARRGGVSELPESQWAEWEEWGDVALTSFIKQHIYNPLCFADAKL

SEQ ID NO: 45123 - protein, 440 aa, Vibrio angustum S14
MTASLAERLSQYKTEGTGCKPVASGRLVRVVGLTLEAIGCRAPVGSLCKVETLNGELEAEVVGFSGETLFLMPSEQLLGVMPGAKVTPILHNSGLPVGPELLGRVIDGVGNPLDGLGPIFTEHRASFNATPINPLARKPIKEPLDVGIKAINGCLTVGKGQRIGLFAGSGVGKSVTLGMMTRGTSAQIVVVGLIGERGREVKEFIEESLGPEGRARSVVVAAPADASPLMRLKGCQTSLTIAEYFRDQGFDVLLLMDSLTRFAQAQREIALSVGEPPATKGYPPSVFAKLPALVERAGNGNENQGSITAFFTVLSEGDDLQDPIADASRAILDGHIVLSREMADAGHYPAIDVERSVSRVMPAIVSEEHMLMSKAVRQILSICRKNQDLVSIGAYKPGTDNTIDQAFSFKPKLDAYLQQEMKESVPYEMCVNMLRSTLGG

SEQ ID NO: 45124 - protein, 325 aa, Eremothecium gossypii
MHICSLIPILFPKLLTCGLALYSAVVLWLKVSVIGSFIQGTVLLTLVPLILYAYFSTIAVGPGSPLDFEELRIRDLNDVETGMEFPPDFLAAKTVTLDSTGRHRYCVKCKVWKPDRCHHCSACDKCYLRRDHHCVWFPGCIGYNNHKFFLHFLLYASVYAFWICIITTWDLVVWFRAHSYERELLNVHLVCLWALSAAATVALTAFCAFNIYLVCKNETTGEYQRRSTLNSDLEMYADCTNGPRTVIENPFDLGSRRRNWAAVMGDTWKEWLLPIRTTASQKARHSFDESGLYFKIDEQAHAKLAESMALQARLITRFNSKRAVQ

SEQ ID NO: 45125 - protein, 372 aa, Oryza sativa
  misc_feature (243)..(243): Xaa can be any naturally occurring amino acid
MPRRGGAAKKPAGGGELSRFLQSHLQTINDTFQMMAEAAPGGLERTEWSEVVKLGEQVSRQATVAGMVWSGDLPDVETLKENIVAYFNILQGFLLGCHGSTVGAGPTLHKSICSSAKNVVDSSFSLFNQAVSAYESRSPDRKTTIPQVTGTVWEACLALNKVPTTNCVAIGRAMTQIGVYLKDILREMKELPIGDSNGTAEKSSNGAVDTTSCSDRDGSSSDLELDEDFTEEEVAVAKLVVTXVLPHALVVVKETIRFITCLLKISGNRSGANEEKVETMEQLLSCCRQAADQINDLGASVYPPQDLSEMKSSVKRLYGGANAMRREIGSLGGSPEGAFVALERFEKSLGALEVEIADDVANEMENLTISSS

SEQ ID NO: 45126 - protein, 258 aa, Calystegia sepium
MAGRWSLQGMTALVTGGTRGLGHAIVEELSSLGAIAYTCSRNQKELDECLKNWKEKGYPVFGSTCDISQQSERENLIQLVCKQFDGKLHILVNSAATIIPKETLNLNAEDNSIVIGTNLMTSLNFSQLAHPLLKASGNGSIVFISSCASFVFVPVHTVYAATKGAINSLAKNLACEWANDNIRVNAVAPWAMRTSLTEAAREEAGGEILEALIQRTPQHRLVEPKEASAAVAFLCFPASSFVTGQVICVDGGATSYGL

SEQ ID NO: 45127 - protein, 340 aa, Brucella melitensis 16M
MTVRYGKDSSSVKASRPRFAVAPMIDWSDRHCRYFHRLFSKRALLYTEMVVADAAIFGPRDRLLGFDPAENPVALQLGGSDPAKLRQAAQIGADFGYDEINLNVGCPSDRVQSGTFGACLMLTPDVVARCVAAMKETISIPVTVKCRIGVDDQDTETALDALADQVLEAGADALWVHARKACLKGLSPKENREIPPLDYERVYRLKQRLGETFVGINGGIATLEEAQVHLQKVDAVMLGRAAYHNPALLADVDARLYGEGQEPLAMPEIIDAMCDYIDRHIASGGRLSHVSRHMVGLFTGQPGARRWRQILSTDATKPGATSDVVRQAYATVVEACAEAA

SEQ ID NO: 45128 - protein, 515 aa, Brassica napus
MLDSLVSKLPSLSTSDHASVVALNLFVALLCACIVLGHLLEENRWMNESITALLIGLGTSVTILLISKGKSSHLLVFSEDLFFIYLLPPIIFNAGFQVKKKQFFRNFVTIMLFGAIGTVVSCTVITLGVTQFFKKLDIGTFDLGDYLAIGAIFAATDSVCTLQVLNQDETPLLYSLVFGEGVVNDATSVVVFNAIQSFDLTHLNHEAAFQLLGNFMYLFLLSTLLGVATGLISAYVIKKLYFGRHSTDREEVALMMLMAYLSYMLAELFALSGILTVFFCGIVMSHYTWHNVTESSGVTTKHTFATLSFLAEAFIFLYVGMDALDIEKWRFVSDSPGTSVAVSSILMGLVMLGRAAFVFPLSFLSNLSKKNQSEKIDIKQQVVIWWAGLMRGAVSMALAYNKFTRSGHTELRGNAIMITSTITVCLFSTMVFGMLTKPLIRHLMPHQSTTTSMLSDDNTPKSLHMPLLDGEQQDSFVEFSGSHHDVPRPDSLRGFLMRPARTVHHYWRQFDDSNH

SEQ ID NO: 45129 - protein, 190 aa, Rickettsia conorii str. Malish 7
MFIQTEDTPNPDAITFFPGQEISSDQPVFFSELAEVKGRSKLAESLFYINNVKSVFFGSDFITVTKQAEGNWQVIKPEILMVIMDHFVSGFPVFEENTKADNVNHNLDGLSEIEKQIVEIIETRVRPSVAQDGGDIIYKGFENGVVKLALRGACLGCPSSTITLKNGIESMLKHFVPEVQEVEAVEEGFE

SEQ ID NO: 45130 - protein, 513 aa, Aspergillus nidulans FGSC A4
MARTFGRAAFARPSPVARRALQPSKLNGFPSFARLASTETAAGGKIHQVIGAVVDVKFEGEKLPAILNAIETENNGQKLVLEVSQHLGENVVRTIAMDGTEGLTRGAPARDTGAPITIPVGPGTLGRIVNVTGDPIDERGPIKATKYAPIHAEAPEFTEQSTTAEILVTGIKVVDLLAPYARGGKIGLFGGAGVGKTVFIQELINNIAKAHGGYSVFTGVGERTREGNDLYHEMQETGVIQLDGESKVSLVFGQMNEPPGARARVALTGLTIAEYFRDEEGQDVLLFIDNIFRFTQAGSEVSALLGRIPSAVGYQPTLAVDMGGMQERITTTTKGSITSVQAVYVPADDLTDPAPATTFAHLDATTVLSRGISELGIYPAVDPLDSKSRMLDPRIVGEEHYNTATRVQQMLQEYKSLQDIIAILGMDELSEADKLTVERARKLERFLSQPFTVAQVFTGIEGKLVDLKDTIASFKAIMNGEGDDLPEAAFYMVGDLASARAKGEKILADLAKN

SEQ ID NO: 45131 - protein, 1501 aa, Candida albicans SC5314
MSDSKMSSQDESKLEKAISQDSSSENHSINEYHGFDAHTSENIQNLARTFTHDSFKDDSSAGLLKYLTHMSEVPGVNPYEHEEINNDQLNPDSENFNAKFWVKNLRKLFESDPEYYKPSKLGIGYRNLRAYGVANDSDYQPTVTNALWKLATEGFRHFQKDDDSRYFDILKSMDAIMRPGELTVVLGRPGAGCSTLLKTIAVNTYGFHIGKESQITYDGLSPHDIERHYRGDVIYSAETDVHFPHLSVGDTLEFAARLRTPQNRGEGIDRETYAKHMASVYMATYGLSHTRNTNVGNDFVRGVSGGERKRVSIAEASLSGANIQCWDNATRGLDSATALEFIRALKTSAVILDTTPLIAIYQCSQDAYDLFDKVVVLYEGYQIFFGKATKAKEYFEKMGWKCPQRQTTADFLTSLTNPAEREPLPGYEDKVPRTAQEFETYWKNSPEYAELTKEIDEYFVECERSNTRETYRESHVAKQSNNTRPASPYTVSFFMQVRYGVARNFLRMKGDPSIPIFSVFGQLVMGLILSSVFYNLSQTTGSFYYRGAAMFFAVLFNAFSSLLEIMSLFEARPIVEKHKKYALYRPSADALASIISELPVKLAMSMSFNFVFYFMVNFRRNPGRFFFYWLMCIWCTFVMSHLFRSIGAVSTSISGAMTPATVLLLAMVIYTGFVIPTPSMLGWSRWINYINPVGYVFESLMVNEFHGREFQCAQYVPSGPGYENISRSNQVCTAVGSVPGNEMVSGTNYLAGAYQYYNSHKWRNLGITIGFAVFFLAIYIALTEFNKGAMQKGEIVLFLKGSLKKHKRKTAASNKGDIEAGPVAGKLDYQDEAEAVNNEKFTEKGSTGSVDFPENREIFFWRDLTYQVKIKKEDRVILDHVDGWVKPGQITALMGASGAGKTTLLNCLSERVTTGIITDGERLVNGHALDSSFQRSIGYVQQQDVHLETTTVREALQFSAYLRQSNKISKKEKDDYVDYVIDLLEMTDYADALVGVAGEGLNVEQRKRLTIGVELVAKPKLLLFLDEPASGLDSQTAWSICKLMRKLADHGQAILCTIHQPSALIMAEFDRLLFLQKGGRTAYFGELGENCQTMINYFEKYGADPCPKEANPAEWMLQVVGAAPGSHAKQDYFEVWRNSSEYQAVREEINRMEAELSKLPRDNDPEALLKYAAPLWKQYLLVSWRTIVQDWRSPGYIYSKIFLVVSAALFNGFSFFKAKNNMQGLQNQMFSVFMFFIPFNTLVQQMLPYFVKQRDVYEVREAPSRTFSWFAFIAGQITSEIPYQVAVGTIAFFCWYYPLGLYNNATPTDSVNPRGVLMWMLVTAFYVYTATMGQLCMSFSELADNAANLATLLFTMCLNFCGVLAGPDVLPGFWIFMYRCNPFTYLVQAMLSTGLANTFVKCAEREYVSVKPPNGESCSTYLDPYIKFAGGYFETRNDGSCAFCQMSSTNTFLKSVNSLYSERWRNFGIFIAFIAINIILTVIFYWLARVPKGNREKKNKK

SEQ ID NO: 45132 - protein, 249 aa, Synechococcus elongatus PCC 6301
MTALPLTDRIALVTGASRGIGRAIALELAAAGAKVAVNYASSAGAADEVVAAIAAAGGEAFAVKADVSQESEVEALFAAVIERWGRLDVLVNNAGITRDTLLLRMKRDDWQSVLDLNLGGVFLCSRAAAKIMLKQRSGRIINIASVVGEMGNPGQANYSAAKAGVIGLTKTVAKELASRGITVNAVAPGFIATDMTSELAAEKLLEVIPLGRYGEAAEVAGVVRFLAADPAAAYITGQVINIDGGLVMA

SEQ ID NO: 45133 - protein, 296 aa, Acidovorax sp. JS42
MTDLLSIAPRDKAEILAQALPYIRKFHGKTMVIKYGGNAMTDPALQADFAEDVVLLKLVGMNPVVVHGGGPQIEQALNRLGKKGEFIQGMRVTDAETMEVVEWVLAGEVQQDIVGLIHQAGGKAVGLTGRDGGMIRAKKLKMVDNKDPSVEHDVGQVGDIVAIDPSVVKALQDDAFIPVISPIGFGEENESYNINADVVASKLATVLQAEKLVLLTNTPGVLDKEGKLLTDLTAREIDALFADGTISGGMLPKISGALDAAKAGVNAVHIIDGRVPHSMLLEILTDQAYGTMIRSH

SEQ ID NO: 45134 - protein, 341 aa, Synechococcus elongatus PCC 6301
MEPQRSRRSLDHRRNLVNSVWALVLLIVVGTLGYQLIEGWTGLDALYMTITTLATVGFGEVNPLSPKGRLFTILLILAGLILIGYVIKTATEALAEGYFQERLRDRRLRHLLNRLHNHYIICGFGRTGQEIAREFNAEALPFVVLDNDESAIDTAIAAGLQAFVGDATLDEVLIKAGIERARCLVAAMPSDADNLYAILSAKTLNPNLRTIARASSAEAVQKLRRGGADAVVSPYITGGRRMAAAARRPQVIDFIDDLTSASERSVYIDEFLLEQPRSRFIGRTLREADLRGRSGALILAIRRADGTLLASPTGDTYLELGDLLLCLGTGPQLQALEKLLA

SEQ ID NO: 45135 - protein, 222 aa, Zea mays
  misc_feature (33)..(33): Xaa can be any naturally occurring amino acid
  misc_feature (45)..(45): Xaa can be any naturally occurring amino acid
  misc_feature (100)..(100): Xaa can be any naturally occurring amino acid
  misc_feature (124)..(124): Xaa can be any naturally occurring amino acid
  misc_feature (200)..(200): Xaa can be any naturally occurring amino acid
MASSPRSPPAPTPEFEISRQSRLFAALSKKVIXLDELRMLAAQGXPDAAGVQATVWKLLLGYLPNDRALWPVAVGAEELAKKRGQYAAFKRPRILNLLKXANRRPHYNVNAEHVHNGFLHRSEXTREEHPLSLGKTSAWNQFFEYSEIMEQIDRDVKRAHPDMHFFCSDSSFAKSNQESLKNALLIFAKLNAGIGYVQGXNEILAPLFVFRSDPDDKNAVWS

SEQ ID NO: 45136 - protein, 444 aa, Lactobacillus johnsonii NCC 533
MKKYDYIILGTGPAAYKLVKLLDTQHKSILTIESGLFGGTCPNVGCEPKIYLDGAVQAVLSNQQFEKEGIISQGGKLNWAQLMKDKKARFASWPNETRKNISKISDVISGSAHFVDRQTIEVNRQYFQGNRIIIATGRRPHELSIPGAKFLHDSSDVLSLGTLPEHTTFIGGGYVAMELATFLAAAGSQVTILVRGDRVLRHFYQKYSRELVVRMKQRGIQFEFETEPTRITQLSDKYVVELNQDGPIVTDYVVNASGRMPNIEKLDLSAAQIDYSTRGIDVDRHLQTNVKNIYAIGDVTSQDVPNLTPVAEFQAQYLFNSLEKGLTQPINYPAIGTGVFAFPQLAQAGINPDSVLEDGDNFEIREYELSQSSLYAGQKEKGLLTVVYDKANYIVGVSEISMSAVNDINYFVPIIGLRINKNEWHRNVLPIYPALADKIEGILR

SEQ ID NO: 45137 - protein, 277 aa, Rhodopseudomonas palustris CGA009
MQTADAHFVEAHGAKIPALGLGTWELSGHSCSRIVEQALRLGYRHIDTAQIYDNEREVGEGIRNSHIRRDQLFVTTKVWTTHFAPNDLVRSAKESLVKLRLSEVDLLLLHWPNAHVPLAETLGALAQARALGLTRHIGVSNFTVALLAEAVAVCPAPLVCNQVEYHPFLDQQKVLAACALYGMALVAYSPIARGNAKKSEVLTRIGNVHGKTAAQVCLRWLIQQNVAAIPRSSRLERLAQNIDVFDFELSDAEMQEIFTLGSPKGRLTTMPTAPVWD

SEQ ID NO: 45138 - protein, 1634 aa, Yarrowia lipolytica CLIB122
MYGYQGTGGQQPLGAQPTGFGFGNTPVQQQQQPMQPMQQSQPTGYQAPGGFQNYQPTGFAQQQQQQQPQQTGFQSMQPPMQQTGFQSQPNVSMYQGGGGQGYQSAPMLHQQTMQTGYQPQQQQPGFTGFQPQQQQQQQQTGFTGFQQQPQQQQPGFTGFQSQPTGYNANASAPAATPAAPLQQQKTGNARDPFAPTLPARPPLTSQPTGGGNKSVVDGVYIPNVRLSFLTADDQRNFENLFRQALPKGEQALSGDKARDILFRSGLPPITLSAIWNLADTTRSGALLFPEFAVAMYLCGQAVKGQTVPNNLSENIKNEVSSMVDIISFNIPDAGSRPSSSGQSVPQSQPQQQQQQSSASMLAGLNLGQPTGYQQQQATGYQPMQQQSTGYPMQAMQPQITGGMPLQQQRTGPMQPLQQQSTGYAPLQSQLTGGAPLQSQLTGGAPLQSQLTGGAPLQSQLTGGAPLQQQSTGYAPLQQQSTGYAPLQQQSTGYMPQQQTGMQPQSTGYGSMQPLTAMPTGKPGQWGFINTPSQGLPGIETMQQRLMPQATGAPVQQLPPMQLQQSATVNWAIAKEEKQIYDGIFMAWDKKRAGAIDGDTAIKIFTQSGLNRADLEAIWTLSDPSNKGRLDRDEFAVAMHLIYRHLNGYPIPSRLPPELVPPSSKNFSDSVNQVKSYLKAGGGRTGGSKLKSRSFTGDSTIKKDATVFKNDDSDFGYTSRNRRGGSSSTASSNGSSGNDISLSGKGSSISELKKLIREKQILLDAIDAEDSDMSRDSNLERRDQEAVADLKRRIQNVQRDIDVAPHSAISTDVGASADAKRNLMRKLDHLGDRLPQLASNVRRIEDKIANAKMELFRLKNPTSLVGTGPGGAITEADRIKARSKAKLQARMAALTGKGTTTGADASEEEDYEHRLLTHTSEVERSKAQNYEMIHDIEDSVKSLQRDLSSKLRETQEEVSEDRQRRRWEEAVGVEDDVRQFIYSLRSTRSSRPAPATASSSAPATGSPATAAPISATSTGASTPSAPAAGVDRKAQLKAEAERKMNERLAALGIKRKEKAQAHGFAPPDAKPAEASPAASPAVASPAVASPAATPAVSSPAPVSRGVPAPAAATPATDPATTPAVPVSAPADDSDSDDEEYEKLMAQKREQEERFKKQQEADKKKEEEKKQKKAAKEERMRKLREEMEANEAREKAWKESQSKEAEADEAEGDVGAAALAAFSNKATAPSTTPTAVAATPPVATSTPSPAAPTVPAADDNNPFHRLNNGGDAAAAAPAAGGEDNNPFLRPGTNQPIAAPSPASFSEAPKEAPKPVDPVKISNQRANQRAAKNDDDDWGMSSDEDDDQDYHRGNAAELASQLFRTMAPPIQRQPTGGAPITATPTGSAPAAPPAAPPVAPAAVEVAVAASEATPGPESAPPAPPMPEINIPPATEAPSAPAATEAPPAPPSAPTTIETTHLPPPVDTHNDMSSSEFDFETPEGSPTQQTFAEAAPPVAAPPPPPPTAAAAAPTGIPPPPPSAPGFGAPEAPSGIPPPPPPAPGFGAPPPPPGPAPSFDAPGGAPPPPPPGPPPPMFGAPAPPSMTGPSAGDLPERPPAATGGITALLGEITGGKTLRRVDDKDKKISSNPSAGAVLN

SEQ ID NO: 45139 - protein, 262 aa, Oryza sativa
  misc_feature (233)..(233): Xaa can be any naturally occurring amino acid
MQAPSIEKVTRVACVGAGYVGGTTMPIIAKFCPDITCTVVDIDEPRIAAWNSENLPIYEPNLQEIVKAYRGKNLFFTSKYLDKGIREAQVIFIAVNTGTKSYGYGAGSAYDMTAWEAVARSIAKHATEEREYIIVEKSTVPVKTAEQVQRILDAAKLSPKTSFEVVSNPEFLAEGSAVKDLEEPDRVLIGGGERACSIVSSIYEHWIPKEKIITTNLWSSELAKLAANAILAXRISSINALSAICDATGADNEEVATVGLYR

SEQ ID NO: 45140 - protein, 312 aa, Bacillus cereus G9241
MKKVYFNHDGGVDDLISLFLLLQMDNVKLAGVSVIPADCYLEPAMSASRKIIDRFSKEYIEVAASNSRAKNPFPKDWRMHAFYVDALPILNEAGKVITSVAAKPAHHHLIETLLQTEGKTTLLFTGPLTDLARALYEAPIVEDKIERLVWMGGTFLTAGNVHEPEHDGTAEWNSFWDPEAVARIWESKIEIDLVTLESTNQVPLTIDIRERWAKERKYIGVDFLGQCYAMVPPLIHFSTNSTYYLWDVLTTALVGNTNLAKTQTINSIVHTYGPSQGRTVEFDGGRPVNVVYDVNHNGFFNYITELAKKAST

SEQ ID NO: 45141 - protein, 231 aa, Zea mays
LEAGGIHYSSPSLPPTEDSFPRPAPSPSSGERSREAAHKFLARENLSSPLSLYISAYLPAQISCRIGLVFRLGKGDGFSVSRDLHDGEHGSSGLHRRGIRGSRHADAQVRAVAKAASVAALEQFKISADRYMKERSSIAVIGLSVHTAPVEMREKLAVAEELWPRAIQELTSLNHIEEAAVLSTCNRMEIYVVALSWNRGIREVVDWMSKKSGIPASELREHLFMLRDSDA

SEQ ID NO: 45142 - protein, 447 aa, Triticum aestivum
GNGDDEKVEGLHHARQPPHGDSSPSSRHATKRRRAHGAAAAMADRFFPNDLPDFVAEAPDGGDPPAAGLRGLLSLPYPRLSDRLLRAALRLKDKVVQETWTRTGGHVTDYTLYTGALGTALLLFKSFQVTGDRRDLNLASEIVQACDAASLGLPFLTFICGRAGVCALGAVIAKHCNDQLMETNFLSSFDEIIITEKVPNELLYGRAGYLWACLFLNEHLSDKTIPAEHISSVAKDIIMEGRKLSNKGSCPLMYEWHGKKYWGAAHGLAGIMHVLMHTELKLDEQDDVKNTLRYMISNRFPSGNYPSSEDSESDRLVHWCHGAPGVALALAKAYQVFQDDHFKQSAAEAAEVVWNRGLLKRVGICHGISGNAYVFLSLYRLTGNVEYLYRAKAFACFLLENADRLIAEEAMHGGDRPFSLFEGKAGMAYLLLDMVNPSESRFPAYEL

SEQ ID NO: 45143 - protein, 390 aa, Pasteurella multocida
MKKITIAGAGYVGLSNAVLLAQHHNVILLDIDQNKVDLINNKKSPITDKEIEDFLQNKSLTMMATTDKEVALKNADFVIIATPTDYNTETGYFNTSTVEAVIEQTLSINPQATIIIKSTIPVGFTENMREKFNTPNLIFSPEFVREGKALYDNLYPSRIIVGSTSYQAKVFADMLTQCARKKDVTVLFTHNTEAEAVKLFANTYLAMRVAFFNELDTYASLHHLNTKDIINGISTDPRIGTHYNNPSFGYGGYCLPKDTKQLLANYADVPQNLIEAIVKSNETRKRFITHDVLNKKPKTVGIYRLIMKSGSDNFRASAILDIMPHLKENGVEIVIYEPTLNQQAFEDYPVINQLSEFINRSDVILANRSEPDLNQCSHKIYTRDIFGGDA

SEQ ID NO: 45144 - protein, 147 aa, Arabidopsis thaliana
MICTESNHQRFSFAGDLGQSDKGTPMEQQPSGPVRRDTTLLDSSNSDFEFHISSNFDPGDSSPADEIFADGMILPVLPFQVTATSTMPKRLYKYELPPIVSAPTLSSYLPPLPLPLPEHSRKYSVKDTRGSLKNEGAEGRIRLNLQD

SEQ ID NO: 45145 - protein, 305 aa, Brucella melitensis 16M
MGGFASIGECMIELSGNEGDQWRMGFAGDTLNTAWYMRALTDKSYPVEYVTAFGEDSFSQKQRVFLTSNGIGIAHSPVIGGLHPGLYAITLDGAERSFTYWRSNAAARRLACDRDALEKSLAGRDMIYFSGITLAIILPEHRATFFDILHQCRAAGSRIAFDPNFRQQLWPDRKAAREIISNAMGIADIALPTFPDEQALFGDRDAAACAKRIAALGGGEIVVKDGTEPALVAAGGECTLVPSAAAQAIDTTGAGDSFNGAYLAARLNGLAPVEAARKAHLVAARVVEIRGALAPMETARATFAG

SEQ ID NO: 45146 - protein, 342 aa, Brucella melitensis 16M
MRALQLLDDRRLEITDIAPPPLPGMGEVTVRIKAVALNHIDVWGWRGMAFAKRKMPLVIGAEASGVVDAVGPGVSNLLPGQLVSIYGARTCGLCRACREGRDNLCEHVGGVHGFHLDGFACEAVNLPARLLVAAPPGVDAIGAAVAPVTFGTVEHMLFDNAKLEPGETVLVQAGGSGIGTAAIQLAKKMGCTVITTVGSNDKIEKAKALGADHVINYREDRFEGVVRKLTKKKGVDVVFEHVGADTWAGSMLCMKRGARLVTCGSTSGVSTNMNLMQLFQQQLKIFGSFGCRMENMADAMQKMARGIVHPVIDTVVGFSDIDTALKRMEGRDVFGKIILQID

SEQ ID NO: 45147 - protein, 362 aa, Oryza sativa Japonica Group
MEEHLLPVVHRDQVYSSRQDRRKSSDVPNRFVTSFHPSTNSKDEFNEQSHAAQHVPSFARQAIVSVILYISIGVLVYITNVEGFKGRSTLKLVDGLYFTIISLCTIGYGDIVPCTTFTKVFTCLFLLIGVRFVDIVLNELLTNVLDKQRTVLLSTMDDNKLNRVFDTYMIDAEKKRSRGRMKVLLALGVVVGTISICTIIVHEVEGLNWIDSFYLSVISVTTVGYGDYGFSTPAGRLSATVCLLVSTLAVAKAFLFLTDLRMDRRNRKTTKWILQKKMDNEPLAADLDHDASCDLLYSRQLSSPNFVVFFFLCHSKSDFLIYKLKEIGKIDDKDIAMISDQFDQLGLAKCGKITLADIIGKL

SEQ ID NO: 45148 - protein, 272 aa, Brucella melitensis 16M
METGFWIKTRASKHLERFQRFRFNRNRSRIFAVPVIRASHAAKETIAMRPIAIAPSILSADFARLGEEVDAVLEAGADWVHIDVMDGHFVPNITFGPQVVKAIRPRTKAFFDAHLMIAPCDPYLEPFAEAGCDLITVHAEAGPHTHRSLQSIRALGKKAGLALNPATPAEALTNVLDDLDLILVMTVNPGFGGQKFIAPMLDKIRRVREMVGDRPIDIEVDGGITPETAGSVVAAGANILVAGSAVYKGNSVESYRANIDAIRAAAEAARNR

SEQ ID NO: 45149 - protein, 172 aa, Nostoc punctiforme PCC 73102
MDLKSLVRDIPDFPKPGILFRDITTLLRDPEGLRYTIDFLTQKCKEAEIKPDYVIGIESRGFIFGSPLAYQLGAGFIPIRKRGKLPAAVHSIEYDLEYGTDCLEVHQDALRHSSRVLIVDDLIATGGTASATAKLVQKIGCELVGFGFIIELRDLEGRKYLPDVPIISLIEY

SEQ ID NO: 45150 - protein, 1127 aa, Solanum demissum
MADFQRSSLADRDIDQAIAALKKGANLLKYGRRGKPKFCPFRLSNYAVAEDRKNALKSLFSQNLDIKDESAVVWYHDKEEKQLELCHVSRIIPGQRTAIFQQYPRPEKEYQSFSLICNDRSLDLICKDKDEAEVWITGLKAIITRGRSRKGKYDARSETVFSDSPHGQRVTTSTSSIDQGDNQRTESLPQSRLGKAYADIIQYTAAGKSPTLVETGSFNLSSLSAGAVDNSNARSSTADTFRVSLSSALSSSSQGSCLEDFDNLGDVFIWGEGTGNGLLGGGKHRIGKSSGTRIDANTPKSLESSVVLDVQNISCGNRHAMLVTKQGEAFSWGEEAGGRLGHGAETDVSHPKLIKNFKGMNVELIACGEYHSCAVTSSGDLYTWGDGAKSSGLLGHRSEASHWIPKKVCGLMEGLRVSHVSCGPWHTALITSAGRLFTFGDGTFGALGHGDRSGCITPREVETFNGLKTLKVACGVWHTAAVVELMSGLDSRPSDAPSGTLFTWGDGDKGKLGHGDNKPRLAPQCITALVDKSFSEVACSYAMTVALTTTGRVYTMGSNVYGQLGCPLANGMSPICVEDYLVDSTVEEISCGSHHVAVLTSRTEVYTWGKGENGQLGHGDCENKCTPTLVDILRDKQVKRIVCGSNFSAAICVHNWALSADNSICFGCRIPFNFRRKRHNCYNCGFVFCKACSSKKSLKASLAPSTSKPYRVCDDCYDKLQKAIESEPFSRVPKVKAGNALYKASEQTDKESGFPLLVGHTSRLSSSDSFNRAQGRISRVDQYENRASSFQNENPPRESFSLSKSPISAFRVSKSLFSASLPSTRVVPQSTSPLLGKASALWSAIPAPYPPVRTAEVVVDNLKPINDSLSQEVKQLKAQLEAMLLGLFKNANGIRDGCGIKSEESAQLRLEELASKSQLLEAELGRKTKQLMDATAKAAVEAEKRRAAKHVIKSLTAQLKEVTERLPEEQISTSNLDFNVEQTSFNRTRPSNGKCVTTTTLTECSGSSNTVVSAKKSRGQKPERMLQVEPGVYLYLISLPDGGNELKRVHFSRKCFSEDEAEKWWNENGQKICEKREGRLSNGFLQSSLLFAITQETLVIFEQLDICIQTRTRSSSIQESAEDRGKS

SEQ ID NO: 45151 - protein, 236 aa, Rhodococcus sp. RHA1
MPYVERSGDVFVLYFGEEGEPDSENAFHPDWIDRVDSLLDRIEQHDGPAALVTTGLGKFYSTGLDTAWVVANTDKLNSYIDRVQALFARILTFPLPTVAALTGHTFGGGAILAAAHDHRVMREDRGYFCLPGITIGASYAPGSIALLAARLPARAVHTALVTGRRYGGVAASELGFVDEVAPEQQVLTRAVEHAQGLVATRGRTLGEIKSSLYADAVASLRTPVANLESQEALNGG

SEQ ID NO: 45152 - protein, 273 aa, Solanum demissum
MVKAIIAPSMLSSDFANLASEAERMLNCGADWLHMDIMLSHTLTNSMTYLYLLALTSNKYQITLSTKARTDEKKLLIVFVIGSLALHSSAVTECCICALQDGHFVPNLTLGAPIIESLRKHTKAYLDCHLMVTNPLDYVEPLGKAGASGFTFHVEASRDNWQELVQKIKSKGMKPGVSLKPGTPIEEVYPLLDGENSVELVLVMTVEPGFGGQKFMPEMMDKVDGGLGPSTIEAATSAGANCIVAGSSVFGAPDPAQVITLLRGSVEEAQKRS

SEQ ID NO: 45153 - protein, 450 aa, Geobacter sulfurreducens PCA
MSPHQVDEKLQGIYQDVLKRNPGEVEFHQAVAEVLESLGPVVTKHPEYLERKIIERICEPERQIIFRVPWQDDKGQVHINRGFRVEFNSALGPYKGGLRFHPSVYLGIIKFLGFEQIFKNSLTGMPIGGGKGGSDFDPKGRSDDEIMRFCQSFITELYRHLGEHTDVPAGDIGVGGREIGYMFGQYKRITNRWEAGVLTGKGLKWGGSLVRTEATGYGATFFINEALKVRKDSFDGKICTVSGSGNVAIYTIEKIHQLGGKCVACSDSNGVIFHEKGLDLDLIKQLKEVERRRIEDYASYHKDAKYIAGGNIWDIPCQVAMPSATQNEINGKDAKTLVKNGCIAVGEGANMPTTPEGVKVFLDAKIAYGPGKAANAGGVATSALEMQQNAQRDSWSFEDTEKKLENIMKGIHRLCHETAEEYGATGNYVLGANIAGFTKVADAMVAHGLV

SEQ ID NO: 45154 - protein, 180 aa, Vitis pseudoreticulata
MASSMVSSATVATINRATPAQANMVAPFTGLKSLSTFPGTRKANTDITSIASNGGRVRCMKVWPTEGLMKFETLSYLPPLTDEQLSKEVDYLLRMNWIPCLEFTKLYPYPHREHNRSPGYYDGRYWTMWKLPMFGCTDSAQVIKEVQEARTEYPNAHIRIIGFDNNRQVQCIAFIAYKPS

SEQ ID NO: 45155 - protein, 452 aa, Pseudomonas aeruginosa
MRLCVIGAGYVGLVTAACFAEMGNQVRCVERDRERVARLRRGEMPIYEPGLESILRDQLDAARLTFTASLAEGLADAEVVLIAVGTPCGEDGSADLSHVLAVAEQLGAQLRQACIVVNKSTVPVGTAERVEEIIRLGLARRRKRFRVAVASNPEFLKEGSAVDDFRRPDRVIIGSAETQAGETLRQLYAPFLRNHERVLLMGRREAEFSKYAANAFLATKISFMNEMAGLCALTGVDIEDVRRGMGSDKRIGTHFIYAGCGYGGSCFPKDVRALIRSAEQQGYDSQILRAVEARNARQKELLFETLGELFQGRWQGRTVALWGLAFKPGTDDLRERRAWSCWRRCCATGCGSGPMIRWPTPGSRHAIRKLCLRPIDAPRLALRGRRGRRCPGAGDRVETVPPAGLPENPWIHANSPVGRRSESLRTGRMAELGFIYQGIGRPRAGHCKASAR

SEQ ID NO: 45156 - protein, 270 aa, Vitis pseudoreticulata
MGSSLLLPLLCAGMVTMATLFLPSSFASEAHPSAYGSGSCNGELIPVKREVYANGRIFDITHPYTPNMPTFGTDEGIGEVIWLEKSMKNGSITNNSHMKMPTHTGTHVDSPGHVFDHYFDAGFDVETLDLEVLNGPALLVDAPRDKNITAEAMESLQIPKGVRRVLFRTLNTDRKLMFKKEFESDYAGFTEDGARWLVENTDIKLVGIDYVSVATYDHIVSAHLPFLEGREVILVESLKLDDVPAGMYNVHCLHLRLPGAEGSTHKMHSH

SEQ ID NO: 45157 - protein, 278 aa, Pseudomonas aeruginosa
MIKKCLFPAAGYGTRFLPATKAMPKEMLPVVNKPLIQYAVEEALEAGLSEIGIVTGRGKPSLEDHFDISYELEHQIRNTDKEKYLVGIRRLIDECTFAYTRQVEMKGLGHAILTGRPLMAATFSVVLADDLCLNLEGAQVLKQMVKLYNQWRCSIVAIQEVPPEETNKYGVIAAEMIRDDIFRVNTMVEKPKPEEAPSNLAIIGRYILTPDIFDLIEQTEPGKGGEIRVTDALMKQAQDGCVLAYKFKGKRFDCGTAEGYIEATNFCYENLYKTGKAH

SEQ ID NO: 45158 - protein, 331 aa, Coccidioides immitis RS
MSRYAEVHKQPAGPGDARPTALQVIEDEGLEGNMKDKVFLITGCSSGIGIETARAIAATGARVFLAVRDLTRGRTACESFLEPGRVELLQLDTSSLSSVKAAASNFLEKSQTLNVLICNAGIMMIPTYEESADGFEIQLATNYLGHFLLFWLLKEAMLKASTPDFNSRLVNVSSSGHHASEVQFEDINFHRGGAYAPSKAYGQSKLAQIYMANYVDRHYGPAGLHALSLMPGGIFTNLQKHVPQEIKDGWTSNPEIMMVLKSHEQGAATTVVAAVAKEWEGRGGKYLEDCEASSPEALVQGFRGFKEYAFDEGKEERLWELTLDMLGLAEA

SEQ ID NO: 45159 - protein, 192 aa, Gibberella zeae PH-1
MGVQKKTRKFAEVKRVIGRRDARLKENKLKAELAQKEKEKKTINGEVIREAPQMPSNMFFQHNTALVPPYSVLVDTNFLSHSVQRKLSLLDSMMDCLYAKCNPIITSCVMAELEKLGPKYRLALRVARDERWTRLECDHKGVYADDCLVDRVQKDRIYIVGTNDKALKQRLRKIPGVPIMSVARAKVDCSRG

SEQ ID NO: 45160 - protein, 389 aa, Xanthomonas axonopodis pv. citri str. 306
MNFHEYQSKQLLAEYGIPVPAGKVAATPDEAVEVANSLGNGPWMVKAQIHAGGRGKAGGVKFCKTTDDVKAAAAKMLGTKMSTYQTAGVELPINLVLVTTAGEIVKELYLSILVDRGTKTITYIASSEGGVEIEQVAAETPELIHALNVDFVEGVQGYHGRDFGFKLGLNAKQAGQFASIMVNLYKLFNEKDLALVEINPLAILDDGNLYALDGKFDSDDNAAFRQKQLVAMRDKTQEDETEVTASELDINYVTMDGNIGCMVNGAGLAMATMDVIKLNGGEPANFLDVGGGANKQRVIEAFKLILSSDKVEGIFVNIFGGIVRCDMIAEGIIAAVKEVGVKVPVVVRLEGTNVEEGKQLLRDSGMAIIPADNINDGAKKVVEAVKNAA

SEQ ID NO: 45161 - protein, 271 aa, Klebsiella pneumoniae subsp. pneumoniae MGH 78578
MVMDKKIGFIGCGNMGKAILGGLIASGQVQPGQIWVYTPSPDKVAALRDQYGINAASSAQEVAQIADIVFGAVKPGIMTKVLGDIASSLNKESLVVSIAAGVTLEQLARALGHDRKIIRAMPNTPSLVNAGMTSVTPNALVSSEDVAEVLTIFRCFGQAEQIAEPMIHPVVGVSGSAPAYVFMFIEAMADAAVLGGMPRAQAYKFAAQAVMGSAKMVLESGEHPGALKDMVCSPGGTTIEAVRVLEEKGFRSAVIEAITQCMEKSEKLSRS

SEQ ID NO: 45162 - protein, 445 aa, Oryza sativa Indica Group
MEVSASAAAEAGMMVGHGEWRDDDGRARRTGTAWTASAHIITAVIGSGVLSLAWAIAQLGWVAGPAVMLLFAFVIYYTSTLLAECYRSGDPCTGKRNYTYMDAVRANLGGAKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGAGVTSMQKDTIKAPPPSEAKVMKRATMVSVATTTVFYMLCGCMGYAAFGDRSPDNLLTGFGFYEPFWLLDVANAAIVVHLVGAYQVFVQPIFAFVERWAAARWPDGGFISRELRVGPFSLSVFRLTWRTAFVCATTVVSMLLPFFGDVVGLLGAVSFWPLTVYFPVEMYIAQRGVRRGSARWLCLKVLSAACLVVSVVAAAGSIADVVDALKVYRPFSG

SEQ ID NO: 45163 - protein, 465 aa, Xanthomonas oryzae pv. oryzae KACC10331
MPEPSSTTAPQFRRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVITILVFIVLGGAAVIGLLPLADGSPAPGLRHLRADGWFAHGTLPILMTMVAVNFAFSGTELIGVAAGETEQPARAIPLAIRTTLMRLVVFFVGTVLVLAALLPAEQAAVETSPFVRAFELLGIPYAADLLNVVILTAILSAANSGLYAAARMLWSLANEGTLPSGLTRLTGRGIPLRAVSLSMLGGLLALLTGVYAADTVFVAISAVSGFAVVVVWLSICASHYVFRRQLLRDGVAPETLAYRARWYPWTPILGFSLCLLACIGLAFDPQQRIALWCGVPFVALCYGAYALTQRLAARRLHA

SEQ ID NO: 45164 - protein, 773 aa, Oryza sativa Indica Group
MGISNALQWWEEWQLRVLVLGSLAFQYFLFITASRYKFPIRSYLRSFIWFVYLGSDALAIYALATLFNRHKKQDVGHTHNNDVLEILWAPILLIHLGGQDSITAYNIEDNELWMRHVLTALSQITVAIYVFCKSWPGGDRRLLQSAILLFVPGILKCLEKPWALNRASINSLVSFDEKVRRTTNRQGKQIDSIEDFVRSARGFFCGNDHLEKPSRSADFTPDELFVDLASPCSDNRVRKLMSFSALCGDEAYYLLQNNLSDTFDLLYTKEKMFPKTPPTEELETGLHHFVELCKQLAQSPYPPFSSLSEFFGTVIRELAMFLPFTAIGLFHQSNRKSYNDKDVKVTYALLCCTAVIELYNPFVKVFTSLTLNQRSSLPNMNSTVSKLSQRPRQRYLYQLQDDMVSQYNLLGYFVRNKKHSTIMNFVGFFGCKNYLDRRWRMKSCFSSRSITNVVLGHVKRWWKDHITDVFTYRMFNDIRGQWSLKVEGCFQGLGWSLEGAFDEIVLLWHLATDLCFYHISPSHGREHATTMCIERSSGLNNRCPTWCEKSIHHKNAVQCREMSNYMTYLLFVNPEMLMPGTRRNLFTDAYNELKGVVKEKNPPLDERELAERIIAEVQQQLEEITGEDKSPSSKRGLIEDAWSIAEELLKLEDDEKMCRVIEGVWVEMLCFSAARCRGYLHAKGLGTGVEFLSYVWLLLHYMGMETLAEKLARGDLQNRGHSGNLRTFHVRESSGEEQVAGPSTSYANGDNGDQHVVAPFSEDGFTLAGDENV

SEQ ID NO: 45165 - protein, 806 aa, Bradyrhizobium japonicum
MLLDLASRDGEFKEVTARMRRLMLNLLGGAKDYSVVPIQGGGSFAMEAARSSFVSRNDKPLVCINGIYGERIFKILRLWGVEALKLVKRATEPLDPQEVAEQLSRNPGVTHLCLVHCETTTGIVNPLDAIIEEARRRGVKTIVDGMSSFGAIDIDLSRGGPDVLVTSSNKCIEGPPGLAFVIASRELLEKAVQEPRSFVLDVTHQWLSLERTGEWRSTPPTHIVQATTKALEILEGEGIDARRRRYEKVRDDLVQELEGVVSPLLSAELQSPVCVAFSAPSGIADQAGFDGLYRHLAAHNLYIYSKLHLATRSFRVGCIGEIQPSWIEQLGCAFRTYFRSGPASSMGTPSTRQACERGVEMSSSFAKDSQLPFSAETAVLHAGYRRDPVTKAVAVPIYQNTAYELDGDLNHIADVYNVKADGFTYTRIINPTTRALEKRYAAVDMGSDSLAVASGQAATFLAILNLSSGEVGDNIVASPYLYGNTWNLLHNTLKRLGISVRTADPRRPETFERAIDDRTICLFGEVISNPCLIPLPVKQLAEIGRKHGVPLVVDNTTTPLVCRPSDLGAAITTYSATKYICGHGTTLGGLIVDNGKFSYRGASRFPLFNSPDEAHGGIIWRNALQDVDDLGKSEVLLKARMTWLRDTGAAIAPFASFQLIQGLETLPLRMKQHCANARIVADVLKEHPKVRRVFYPGLFEGADRETVDQTLNPAYGHGAMVMFEVEDEQAGRKFIQNVDLMYHVSNVGDARTLVTHPVSTTHTTVPREKREPPAYLAARSDFAWASKMSTTSCAIWTGRFPQSDNL

SEQ ID NO: 45166 - protein, 117 aa, Sorghum bicolor
PGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 45167 - protein, 248 aa, Rickettsia conorii str. Malish 7
MNQTNFGFKKVDYTKKQGLVNNVFSNVADKYDLMNDLMSLGLHRLWKDEFIRQIPNLNSHILDVASGSGDIALKLAKKARDRVNNISLTLSDINEEMLKQAKKKAIDLNLFQNLKFTVASAEELPFPDDSFDYYTIAFGIRNVPDINKALKEACRVLKPMGKFICLEFSKVKEGYIKDFYKFYSFNIIPSIGQMIAGNKEAYEYLVESIDLFPSQDEFRIMIKDAGFEEVGYKNLSGGIVAIHSAYIQ

SEQ ID NO: 45168 - protein, 209 aa, Rickettsia conorii str. Malish 7
MKVDSLHNLSYKEEFEGDMKRSTAAYKKVSEDASIGSTYIADISEVGSQISGEPVQRIKIPEHRQILKRSLIKPVIMAGGNGKRLWPLASKDKPKQFKKILSDLTLLQQTLNRNKFLGQPTIITSKKYESITKEQATEIDVEIALITEPLQKNTAVCAIITALSATALGFDIVVLLPSNHHIADDINYLNTINKALHYVNECGICTIFL

SEQ ID NO: 45169 - protein, 266 aa, Zea mays
MGYAQLVIGPAGSGKSTYCSSLYDHCQTVGRTIHIVNLDPAAEHFDYPVDMDIRELISLDDVMEEIGLGPNGGLIYCMEHLEDSLDDWFDEQLENYLDDDYLVFDCPGQIELFTHVPVLRNFVEHLKRKNFNVCAVYLLDSQFVSDVTKYISGCMASLSAMIQLELPHINILSKMDLVSNKKDVEEYLDPNAQVLLSQLNRQMAPRFGKLNKCLAELVDDYSMVNFIPLDLRKESSIQYVLSSIDTCIQYGEDADVKVRDFEEDED

SEQ ID NO: 45170 - protein, 175 aa, Rickettsia conorii str. Malish 7
MRHLHYIPINVISAKYGYINTGLSIAENVYLVDHLIEQPILEQANKHFQSNEYFWNSGICVYDVNFFLNLAMNLQPDLFCIAEKAFNTAVKNENSLAIDNEAYNEIAAISIDNTIMEYISGMVMIKADFAWNDLGTWHSLLQVKHRNINYNYCEGNVVTSNTTNSFISSNNKLRS

SEQ ID NO: 45171 - protein, 816 aa, Coprinopsis cinerea okayama7#130
MLPTPLTPQELIVVQTTAVATGTMPLAAGFVGILPALSLLDEERDGSPAIRLDWWSALWWSCGVAFFGVFLSPPLRKQVIIEEELPFPSGTATAQMISVLHKLPPPDTQVHRRRGYQQVDEDEVNVAPAEETEVADPQREESDGLEREAVQHDGWHDLIWSFSAAGGLTLFAYFFPAVFTIPIFGTYLAKEWLWYFTPSLSYVGQGIIMGFPTTVSMNLGMLVGWAVLSPLAKLSGWAPGPVGDMSNGARGWILWVSLGIMCVDSLVSLLPVVVEYAADLIWPLRRHYSRIGDNGVAKREDHEVETPNRLVPTSWVLIGLVSSITVGTCLVWLVFGHDGIKPWATVVGFIFGGFLSVIGVRALGETDLNPVSGLGKVSQLLFAWIQPGNVVANIIAGGVAEAGAQQAGDLMQDLKTGHLCRASPRAQFYGQLVGSAVSVVITTTAFTLYNRAYEIPGPSFPAPTAYVWLGLARLLRDGQLPENSATFMVGFSLIFGILSGAKTYASRNQLWYAQWIPSGVAFAIGFLNTPSFSIARLIGGTIEYIYRTRYARKDGGDIRLVVVAKLAKIRSLTFYKDELTAARRTSAIPQLKCVNTGGDGVDIDWRCEADLPEALRFGKVEVSCEGWSRPGDPYVLKGSCALEYKLVQVPDALRGGKTDSPILGSWKEWDTSEIIFWVVWISILLFIVYNFLKSCFGNDRQVARTAGNNRPGPSPGGGWGRWFPRDDHDDYRPPPPPYSKDPPGTSTWDNWRPGFWTGAALGGLANQWWNNRNRRVYEPEPEPILRPGWFVSRASEERDQCMTILIVEKALRILGP

SEQ ID NO: 45172 - protein, 446 aa, Oryza sativa Indica Group
MAMGAASLLPQPARGAAARLLLPASGAARGAAARLPLPEPPCARLPLPEQPWGAAARLPQSEPSWGTTALPPEPPWGAAAHPSAPHWGAGPSRPALPSSKLVPLVLERRTRKLKSSIYLHLENYKISNLTGHGDSMEWTNEHTTIVCQLFAQQVVKGNRPNTHLNSVGYDEVIQLFRQITGIELSKRQLRNKWDKMKPDFVAWQKLMRQQTGTGWDHSRGVIVMDDEWWRKAKKDIPGCGKFRKKPLQNVDDLNIMFSDIINDAFDHWNPMSENPIIPEHMTEEVQEDNLVVDDEEVQETPMEEMNDEAHECHEVSPSIGIGKRRSRAVLDKGKKPKIGTALVIQEQITKIAESASSFTSKKSNEVTVQQIMDLILDCGADYGSDEHFIATELFVKKDQRDMFMTLPNKEFRFNWLRRKYNAKYGACSILAVMQAFLLFHNFSHLK

SEQ ID NO: 45173 - protein, 468 aa, Vibrio angustum S14
MATGKIVQIIGAVVDVEFPQDSVPQVYDALHVDAKENGTLVLEVQQQLGGGVVRGIAMGTSDGLRRGLSVENTGRPIEVPVGTATLGRIMNVLGQPIDECGEIGEQERYAIHREAPSYEDQSNVTELLETGVKVIDLICPFAKGGKIGLFGGAGVGKTVNMMELINNIALKHSGLSVFAGVGERTREGNDFYYEMQEAGVVNIEKPEESKVAMVYGQMNEPPGNRLRVALTGLTMAERFRDEGRDVLLFIDNIYRYTLAGTEVSALLGRMPSAVGYQPTLAEEMGVLQERITSTKSGSITSVQAVYVPADDLTDPSPATTFAHLDATVVLSRQIASLGLYPAIDPLDSTSRMLDPLVVGQEHYDIARGVQSLLQRYKELKDIIAILGMDELSEEDKQAVSRARKIERFLTQPYHVAEVFTGDPGIYVTLKDTLRSFKGLLAGEYDDIPEQAFMYCGAIEDVLENAKKL

SEQ ID NO: 45174 - protein, 523 aa, Methylobacillus flagellatus KT
MIACCLALVPIHPNSKEAIIMSTNTADIGLIGLAVMGQNLALNIADHGYTISVYNRDPEKTRKFIAHCKENEPSADNLKGFEDLATFVLSIKRPRKIVLLVKAGSATDVTINALVPFLEEGDIIIDGGNALWTDTIRREKELRAKGLEFIGSGVSGGETGARFGPSLMPSGTRKAWFHLEPIWRDIAAKVDPRTGKPIEGAAPGKPVQGGFSCAEYIGPDGAGHYVKMVHNGIEYIDMQLICEAYWLMKNLLGMRADEIGQVFEEWNKGELSSFLIEITGDILQQKDPAGDGFLVDKILDAAGQKGTGQWTAANALELGSPANAIAAAVFARALSTLKAERVEASTILKGPTVKLESDREQLIEAIRNALYCSKICAYAQGFQLMDKAQVAYNWKLNFGEIAQIWRGGCIIRARFLQKITDAYALDSRLKNLMLDPYFTEALDEGQASWREVVTLAVRNGIPAQAFCAALSYYDGYRSASLPANLLQAQRDYFGAHTYERTDQPRGEFFHTDWPEPGRPQFKV

SEQ ID NO: 45175 - protein, 1017 aa, Solanum demissum
MESRMEHYEIMEQIGRGAFGAAILVNHKQARKKYVLKKIRLARQTKRCRRSAHQEMALIARLQHPFIVEFKEAWVEKGCYVCIVTGYCEGGDMAELMKKANGQYFPEEIVDYGHGKTSLKLIYELICSIGWGNIPTQFLDDTNTKSNPAYTVWLREDQLVLSWIVASVSESILPQLVGATTARAAWDKLVAAYASGSRPYIRELKSQLHTLRRDNVSIESYVQKAKGIADKLAALQHPVPNDDLVEFVLAGLGPFYRPFTRVPFLPPVDVVETEEAEVVGVPPITSSNRLKIVGLITMHIPILHHLKFQICLQLFVITVKDLATRDILHTGPSEDGLYSLPMLKSSAPASYAASLGVWHARLAHTSLPTVRQALSSSVIVPSFKSSSLCSTCAISKSHKVHFRDSSFQAFGPLDLVCSDVWVLLQLFQMKDWGGEYQALTNYLRDNGIVQRSSCPYTPEQNGCAERKHRHIVETGRALLHHANVPHKFWTNAFDTVDVVVPPSITNAKSDPLNVTLPFQNYVSPSSVPPMMPQSSVPTPTSNQPSLSPSIESLTNPRSLTYVDPITGHTHATDPPSQDDVSHGVALISPSVVAENPHSSNTSHSGDFGNTSAVGSLKPKKPFSMSTTTPTSAIVEPSCHSRAIKDVHWRHAMSEEYNALIQNGTWELVPLSPSQNIIGCKWVFKRKLKSDGSLDRYKARLVAKGYHQRPGLDFADTFSPVVKPATIRLLLSLAVSHQWHVTQLDISNAFLHGKLDEIVYMSQPPGFVDPTRPDHVCLLKRSLYGLKQAPRMWNKCLADVLLSLGFVGSKTDSSLFYLPNVDVKLLCLDYLEDILVVGSNSDHIAALITNLKTHFVVRDLGKLSYFLGIQANWKPEGLHLSQGKYVTDLLNRVQMGSCGPVSTPASSSSKLSNTGGCPFHDQTLYRSTVGALQYLTFTRHDIADSDWGGDVDDRKSTTGFTIFLGSHLISWASRKQRAVSRSSTEAKYRALAAATSKMTWVEHLLREIGCYTTSVQPT

SEQ ID NO: 45176 - protein, 529 aa, Geobacter sulfurreducens PCA
MNAHELWQRYQTYLLFDADTGLILDVSRMAFSDDFFASMEPAMQRAFDAMERLEAGEIANPDENRMVGHYWLRSPELAPDPAIAAAIRETVDRVTAFAADVHNGVVTAPRARLFRNVLVIGIGGSALGPQFVADALGGHGDRMRPFFFDNTDPDGMDRVLETLGADGLAETLAIVISKSGGTKETRNGMLEAEAAYRRAGLDFSRHAVAVTGAGSELDRTAEAGGWLCRFPMWDWVGGRTSETSAVGLLPAALQGIPIRDFLDGARTCDTLTRRRETLRNPAALLALMWHHATRGSGSRDMVVLPYKDRLLLFSRYLQQLIMESIGKELDLDGTVVNQGLTVYGNKGSTDQHAYVQQLREGTNNFFVAFIEVLKDREGASLAVEPGFTSGDYLSGFLQGTRTALSEKGRESLTITIPAITPRTVGVLVALFERAVGLYASLVNINAYHQPGVEAGKKAAGGVLALTGEALAFLRREGGTLSATEIAAALGRPEEAETIFRSLLHAAANPDHGVVMEAASPLTRSRFSAR

SEQ ID NO: 45177 - protein, 501 aa, Synechococcus elongatus PCC 6301
MFEVEVHQLLRRWLREQTAEDAWPHHLSVARLAARSLRLQQPTLLHLPASGGDRLYLCSVLLPLLLWQGPVVILAAPPLRDRLLHREIPLLQSHFNLAKSLLIADQLPRPDFQGVWLTDLDRWRSHQADYPHWPLAVMAADDFEAQLITAASAVITPQDWEVLRCCQPAAQGQLQDWQARLTFQLFQRPINPTGTYRLEAADLEPLQIWLRSQLDLPAAWQTWLQVPVPAVEVAQLDRATGQFQLWRQPLAIAELAAPLWRDRPLLLAAEACDAAGQAPAWIRRLGLPDPVSAQFGSDRHAPGLRLFLPRQAVLPNTPHFQQALLHELRLLLLWLGNQSVVLIVDDRPLQQQVASALAAEWGSRVQVGATAKLADNSIHLCSMSTWLGLQSQRPTPTAIAIASLPFASAEQPLTAARIEFYKQQRWDWFREFLLPDALMQLQQAIAPLRKNSGLLAIYDGRLQRRSYGQAFLEAIAPSEHLRQLSFENQANPWLAPEDSSL

SEQ ID NO: 45178 - protein, 423 aa, Chlamydomonas reinhardtii
MVYGGAVDCVIGRPPPGVGDVVVVCDANRRSIGWGVFNPHSMFRVRMLALQTEEDAQPSGPLAAARLDVGALLRLRLGQAAALRRSMGLPGPETNVYRLVNSEGDRLSGLVADVLGDTVVVQVVAGWVQRYRSDVEAAIREATGLSRIVWRPAWRILAEEGLTPPPEEQQQQQEGAKAGAEEESEAEQAERVEVREAGLRYWASPMGQKTGFYADQRDSRAFLARVVRAQAQQASGSSSGSSGSGSAGPTVLDLCCYSGGFALSAAAAGASRVVGVDSSEAAVQLAAANAELNGLGGVASFVRADVSDYMREAVQQGHQYDVVVLDPPKLAPDRNSLARARIKYTRLNSLAMRLVKPGGLLITCSCSGAMTQSGEFTEMVIEAARQVGRQATALREAGAAPCHCLNPAYPEGEYLTNLTLRLL

SEQ ID NO: 45179 - protein, 199 aa, Zea mays
  misc_feature (37)..(37): Xaa can be any naturally occurring amino acid
  misc_feature (58)..(58): Xaa can be any naturally occurring amino acid
  misc_feature (85)..(85): Xaa can be any naturally occurring amino acid
NSSYNVRLLWLPSAKGILAADDPTGTIGKSLSTIHVXNDVENLRDLRELLFCCPGALXNIMRVILFKDTLNQKTKDGKPFVDVLXEGGVLPGIKDDYGTIEVAGTDNETTTQGHDDLDKLCPKYYEARARFVKWHDVLKSVPNDASQVVIHLNAQGLARYGIICHENGLAPTVEPEILVDVPHEIDICSYLTETVHADC

SEQ ID NO: 45180 - protein, 529 aa, Yarrowia lipolytica CLIB122
MRAVAPDIDIQLCSVFVNSLVPHHHIEFDKKAQMHSPSSSNNMFTGKSNVWGNSQMTRLFILTLTIAGLQFTWGVEMSYVNVYLLSLGMSKSTISLVWAMGPLAGLVTQPVVGLLSDSCTSRYGRRRPFMVVGSLFVSLSLVTMAWATELSPILFFLNKSISTRVIAVFSVFLTDFSINTVQACCRALIVDILPASLQQAGNGWAARQTAVGHLIGYFLGFLNLVHITNGWMGDTQLKCLCVISSAALLLTVGITSMLTREQVLVKTEQHEPVTLKSVLSHTCGIFTTIFKTATTLPPRMKRIVSVQFFAWYGWFSFLYYSSTWIGEVYQRQHGGVDEDGDKVGKVGRIGSMSLTVFSVVSLIASFVMPFLATNTVFRYKPRLTSIWTGAHIVFSLAMFSTLYVGSVGAATAVIASCGYSWAITTWAPFALMGEEIHRLEGTPLPISQEINETDQLGPNSSATSDAKHTGVFLGIHNIAISAPQFVCTFVSSFVFFLLEGEGDGGRAIAVTFQIGGVMTLIAAYISRAL

SEQ ID NO: 45181 - protein, 759 aa, Pseudomonas fluorescens
MLNTLRKIVQEVNSAKDLKAALGIIVLRAKEAMGSQVCSVYLLDPETNRFVLMATEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSISGLGRQGKGIQEAKFVGVPGSPGAAVGTAVVMLPPADLDVVPDKTITDIDAELGLFKTAIEGVRADMRALSAKLATQLRPEERALFDVYLMMLDDASLGSEVTTIIKTGQWAQGALRQVVTDHVNRFELMDDAYLRERASDVKDLGRRLLAYLQQERQQTLVYPDNTILVSEELTPAMLGEVPEGKLAGLVSVLGSGNSHVAILARAMGIPTVMGLVDLPYSKVDGIQMIVDGYHGEVYTNPSDVLRKQFADVVEEEKQLSLGLDALRDLPCVTLDGHRMPLWVNTGLLADVARAQKRGAEGVGLYRTEVPFMINQRFPSEKEQLAIYREQLAAFHPQPVTMRSLDIGGDKSLSYFPIKEDNPFLGWRGIRVTLDHPEIFLVQARAMLKASEGLNNLRILLPMISGTHELEEALHLIHRAWGEVRDEGTDVPMPPVGVMIEIPAAVYQTKELARQVDFLSVGSNDLTQYLLAVDRNNPRVADLYDYLHPAVLQALQNVVRDAHAEGKPVSICGEMAGDPAAAVLLMAMGFDSLSMNATNLPKVKWMLRQINLSKAQELLAEVMTIDNPQVIHSSLQLALKNLGLARMINPASNKTL

SEQ ID NO: 45182 - protein, 517 aa, Vibrio angustum S14
MSEVKQATDEELLSGADYLRNILRAPVYEVAQVTPLQNMSRLSARIANQIQLKREDRQPVHSFKLRGAYNMMSQLTEPQKAAGVIAASAGNHAQGLALSSQKLGVKATIVMPRTTPDIKVDAVRSFGGVVVLHGSNFDEAKGYAEQLAQQHGYTFIPPFDHPSVIAGQGTIGIELVQQNGHLDCVFVPVGGGGLAAGVAVLLKQLLPEIKVVGVEAEDSACLKAALDAGKPVSLDQVGMFADGVAVKQIGSETFRLCQQYLDDVVTVSSDEICSAVKDIFEDTRAIAEPSGALSLAGLKKYVEQHQIRDQQLAAILSGANLNFHGLRYVSERCELGEKREGLLAVTIPERPGAFLDFCHLIGGRAVTEFNYRYNDDALANVFVGVRLMQGQEELDGIIKDLRKGGYPVVDLSDDEMAKVHVRYMIGGRPSKPLKERLYSFEFPEYPGALIRFLNTLGCHWNISLFNYRNHGADYGRVLCGFELEDKDLLSFTSHLRELGYQWKDETENPAYKFFLAQ

SEQ ID NO: 45183 - protein, 302 aa, Rhodopseudomonas palustris CGA009
MRLQFETVDVFTAEQFSGNPLAVVLNAEGLSAAQMQAIAGEFNLSETTFVLPPQDPAHTAQVRIFTPNGEMPFAGHPNVGTAFVLARIGQSYGRSIAGDRVVFEEKAGLVPIELIKDGGAVTGARLNSPQSLSLVDELAPDVIAAACSLSEGDIEIANHRPCIASCGAAFIVAEVNNRAALTAASPRIEIFRDRIAGAAATSILLYTQVEEDTIDIRARMFAPLHKIPEDPATGSANVALIGLLAKLRPESDLTLSKTILQGFEMGRPSLLFASAEKRGGEVITTAIGGHCVAVMSGTIGLK

SEQ ID NO: 45184 - protein, 505 aa, Geobacter sulfurreducens PCA
MSDNFASPHDRDLDERVRPPGWINPSPAPRYDLVVVGAGTAGLVCAAGAAGLGARVALVERHRLGGDCLNYGCVPSKALIRAARAAHDAGNGAPFGVTGCHGTGVDGAAVMERMRRLRAEIGRHDAAVRFRDLGVHVFFGQGSFISRNALEVDGRRLNFVHAAVCTGARAAAPPVPGLAEAGYLTNETIFSLATLPARLAVIGGGPIGCELAQAAARLGSSVTVIEAAPEILPREDTDAAALVRHALERDRVSFLTAAAVVGVERRSGARTLIVRQGDQSHEVTADEILVGAGRTPNIEGLGLERAGIVADPLRGVRVNDRLRTDNPRVYAAGDICSPYRFTHAADAMARIVVANALFGARQRFSTQIIPWCTYTDPEVAHVGLYEREAGERGLAVDTLTVPLTEVDRALLDGEDEGFARVHLKRGTDRIVGATIVARHAGEMLNELTLAMSAGLGLSAIGRSIHPYPTQAEAIKKLADAWNRTRLTPGVKRLMGIMLTLRRLWR

SEQ ID NO: 45185 - protein, 273 aa, Vibrio vulnificus CMCP6
MKHCEKQKVWQSIVKEARELSEQEPMLASFYHATIIKHESLCAALSYILANKLNTASMPAMAVREVVEEAFAADPNITDSAACDICATVNRDPAVSMYSIPLLYLKGYHALQGYRVANWLWKQGRYALATYLQNQISVACQVDIHPAARIGKGIMLDHATGIVIGETAVVENDVSILQDVTLGGTGKECGDRHPKIREGVMIGAGAKILGNIEVGEGAKIGSCSVVLQPVPPHTTVAGVPARIVGRPQSDKPSLDMDQGFNGKYPNFIDGDGI

SEQ ID NO: 45186 - protein, 145 aa, Vibrio vulnificus
MAPFIFTKKILDGDTIDINNNGDMWRDFTHVDDIVEGVVRIADVLPVRNEAWTVEAGTPASSSAPYAVYNIGHGSPINLMDFVKAIEDKLGIEAKKNFRDMQPGDVYQTYADTADLFAATGYKPQVTVKQGVAEFVAWYRDFYNK

SEQ ID NO: 45187 - protein, 454 aa, Burkholderia mallei ATCC 23344
MKNLQRHLSARHIRFLALGSAIGTGLFYGSASAIRLAGPAVILAYIVGGAAVYMVMRALGEMAVREPVPGSFGHYATENLGPFAGFVTGWTYTLEMVIVAIADITAFGIYMGFWFPHVPQWIWVLAIVAIICGLNLCHVKVFGELEFWLSIVKVGAIVAMIGGGAAILFTGMRLGSGGAPSLANLWSHGGFLPNGVGGLVASLSVVIFAYGGIEVIGMSAGEAKEPERVIPRAINAVPMRILLFYVLTMIVLMSIFPWTGVGANGSPFVQIFSALGVRSAAEILNLVVISAAISAINSDIFGAGRMMYAMALQGQAPRALAAMSARGVPWVTVLVMAGALLVGVVLNYLMPKDVFLMVAASATFATVWVWLMILLSQVAMRRRLGAAEVAALKFKVPFWPVGPALTIAFMAFVIAMLGYFDDTRVALFVGAAWLAILALVFYTRIRPRLAAVAR

SEQ ID NO: 45188 - protein, 422 aa, Glycine max
MVRGLLNKLVSRSLSVAGKWQHNQLRRLNIHEYQGAELMSKHGVNVPRGVAVSSVEEVRKAIKDLFPNENELVVKSQILAGGRGLGTFKSGLKGGVHIVKTDQVEDIAGKMLGQILVTKQTGPQGKIVSKVYLCEKLSLVNEMYFAITLDRTSAGPIIIACSKGGTSIEDLAEKFPDMIIKVPVDVFEGITDEGAAKVVDGLALKVADRNKSIEQVKNLYKLFVDCDCTLLEINPIAETADNQLVAADAKLNFDDNAAYRQKEIFSLRDTTQEDPREVTAAKADLNYIGLDGEIGCMVNGAGLAMATMDIIKLHGGTPANFLDVGGNASENQVVEAFKILTADDKVKAILVNIFGGIMKCDVIASGIVNAAKEVALKVPVVVRLEGTNVDQGKRILKESGMALITAEDLDDAAQKAVKAAYK

SEQ ID NO: 45189 - protein, 263 aa, Escherichia coli
AISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGQGFHEEPQVLHYDSRETNVVLKPGMTFTIEPMVNAGKKEIRTMKDGWTVKTKDRSLSAQYEHTIVVTDNGCEILTLRKDDTIPAIISHDE

SEQ ID NO: 45190 - protein, 345 aa, Vibrio vulnificus CMCP6
MTQTLVNNAYGKEISMTVIGAGSYGTSLAISLSRNGANVVLWGHEPEHMAKLEADRANHEFLPGIEFPPSLIVESDLAKAVQASRDLLVVVPSHVFGIVLNSLKPYLRDDSRICWATKGLEPETGRLLKDVAFDVLGEHYSLAVLSGPTFAKELAAGMPTAISVASPDAQFVADLQEKIHCSKTFRVYANSDFTGMQLGGAVKNVIAIGAGMSDGIGFGANARTALITRGLAEMCRLGAALGAQPETFMGMAGLGDLVLTCTDNQSRNRRFGLALGQGKDVDTAQADIGQVVEGYRNTKEVWMLAQRMGVEMPIVDQIYQVLYQGKDARLAAQDLLARDKKSEGK

SEQ ID NO: 45191 - protein, 439 aa, Ralstonia solanacearum
MTHLALLDSLESAARTTPLIRRFGKVVEVSGTLLRVGGVDVRLGELCTLTEADGTVMQEGEVVGFSEHFALVAPFSGVTGLSRSTRVVPSGRALSVGIGPGLLGRVLDGHGRPADGGPPLDVVEYVPVFANAPDPMTRRLVEHPLATGVRVIDGLATLAEGQRMGIFAPAGVGKSTLMGMFARGTECDVNVIVLIGERGREVREFIEQILGEEGMRRSVVVCATSDRTAVERAKAAYVGTAVAEYFRDQGLRVLLMMDSLTRFARAQREIGLAAGEPPTRRGFPPSVFAELPRLLERAGMSAAGSITAHYTVLAEDESGNDPVAEEVRGILDGHLILSRDIAARNRYPAIDILNSLSRVMTQVMPRDHCDAAGRMRQLLAKYNEVVTLLQMGEYKEGSDPVADAAVQWNDWMESFLRQRTDEWCSPDETRRLLDEIALA

SEQ ID NO: 45192 - protein, 388 aa, Vibrio vulnificus
MKIAVAGTGYVGLSNAMLLAQNHQVVAVDIIKEKVELLNQGKSPIVDKEIEHFFAKKVLNFTATLDKTLAYQGADFVIIATPTDYDPNTNYFNTASVEAVIKEVMAINPNAVMVIKSTVPVGYTARIKQQLGCENVLFSPEFLREGKALYDNLYPSRIIVGERSERAEVFANLLLEGAEKTDVPVLFTDSTEAEAVKLFSNTYLAMRVAYFNELDSYAEAHGLDARQIIEGVGLDPRIGNHYNNPSFGYGGYCLPKDTKQLLANYQEVPNNIIGAIVDANRTRKDFIAESIIKRQPKVVGVYRLIMKAGSDNFRASSIQGIMKRIKAKGIEVVVYEPVLQDAEFFHSRVVKDLNEFKKCSDVIVSNRMVEELADVAEKVYTRDLFGSD

SEQ ID NO: 45193 - protein, 334 aa, Vibrio vulnificus
MKYLVTGAAGFIGSATAEKLNAAGHEVVGIDNLNDYYDVNLKHARLARIENPLFKFVSVDISDRGAMEQLFATEKFDRVIHLAAQAGVRYSLENPHAYADSNLVGHLNILEGCRQNKVSHLVYASSSSVYGLNAKVPFSTSDSVDHPVSLYAPTKKSNELMAHSYSHLYDIPTTGLRFFTVYGSWGRPDMAPFIFTKKILDGDAIDINNNGDMWRDFTHVDDIVEGVVRIADVIPTRNESWTVEAGTPATSSAPYSVYNIGHGSPINLMDFVKAIENELGIEAKKNFREMQPGDVYQTYADTEDLFTATGYKPRVTVKEGVAEFVSWYKEFYNK

SEQ ID NO: 45194 - protein, 124 aa, Artemisia annua
YCHYVAGLVGIGLSKLFHSSGTEILFSDSISNSMGLFLQKTNIIRDYLEDINEIPKSRMFWPREIWSKYVNKLEDLKYEENSEKAVQCLNDMVTNALIHIEDCLKYMSQLKDPAIFRFCAIPQV

SEQ ID NO: 45195 - protein, 515 aa, Vibrio parahaemolyticus RIMD 2210633
MMESQPEKKANQSGADYLRQILRAPVYEVATVTPLQEMPRLSARIGNNVQIKREDRQPVHSFKLRGAYNMVASLTEAQKAAGVIAASAGNHAQGMALSGSKLGIKTTIVMPKTTPDIKVDAVRSFGGNVVLHGNNFDEAKAEAERLSEQHGYTFVPPFDHPLVIAGQGTIGMEMLQQNGHLDYIFVPVGGGGLAAGVAVLVKQLMPEIKVIAVEPEDSSCLKAALDAGEPVVLDQVSMFADGVAVKRIGEETFRLCQKYIDGHVAVSSDEICAAVKDIFEDTRAIAEPSGALALAGLKKFVEQNQLENKNLATVLSGANTNFHGLRYVSERCELGEKREGLLAVTIPERQGAFFEFCNLIGGRAVTEFNYRYNDDELANIFVGVRLQGGQEELDNIIRDLREGGYPVVDLSDDEMAKLHIRYMIGGKPSKQLKERLYSFEFPEYPGALLKFLSTLGTHWNISLFNYRNHGADYGRVLCGFELDESDLAQFSAHLRELGYQCKDETDNPSYKFFLS

SEQ ID NO: 45196 - protein, 256 aa, Zea mays
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKH

SEQ ID NO: 45197 - protein, 500 aa, Leifsonia xyli subsp. xyli str. CTCB07
MSEQNREPAETSEESALQPTAAMRRKVTGLALAAAVGGFLFGFDSSVINGAVDSIQRNFALNAFVTGFIVAIAFFGCAVGAFVAGRLADRWGRLRVMLLGAVLFLISSVGAGLAFSVWDLGLWRIVGGLGIGIASVVAPAYIAEISPRQSRGRLGSLQQLAITLGIFVALLSDALLAGIAGSASSQLWLGLEAWRWMFLVGVIPSVVYGVLALTLPESPRYLLTTGRHKDARAIFSTMVPEGDVDRQVRDIERVIEEDKEGRRGTLAGNRFGLKPIVWIGVILSVFQQFVGINVIFYYSTTLWRAVGFTESNSLLITVITSVTNVVVTIVAILLVDRVGRRPILLTGSVGMALALGVMALSFTFAVKQDGAVSLPSPWGPLALVAANVFVVCFGASWGPLVWVLLGEIFPSRIRGKALGVAAAAQWIANFLVTVSFPPMSDFSLPFTYGMYAVFAALSWFFVFFKIPETNGMALEHAETLFQEAGGRRRGIQVRSSGDSV

SEQ ID NO: 45198 - protein, 424 aa, Chlamydia trachomatis D/UW-3/CX [sequence omitted]

SEQ ID NO: 45199 - protein, 439 aa, Klebsiella pneumoniae subsp. pneumoniae MGH 78578
MALGSAIGTGLFYGSADAIKMAGPSVLLAYIIGGVAAYIIMRALGEMSVHNPAASSFSRYAQENLGGLAGYITGWTYCFEILIVAIADVTAFGIYMGVWFPTVPHWIWVLSVVLIICAVNLMSVKVFGELEFWFSFFKVATIIIMILAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTDGSPFVLTFQHLGITFAASILNFVVLTASLSAINSDVFGVGRMLHGMAEQGSAPKVFAKTSRRGIPWVTVMVMTIALLFAVYLNYIMPENVFLVIASLATFATVWVWIMILLSQIAFRRRLSPEEVKALKFKVPGGVVTTVIGLLFLAFIIALIGYHPDTRISLYVGMAWIALLLLGWVFKTRRERRLAQAQ

SEQ ID NO: 45200 - protein, 126 aa, Brassica napus
  misc_feature (63)..(63): Xaa can be any naturally occurring amino acid
  misc_feature (67)..(67): Xaa can be any naturally occurring amino acid
  misc_feature (123)..(123): Xaa can be any naturally occurring amino acid
TIRTVATYNTHQEHTVDFFGNEFTVTVTRFSSVITRWINNVQYYNRYSSHPLVSGVGVQWTPXFSYXDNCYYADPYYNAEPEADTLQLCVGTRCLVIQLSHCDDVPDELRSFLTDPHTVYVGXWNG

SEQ ID NO: 45201 - protein, 269 aa, Leifsonia xyli subsp. xyli str. CTCB07
MPDWAHPVCAERRTRLIELRTPAEIEQMRPAGRFAAEVLAETSTAATVGTNLLELDRIAHAAIRRRGATSCYIDYHPSFGASPFGKVICTSVNDAVLHGLPHDYRLRDGDLLSLDFAASVDGWVADAAVSVVVGKARDEDLRLIDTTRRALAAGIAAAQPGGRTGDISAAIAAEAQTEGYSINTQFGGHGVGRTMHGDPHIPNDGRPGRGFPLRPGLVIAIEPWFLETTDQIVTDPDGWTLRSADGSRGAHSEHTIAITESGPLVLTAV

SEQ ID NO: 45202 - protein, 365 aa, Glycine max
MGSTGETQITPTHVSDEEANLFAMQLASASVLPMILKSALELDLLEIIAKAGPGVHLSPTDISSQLPTQNPDAPVMLDRILRLLACYNILSFSLRTLPDGKVERLYGLAPVAKYLVKNEDGVSIAALNLMNQDKILMESWYYLKDAVLEGGIPFNKAYGMTAFEYHGTDPRFNKVFNKGMADHSTITMKKILETYTGFEGLKSLVDVGGGTGAVVNMIVSKYPTIKGINFDLPHVIEDAPSYPGVEHVGGDMFVSVPKADAIFMKWICHDWSDEHCLKFLKNCYEALPDNGKVIVAECILPVAPDSSLATKGVVHIDVIMLAHNPGGKERTEKEFEALAKGSGFQGFRVLCCAFNTYVMEFLKKV

SEQ ID NO: 45203 - protein, 551 aa, Coprinopsis cinerea okayama7#130
MEFIAFPLQALALYFVTKLVWAILSRVLLNHPLDVLPGPPSPSYLTGNLKKVFDRSNGIVYHEDILKKYGSAMQIAGPLGMKTLLTSDPKALHHVFVKDQDVHEETDLFLATNSMVFGPSLLSTLGEPHRKQRKMLNPVFSINHMRQMVPIFMEVSTKLGDALSRLTSTGPKEVEVLGWLTRTALELIGQSGFGYSFDPLTEHHEEHPYVTSVKLLTAMLMKTIWVRLFFLPTIHKWNLGGKRLRRFVMDRFSWGASRMFKDIVDTMHKTSLEIYHSKKKALEEGDEVVARQIGQGKDLLSILMRANMEADSDDERLHEDELIAQVTTFTFAAMDTTSSALCRFFYLLAKHQDVQERLRKEIKEAKQQYGEINYDQLTALPYLDAVCRETLRLYPPVPLISREARRDAILPLGMPITRKDGQRIDEIHVPKGTKIWASILGINRMPELWGPDADEWKPERWLSPLPEALRDAKVPGVYSNLMTFIGGGRACIGFKFSQLEMKCVLFVLLDHLRFSLPENKDIKWVMSGIIMPAVDAEKLRPELPLIVERIP

SEQ ID NO: 45204 - protein, 229 aa, Physcomitrella patens subsp. patens
MPHDVALALLHFATTKELPQQSKDEIAMTLGVLLQRAPCNFLVFGMWYDSLLWATFNYGGRTVFLDESQEWIDRMRVKHPELEIYKVKYSTTLQDASDLLQKARETISTKCRPYQPIETSECALAMSQLPIEILSVQWDVIMIDGPRSYPKYSNFPGRMSPIFTSAVVAHTRTASEYTDIFLHDVSRPLEKQFSEEFLCATNLVKSIGDLWHFQVYPGRKTRFCSDKTH

SEQ ID NO: 45205 - protein, 198 aa, Escherichia coli
MNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 45206 - protein, 277 aa, Klebsiella pneumoniae subsp. pneumoniae MGH 78578
MRNDRSFIELRARERAHALLDDGSYRELLDPFEGIMSPWLGAQGIVPQSDDGMVVAKGTINGQPAVVIAIEGTFQGGSMGEVSGAKMAAALELAAEDNRNGIPTQAVLCLETGGVRLQEANLGLAAIADIHAAIVDLRRYTPVVGIITGTVGCFGGMSIAAALCSYLIVTREARLGLNGPQVIEQEAGIEEYDSRNRPFIWSMTGGEIRAASGLVDALVNDGVNAVKTAMIEAIAKGVPAQHRSDNYDDYLRRLSQFDTRQQADTAQIKQLFAREDK

SEQ ID NO: 45207 - protein, 322 aa, Zea mays
  misc_feature (177)..(177): Xaa can be any naturally occurring amino acid
MAAALSQLDDEIVRGMAIGAVFTDYAGKINCLDFHRKEDLLVTSSEDDSIRMYNITSATLLKTTYHRKHGADRVCFSHHPSSILCSSRYNLESAESLRYLSLYDNRCLRYFKGHKDRVVSLCMSPVNDSFMSGSLDHSVRIWDLRVNACQGILRLRGRPSVAYDQQGLVFAVAHASXMEGGAIKLFDSRSYDKGPFDTFLVGGDTAEVSDIKFSNDGKSMLLTTTNNHIYVLDAYGGDKRCGFSLEPSPNVTNEAAFTPDGQYVISGSGDGTLHAWNINTVQEIACWNSHIGPITALKWAPRRAMFATASTALTFWIPNQSN

SEQ ID NO: 45208 - protein, 354 aa, Triticum aestivum
  misc_feature (169)..(169): Xaa can be any naturally occurring amino acid
  misc_feature (215)..(215): Xaa can be any naturally occurring amino acid
  misc_feature (243)..(243): Xaa can be any naturally occurring amino acid
  misc_feature (293)..(293): Xaa can be any naturally occurring amino acid
  misc_feature (300)..(300): Xaa can be any naturally occurring amino acid
  misc_feature (327)..(327): Xaa can be any naturally occurring amino acid
  misc_feature (331)..(331): Xaa can be any naturally occurring amino acid
MEMAIDTPSPSPSVSPAPSAAAGRQTRAAESVRLEHQLVRVPLEALRATARTNHRLAEKEIAAVLSSASSAAAAPGESGSAAAVDHLTSLVSRLHGLKRKMEEGARAEELQVQRCRARLDRLAAASAGDDAEWEDIRLKRILVDYMLRMSYYDTATKLAETSGIQDLVXDIDVFLDAKRVIDSLRNKEIAPALAWCAENKSRLKKSKSKLEFLLXRLQEFVGTSPRLRPFLQAYIIMLRKSLXPPWGSTHMKELQRVTATLVFRSSTNCAQIQVLFEQNQWDSLVDQFKQEFXQLYGMTXEPLLNIYPAAGLTALKTPICFEGNCPXEDPXSLEGFGKSQSLAFLNRTLEAGCH

SEQ ID NO: 45209 - protein, 112 aa, Solanum demissum
MESRMEHYEIMEQIGRGTFGAAILVNHKQERKKYVLKKIRLARQTERCRRSAHQEMALIARLQHPFIVEFKEAWVEKGCYVCIVTGYCEGGDMAELMKKANGQYFPEEGIPY

SEQ ID NO: 45210 - protein, 118 aa, Triticum aestivum
  misc_feature (45)..(45): Xaa can be any naturally occurring amino acid
MELLPFSQQNVSFKVILTSDPKLPFKVFSVPDAAPFTHVLKFAFXEFKVPPHTISNITNDGVFINPQKSACSVFLKHGFELLLIPRNKFGTPLAFFLVHCRINFDLILYYRNKYIFIL

SEQ ID NO: 45211 - protein, 630 aa, Oryza sativa Indica Group
MAVTTLRKKSASQGMLRTPSCPYPISSAASSSSASMHGSFSSPTGTRNLVAASPPPPPLFPTSTGTYPAFISATTPDECPAAALVMLPGKLEVARKITAVAVAARASRLELEAARLRQKLADKDRLAAELADRAASLEQALRDSDARLRAALDDNAKLAKERDSLAHTSKKLARDLAKLETFKRHLMQSLGDDNPPIQETVDIRTCEQSVAKASSWKDGVAHSRHHHPVSSLADGSTEIESVNQEVARPFEQKLSVTHISPRLTSDPAAKTRTAATSPRRYSTAVSPKLAASATSPRRTTRVDGKEFFRQARNRLSYEQFAAFLANIKELNAHRQSREETLQKADEIFGSENKDLFMSFQSLLSRSLSSGVKVYQMMDLSTTSVVAAKAYKYRAESLVKDYLLADCYVSYTAVLGGILMCKMVYDITHLISSLYYKGYGSLTKIQKLEWNNRGMSTVHAMFITLMSVYLVFFSNLFSDELDGPVTVRSSNLSNFTLGVSLGYFIADLAMLSWAYPSLGGMEYVLHHLLSIISLVYAIYSEEGQLYTYMVLISETTTPGINLRWFLDTVGMKRSKAYLVNGVTMFVAWLVKQMRTFSCILIFAVPTILLVMNTVWFVKILRGLKKTLAKRQ

SEQ ID NO: 45212 - protein, 159 aa, Lactobacillus johnsonii NCC 533
MNIKIVCVGKLKEKYFKDGIAEYVKRMSRFAKVKIVQVPDEKAPEKLSPAEMEQVKEIEGKRILDKIKDKEYVYVTAIKGKERTSEAFAKELSDLTTYGHSDITFVIGGSLGTSDAVNKRADDLISFGKFTMPHQLMRLVLIEQIYRAFMINSGSPYHK

SEQ ID NO: 45213 - protein, 552 aa, Chlamydomonas reinhardtii
PRCAPQSLPWAHTFVNELPADPNTTNVVRQVKGALFTPVQPTPPDGVPYTITYSAKVARLLGLDPTECERPEFALVMSGAAPLPGARPFAACYGGHQFGQWAGQLGDGRAITLGEVRRAGACGGVWKLGKRKGKGPTHGVRRADGRAVLRSSLREFVASEAMAALGVPTTRALSLVGTGDKVLRDMFYNGNAKMEQGAVVCRVAPSFVRFGTFQLPVSRGAGEVGLVKMAADWVIKHHMPHLAGEGEGTCVFRAAGPPVNKSPEPYLGLLREACARTGRLVAQWQALGFVHGVLNTDNMSILGLTIDYGPYGFLDVFDPDWTPNLTDASGRRYSYRNQPEAGQFNVVMLGNALLAADLLGREAATEALVGYSEVLSTTYNQLMAAKLGLKEYDRTLAQELMKMMYTDDADFTNTFRALSSEEGGGAAAEGPQQLPGRLAAALNRGQPLSEERAAAWRQWLQAYQARCVPDGTPDAERQAAQRLACPKFIPRQHLLQWAIEAAEQGDYSELEALMEVLERPYDEQPEAPAKYSAPPPPDMEGRPGVCMLSCSS

SEQ ID NO: 45214 - protein, 251 aa, Vitis pseudoreticulata
MAEEKCFIAKDVTELIGKTPLVYLNNVVDGCVARIAGKLEMMEPCSSVKDRIGYSMITDAEEKGLITPGESVLIEPTSGNTGIGLAFMAAAKGYKLIITMPASMSLERRIILRAFGAELVLTDPAKGMKGAVQKAEEILAKTPNSYILQQFENPANPKIHYETTGPEIWRGTGGKVDAFVSGIGTGGTITGAGKFLKEQNSDIKLYGVEPVESAVLSGGKPGPHKIQGIGAGFIPGVLDVNLLDEGCSSFK

SEQ ID NO: 45215 - protein, 384 aa, Arabidopsis thaliana
MFSIHEGKPIRCKAAVSRKPGEALVIEEIHVDPPQAYEVRIKIICTSLCHTDVSFSKIDSGPLARFPRILGHEAVGVIESIGEHVNGFQQGDIVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTSFINPTLCGEKKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 45216 - protein, 842 aa, Arabidopsis thaliana
MKKEEFQSRLWDSWGSIKKKLEKDIYGVGSIGLFTDLDRESLAIRQKPGLEEHSVLDKSRTTTQDKQCSIPMHPSTFQTELNPHTSTLLKKLTHHSQQRNLVAGRAVHGQIIRTGASTCIQHANVLVNFYAKCGKLAKAHSIFNAIICKDVVSWNSLITGYSQNGGISSSYTVMQLFREMRAQDILPNAYTLAGIFKAESSLQSSTVGRQAHALVVKMSSFGDIYVDTSLVGMYCKAGLVEDGLKVFAYMPERNTYTWSTMVSGYATRGRVEEAIKVFNLFLREKEEGSDSDYVFTAVLSSLAATIYVGLGRQIHCITIKNGLLGFVALSNALVTMYSKCESLNEACKMFDSSGDRNSITWSAMVTGYSQNGESLEAVKLFSRMFSAGIKPSEYTIVGVLNACSDICYLEEGKQLHSFLLKLGFERHLFATTALVDMYAKAGCLADARKGFDCLQERDVALWTSLISGYVQNSDNEEALILYRRMKTAGIIPNDPTMASVLKACSSLATLELGKQVHGHTIKHGFGLEVPIGSALSTMYSKCGSLEDGNLVFRRTPNKDVVSWNAMISGLSHNGQGDEALELFEEMLAEGMEPDDVTFVNIISACSHKGFVERGWFYFNMMSDQIGLDPKVDHYACMVDLLSRAGQLKEAKEFIESANIDHGLCLWRILLSACKNHGKCELGVYAGEKLMALGSRESSTYVQLSGIYTALGRMRDVERVWKHMRANGVSKEVGCSWIELKNQYHVFVVGDTMHPMIEETKDLVCLVLILGNMSKSEEKQELPLETSPYTKYEDIEDYKKNAYGTSGHQDVKPGHGGGTTDAPTPSGDAAPSAIDSANQKAKK

SEQ ID NO: 45217 - protein, 308 aa, Corynebacterium ammoniagenes
MKMILDLDTGIDDAFALAYAIAHPGIDLIGVTGTYGNVTIEQGMANTQALLTLLGAADVPVYAGRAIDGFEVSEASARIHGRNGVGEVDIAADDAQSAGDALEFLSEAAAKYGDDLVIVPTGAQTTLARALEKDPALRGIRMVSMGGALTVPGNVSPAAEANISQDPVSSNTVYQLAEDMTMVGLDVTMQTQLTRAEADSWRGTPAGDVFADMAGYYIDAYQENNPHMDGCALHDPLAVAVAADPDLVDCLILPLQVDTEGPTIGRTIGRWDGSEVETRVAVGVNVDSFVPDFIDKLAQLFGRLVQNQ

SEQ ID NO: 45218 - protein, 463 aa, Arabidopsis thaliana
MLRAVIRRAASNGSSPSLFGKSLQSSRVAASSPSLLSGSETGAYLHRGNHAHSFHNLALPAGNSGISRSASLVSSTLQRWVRPFSAETGDTVEAVVPHMGESITDGTLATFLKKPGERVQADEAIAQIETDKVTIDIASPASGVIQEFLVNEGDTVEPGTKVAIISKSEDTASQVTPSQKIPETTDTKPSPPAEDKQKPKVESAPVAEKPKAPSSPPPPKQSAKEPQLPPKERERRVPMTRLRKRVATRLKDSQNTFALLTTFNEVDMTNLMKLRSQYKDAFYEKHGVKLGLMSGFIKAAVSALQHQPVVNAVIDGDDIIYRDYVDISIAVGTSKGLVVPVIRGADKMNFAEIEKTINSLAKKANEGTISIDEMAGGSFTVSNGGVYGSLISTPIINPPQSAILGMHSIVSRPMVVGGSVVPRPMMYVALTYDHRLIDGREAVYFLRRVKDVVEDPQRLLLDI

SEQ ID NO: 45219 - protein, 362 aa, Burkholderia mallei ATCC 23344
MATPQFHPLRIRDVRPETADAVTVSFEVPPELRDAYRFTQGQFVTLKAHVDGKETRRSYSICVGTTDYDRDGELRIGIKRVRGGRFSNFAFDTLKPGHTIDVMTPDGRFFTHLNAGHGKQYVAFAGGSGITPVLAIVKTTLELEPRSTFTLIYGNRSVDSIMFAEELEDLKNRFMQRLALYHVLSDDVQDVELFNGVLDQAKCAAFLDSLVPAATIDEAFICGPAPMMDAAEAALAAAGVPRERVHVERFGTPLPQAGAPAVEITADTPAADLEIVLDGKKRKLRLPYEGASLLDVGLRAGLALPYACKGGVCCTCRAKVLEGEVRMEKNYTLEPQEIADGFVLTCQCHPVSEKIVVSYDER

SEQ ID NO: 45220 - protein, 200 aa, Klebsiella pneumoniae subsp. pneumoniae MGH 78578
MVLVTRQAPDFTAAAVLGNGEIVEKFNFKQHTNGKPTVLFFWPMDFTFVCPSELIAFDKRYEEFQKRGVEVVGVSFDSEFVHNAWRNTPVDQGGIGPVKYAMVADIKREIQKAYGIEHPDEGVALRGSFLIDANGVVRHQVVNDLPLGRNIDEMLRMVDALQFHEEHGEVCPAQWEKGKEGMAASPEGVAKYLTENVSSL

SEQ ID NO: 45221 - protein, 706 aa, Vibrio angustum S14
MTQSAFSLSYKDNGVAWLKIDVPNEKMNTLQAEFSEQITSVLAELKARSDIKGLVVYSGKPDNFVAGADIRMLSACETVQEAQALAKKGQVLFSQLEQLPFHVVAAIHGPCLGGGLELALACHSRVCSDGDKTRLGLPEVQLGLLPGSGGTQRLPRLIGVANALDMILSGKQLRAKKAVKLGVIDQVVPESILLNVAEQVALTAKPSRKSSMQNWALGGNPLGRSVVFDQAAKKAHEKTRGNYPAVDAILEVVKYGLQHGMEKGLEQEAKVFGELVMSPESAALRSIFFATTAMKKETGSEAEPLTVERVAVLGGGLMGGGISHVSATKAGYPVRIKDISNDGIQNALAYNFKLLEKKRKRKIISKATLQKQMLTITGGTDFTGFNQADVVVEAVFEDLALKHQMVKDVEEHAKPNTIFATNTSSLPINQIAQAAEHPENVVGLHYFSPVEKMPLVEVIPHQGTEMGSGTSEETIATVVALAKKQGKTPIVVGDKAGFYVNRILAPYMNEAARVLLSGEPIEHIDTALLNFGFPVGPITLLDEVGVDVGAKISPILLAELGDRFEAPDVFDLLLKDDRKGRKSGKGFYRYNTKKKEVDKSVYKLLEIEPKIKESETEIAVRCSLMMLNEAARCLDEGVIRSARDGDIGAIFGIGFPTFLGGPFRYMDHIGITRVVDMLNEYTDKYGDRFKPCERLLDMAKEEKTFY

SEQ ID NO: 45222 - protein, 165 aa, Fusobacterium nucleatum subsp. nucleatum ATCC 25586
MELKEEDLLKRNVKGISKKLKKTRVCILGLGGLGSNVVVLLARSGIGSLKLVDFDIVEASNLNRQQYRISHIGLKKTEAMKSIIREINPFVEVDISDIKVDRENIYSIVGDIELVVEAFDRAETKAMTLEALLTNTNKIVVSASGMAGLGSANEIVKERLKIIFI

SEQ ID NO: 45223 - protein, 211 aa, Listeria monocytogenes EGD-e
MAEGLRTIYFVRHGKTEWNMTGQMQGWGDSPLVAEGIDGAKAVGEVLKDMQIDAVYTSTSKRTQDTAAYILGDREIEIQPLEELKEMGFGTWEGIRVTEIDEKHPEERAKILHSPETYKAEVNGGETYYELAERLLEGVEKIIADNPNGNILVVSHGMSLTLLLYLLQGGTIEDHRKEAPRILNTSISIVEYQNGEFSLKKINEIGHLDLK

SEQ ID NO: 45224 - protein, 787 aa, Coprinopsis cinerea okayama7#130
MSIRDSAEETMDVDGATNGADPSTRPPLRVRALTLLQERRLIAYLDDRWLQFTRNFKKRSEQSSTLRTLGDYLEEARHLLAFILQIPPVDPSTSLRIAYMLRLTADVLGGIPGYSLTRRVSDPLAPANTEEPTNVSPKSIRNTLRDLLDFLDDLDHAWLAVLQGQVWDPETAEGVDLTSALEFITHSPHDPTTSNGEEHQPASAPPNVKTSPPSQTELTRLRSLLVGGQSALEEWLLNERVAKLSSPSADGDDLTGMLARMGLLDEFDNVFTRTMDVLGYGNLREDDDLEEVPMSAPLTGPGEDSAQAYLGIRFLTWVDHDRCGTALFSDGYANGVIGTVNTLLTRIYGAEALANHAYSRTLSSLAFAGTIVGMLLFGYLSDKIGRKFGMMSATAIVTLFSGLSAASAGANGSLGGMLSMLSAMRFLLGIGVGAEYPCGSVSASEQSEEPGINKKAQHRWFTLATNSMIDFGFVIAAFVPFVLFKIFGNDHLRAVWRLSLGLGMVPAAAVFIWRLSMDEPVRYKKDSMKHAKIPYLLILKRYWVSLAAISFVWFLYDVIVYPFGLYSSLIVNNITGGDTNLTVVLGWNVVINLFYMPGTLIGAFTVDFLGPKYTLITGLVLQAIIGFTMSGLYKQLSDNVAAFAVVYGIFLSFGEFGPGNCLGLLASKTSPTAIRGQYYGAAAAIGKVVFPPIIDAFGGPETARGNTGPFWIASGLALVSALTTFFFIVPLTHDGMEKEDAEFRAYLEANGYDTSAMGLPDFDSERGSLGEKVEGPEKAVDVKVEPA

SEQ ID NO: 45225 - protein, 418 aa, Cryptococcus neoformans var. neoformans JEC21
MIRGFKQARAAVKPLKTVSQQKRSLSIHEYQSVQLLNSYGIPTPKALPAFSAAEAESVAKSFGKDELVIKAQVLAGGRGKGHFDSGFQGGVQMVDSPAQAKEYAEKMLGYKLITKQTGAAGRICNAVMLAERMPPQKEYYAAILNDRTTGGPVLVTSSQGGMNIEDVAKETPDAIITTPLDFDNGISHAEALELAKKLGFKENAQKNAADVFGKLYTIFKEKDSTQIEINPLAELSNGQVLCMDAKFGFDDNADFRQKDVFKLRDTTQEDAQEVEAAEYGLNFIKLDGDIGCLVNGAGLAMATMDVLNLHGGSPANFLDVGGGATAEAVKKAFELLLTSKNVKSIFVNIFGGIMRCDVIAEGIIKATKELHLEIPLVVRLQGTKEEEAKQMIRESGLKIFPFDGLDEAAAKAVEAARA

SEQ ID NO: 45226 - protein, 91 aa, Triticum aestivum
MANQVGTVTEAIEAVKQAKDAHWGVMVSYRYGDTDDSFIADLIVGATTGQIKAGAPCCGECLMKYNQLLRIEEELGSEGVYAGKNWRTTPS

SEQ ID NO: 45227 - protein, 364 aa, Cistus creticus
MTTVSISSWVQTYCVFNQATRSRSRSRSPSFNRFNLPIIPVSKPFRFFRPSNRLGTHQRRRIEQDPPKWAFDLKSYMIQKANSVNQALETAVSLREPLKIHEAMRYSVLAGGKRVRPVLCIAACELVGGEESMAMPAACAVEMIHTMSLIHDDPPCMDNDDLRRGKPTNHKVFGEDIAVLAGDALLAFSFEHMTGSTVGVSPARIVRAVGELAKSIGSEGLVAGQVVDICSEGLTDVGLEHLEFIHVHKTAALLEGSVVLGAILGGGSDEEVEKLRKFARCIGLLFQVVDDILDVTKSSTELGKTAGKDLVADKVTYPKLMGIEKSREFAEELKNDAVEQLRGFDQEKAAPLIALANYIAYRQN

SEQ ID NO: 45228 - protein, 437 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRRALYLGKIVSYAQGFSQLRAASEEYNWDLNYGEIAKIFRAGCIIRAQFLQKITDAYAEDPQIANLLLAPYFKQIADDYQQALRDVVAYAVQNGIPVPTFAAAVAYYDSYRAAVLP

SEQ ID NO: 45229 - protein, 369 aa, Cistus creticus
MSTVNVNLGSWSQPTCFVFNQKTRSRIPNFSSFKGFMASSSNFRSVSSSSSSSSSFIASVLSGKDTMKGEEENSGFDFQSYMDQMADSVNQALESAVSLREPLKIHEAMRYSLLAGGKRVRPLLCIAACELVGGDVSVAMPAACAVEMIHTMSLIHDDLPCMDNDDLRRGKPTNHKAFGEDIAVLAGDALLSFAFEHVAVSTVGASPDKIVRAVGELAKAVGKEGLVAGQVVDITSEGLNDVGLDHLEYIHVHKTAVLLEAAVVLGAILGGGTDEEVERLRKFAICIGLLFQVVDDILDVTKSSVELGKTAGKDLVADKVTYPKLMGLEKSREFAEKLRDDAVEQLRVFDQVKAAPLIALAHYIAYRQN

SEQ ID NO: 45230 - protein, 430 aa, Synechococcus elongatus PCC 6301
MPDDYGTQIAEITAREILDSRGRPTVEAEVHLEDGSVGLAQVPSGASTGTFEAHELRDDDPSRYGGKGVQKAVENVSAIEDALIGLSALDQEGLDKAMIALDGTPNKKNLGANAILAVSLATAHAAATSLNLPLYRYLGGPLANVLPVPMMNVINGGAHADNNVDFQEFMIMPVGAPSFKEALRWGAEVFHALAKVLKDKGLATGVGDEGGFAPNLGSNKEALELLLTAIEAAGYKPGEQVALAMDVASSEFYKNGLYTCDGVSHEPAGMIGILADLVSQYPIVSIEDGLQEDDWSNWKTLTQQLGSTVQLVGDDLFVTNPDRLQSGIEQGVGNAVLIKLNQIGTLTETLRTIDLATRSGYRSVISHRSGETEDTTIADLAVATRAGQIKTGSLSRSERIAKYNRLLRIEAALGENALYAGAIGLGPKGR

SEQ ID NO: 45231 - protein, 893 aa, Aspergillus nidulans FGSC A4
MNPPRPRVASSRVADAEEAGLRGGTAPLQAENMDHRGSTSTQKSKVPREHVTSEKRTERVVIQTKEKMQGRTRNPVRESPSAGNRGEGDKSRSRRANTAGPLSPNLRKKEKETPDAPWNPHASLMPYTTAPLASRVSVPPLSSTLPQSLQPKPLRDLSTDAQEKAILEDLLFVFMGFEGQYIQYQAQYDPTAEKDRLTGPAFQLPSGLDPTLRDLTRSMLKMATHYSALEAFVEVQSRAEYGAVSHALCATIRKLLKDYLILVAQLETQLLNNPNFTLHVLHLHTMPTSQCLAQLYSLGQELLRRNGLLDQDIDESIDDFDDVDNILEQLREGGDLIPGAMSSKKICKGGNVLRLLTERLATFSGDPTTKALLETLLRESSRPYMTMLNEWLHHGVIKDPHAEFLVKEQKWIKREKLEEDYTDEYWEKRYTIRDNEVPPQLDSVRDKVLLAGKYLNVVRECGGVDVSKAVKDVPKTFDDPRFLENVNAAYTYANASLLNLLLTKNSLTTRFRSLKHYFFLDRSDFFSYFLELGASELRKPAKNVNESKLQSLLDLVLRQPGSIAAQDPFKEDVKVRMNKIGLTKWLMQVVSVSGIDQDNPEAALEKYQAPQAGSEDDKDIVGFDALELDYTVPFPLSLVISRKTVLRYQLIFRHLLSLRHLESMLSSAWLDQSKILGWRHKSTDRRLELWKRRAWNLRAKMLVFIQQLLYFCTAEVVEPNWQSLMDRVNGTDADGSEVTVNGTKQVNRTVDELMQDHVDFLDTCLKECMLTQAKLLKIHSKLLTCCTMFASWTAAPLGRALISADPGLSANPATSDGRGYDPARIGKLEDTLKRYEDHFGRHLRILMDRRLHSNTVTAASYIHQTYVCAGSPENKQSTFDPTTFDGRQSLFCK

SEQ ID NO: 45232 - protein, 444 aa, Lachancea kluyveri
MSPIAVTSQTPATEVPSVKEIPQVITKSSPVENLILTTYPEDSSPIPLQWGAPSTDSRGPIIATRYKEGLAKHNAIGAHSGSYCVYHALAVGTKQLDPEHVADYTNSQPAFAVPEQKTWYNDEDIVAMDPFGHLTPYLFDEVSTKENVEIRPTIAVTKATMQLFEMKDAVEKGRLEVDGEVVINKNGDLNVSKVAVEPVWYLPGVAKRFGVTEEELRKALFEDTNGMYPELVTRPDIKVFLPPIGGLTVYIFGNPDFVSDPSKKLALRVHDECNGSDVFGSDICTCRPYLMFGIEEAVKEAQNGGSGVVVYFRKEGRALGEVTKYLVYNARKRGGDTADEYFHRTECIAGVRDMRFQQLMPDVLKWLGISKIDRMLSMSNMKHDAIVDQGIPIIERIPIPDELVPPDSRVEIDAKINSGYFTNGKVMDKNELKSVQGRTWNDVK

SEQ ID NO: 45233 - protein, 442 aa, Pseudoalteromonas tunicata D2
MQNSALPDKISQYQKHIRKVPPAVAGSLTRVVGLTLEARGVKAPVGSQCQIETLNGFIDAEVVGFNGDVLYLMPNDALSGVLPGARVIPQVKEAGLPVGMSLLGRVVDGLGRPIDGLGPIKAEKKLKFAQNAINPLARRAITQPMDVGVRAINAVITVGQGQRMGLFAGSGVGKSVLLGMMTRGTSADVIVVGLVGERGREVKEFIEEILGDEGRKRSVVVAAPADASPLMRLKGCETAVTIAEYFRDQGLNVLLLLDSVTRYAMAQREIALAVGEPPATKGYPPSVFAKLPALVERAGNGGKGQGSITAFFTVLSEGDDMQDPIADAARAILDGHIVLSRELADSGHYPAIDIEKSISRVMPQVVSEAHMQQARVLKQVYSLYQQNKDLITLGAYQKGADPILDKSISMMPMVNGFLQQTMKEVIPYDESLSGLARLLGQA

SEQ ID NO: 45234 - protein, 143 aa, Triticum aestivum
MAPKQRTPASTAPQTTTTTPSTPARSSKPASSGSAQDILQGIWNKYVTKTPQRVKLLDTFMAFLIVVGALQFFYVVLVGNFPFNAFLSGFSATVGQFVLTASLRIQTNPENKADFESISHERAFADFVLGSLLLHFFCVNFIN

SEQ ID NO: 45235 - protein, 285 aa, Rhodopseudomonas palustris CGA009
MKFLIFGLGYSASYIAQHLQGAGIEVTATVRTSAKAEELGRRGITARVFSSSYVDPLISDDIKSSDAILSSVPPNESGDPVLASFIGSITSDSRPRWIGYLSTIGVYGDHLGNWVDETTPETSEKPRSQLRIAAEQRWLALGAHVFRLSGIYGPGRNQLEKLASGTATRIIKPGQVFNRIHVADIAAVVAASLSRPRAGAIYNVTDNEPAPPQQVVEFAAELCGRTPPPEVAFDDAELSPMARSFYLENCRVRNDLIRTELGVTLAYPSYREGLSALRALGEGPA

SEQ ID NO: 45236 - protein, 510 aa, Rhodopseudomonas palustris CGA009
MKHILEALDERRTAAKLGGGEKRINAQHARGRLTARERIDLLLDKHSFEEMDMFVQHRSTEFGMAKTKIPGDGVVTGWGTVNGRKVFVFAKDFTVFGGSLSETHAAKITKIQDMALKARAPIIGLYDAGGARIQEGVAALAGYSYVFRRVVQASGVIPQISVIMGPCAGGDVYAPAMTDFIFMVKNTSYMFVTGPDVVKTVTNEVVTPEELGGASVHATKSSIADGAFENDVETLLQMRRLLDFLPANSSEGVPEWPSFDDIEREDFSLDTLIPDNPNKPYDMKELILKVVDEGDFFELQDTFAKNIITGFGRIAGRTVGFVANQPMVLAGVLDSDASRKAARFVRFCDSFNIPIVTFVDVPGFLPGTAQEYGGLIKHGAKLLFAFSQCTVPLVTVITRKAYGGAFDVMASKEIGADINYAWPSAQIAVMGAKGAVEIIFRQDMHDPEKIAARTKEYEDRFLSPFIAAERGYIDDVILPHATRRRIARALAMLRDKKMEIPQKKHDNMPL

SEQ ID NO: 45237 - protein, 453 aa, Arabidopsis thaliana
  misc_feature (422)..(422): Xaa can be any naturally occurring amino acid
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKSQSDNMTDKWHVYXTKDGRISLAGLSLAKCEYLADAIIDSYHNVS

SEQ ID NO: 45238 - protein, 548 aa, Methylococcus capsulatus str. Bath
MYQYDQYDQRLVDERVAQFRSQTRRFLQGELSEDQFRPLRLMNGLYLQRHAPMLRVAIPYGVLSSRQLHKLAEIARRYDKSVAHFTTRQNIQFNWPRLEDVPDILAELATVQMHAIQTSGNCIRNVTSDPLAGVCPDEIEDPRPYCEIIRQWSTLHPEFSYLPRKFKIAVSGARKDRAATQVHDIGLQMVENEAGETGFEVLVGGGLGRTPIIGQTIRPFLAKTDLLSYLEAILRVYNRFGRRDNKYKARIKILLKETGIEDFTRRVEAEWVQIRQQLVLDTGEIERVKRHFTAPEYKTVAGPGLDAQAAADPRFAVWLRNNTTPHKIPGYRAVFLSLKARGVPPGDIADTQLDAVADLAERYSFGEVRATHTQNLVFADVHQDDLHELWQRLDSIGLATPNIGKATDMICCPGLDYCSLANASSISVAEDIYSRIDDLDYLHDLGDLRINISGCMNGCAHQSVGHIGILGVDKKGEEWYQLTLGGSSSNDASLGERLGPAIDKAHVAEAVETILQTYIELRQDGESFLDTVRRLGINPFQERVYAHH

SEQ ID NO: 45239 - protein, 195 aa, Chlamydia trachomatis D/UW-3/CX
MGSLVGRQAPDFSGKAVVCGEEKEISLADFRGKYVVLFFYPKDFTYVCPTELHAFQDRLVDFEERGAVVLGCSVDDIETHSRWLAVARNAGGIEGTEYPLLADPSFKISEAFGVLNPEGSLALRATFLIDKYGVVRHAVINDLPLGRSIDEELRILDSLIFFENHGMVCPANWRSGERGMVPSEEGLKEYFQTMD

SEQ ID NO: 45240 - protein, 155 aa, Arachis hypogaea
GAYGVVCSALNSETNEHVAIKKIANAFDNKIDAKRTLREIKLLRHMDHENVVAIRDIVPPPQREAFNDVYIAYELMDTDLHQIIRSNQALSEEHCQYFLYQILRGLKYIHSANVLHRDLKPSNLLLNANCDLKICDFGLARVTSETDFMTEYVVT

SEQ ID NO: 45241 - protein, 322 aa, Brassica oleracea var. acephala
GHASTSTSPVFVQAPSEKGFSSFAIDFLMGGVSAAVSKTAAAPIERVKLLIQNQDEMLKAGRLSEPYKGIGDCFGRTIKDEGFGSLWRGNTANVIRYFPTQALNFVFKDYFKRLFNFKKDRDGYWKWFAGNLGSGGAAGASSLLFVYSLDYARTRLANDSKAAKKGGERQFNGLVDVYKKTLKSDGIAGLYRGFNISCVGIIVYRGLYFGLYDSLKPLLPADLQDSFFASFALGWLITNGAGLASYPIDTVRRRMMMTSGEAVKYKSSMDAFQQILKKEGPKSLFKGAGANILRAIAGAGVLSGYDKLQLLLLGKKYGSESG

SEQ ID NO: 45242 - protein, 434 aa, Fusobacterium nucleatum subsp. nucleatum ATCC 25586 [sequence omitted]

SEQ ID NO: 45243 - protein, 602 aa, Pichia angusta
MSYQRAVPSSSNHTMPERDRLDELLDAVKKEFDNLTRETTIYKDHHHDYELKINQQHQELTNIRNTVYELEQAHRTMKEAYEKEILRLKQDLENRDRLFQQQSLQQAQAQAQAQAQVKAQVQSQQHPLLDRPQGAFPQTPQQLPPPNLSGSPSDYRGAGFNGALPQINAQASGAKPEISQSTQLPPPPPVSTQEQQAASQTQTSPEQPPTAVQTSVVKTEADAGYVMRSQHNKPIPTFLKDFDSYSTLPYKKQHSEYYIVYNPKVPKKVDTSLVHSFDHTSVVCCVRFSKDGKFLATGCNKLTQVFSVETGDLVARLSDESSASSNGSYDTDTGDLYIRSVCFSPDGKFLATGAEDKIIRIWDLATRTIVKYLKGHEQDIYSLDFFPDGSKLVSGSGDRTVRIWDVFTGQCSLTLSIEDGVTTVAASPDGKLIAAGSLDRTVRVWDANQGFLVERLDSANESGNGHMDSVYSVAFTHDGKEIASGSLDRTVKLWSLKDLQKQQGSSKSNCEVTYVGHKDFVLSVCCTPDDEFILSGSKDRGVIMWEKATGEPYIMLQGHRNSVISVNVSPVMTQKRGVNGGYFATGSGDCKARIWRWEKVSS

SEQ ID NO: 45244 - protein, 475 aa, Fusobacterium nucleatum subsp. nucleatum ATCC 25586
MRSLKKTKIVCTIGPVTESVETLKELLNRGMNVMRLNFSHGDYEEHGMRMKNFRQAMSETGIRGGILLDTKGPEIRTMTLKDGKDVSIKAGQKFTFTTDQSVVGDNERVAVTYENFAKDLKVGNMVLVDDGLLELDVVEIKGNEVICIARNNGDLGQKKGINLPNVSVNLPALSEKDIEDLKFGCQNNVDFVAASFIRKADDVRQVRKVLRENDGERIQIISKIESQEGLDNFDEILAESDGIMVARGDLGVEIPVEEVPCAQKMMIRKCNRVGKTVITATQMLDSMIKNPRPTRAEANDVANAILDGTDAVMLSGETAKGKYPLAAVEVMNKIAKKVDATIPPFYIEGVINKNDITSAVAEGSADISERLNAKLIVVGTESGRAARDMRRYFPRAHILAITNNEKTANQLVLSRGIISYVDASPKTLEEFFVVAESVAKKLNLVKNNDIIIATCGESVFIQGTTNSIKVIQVKA

SEQ ID NO: 45245 - protein, 439 aa, Myxococcus xanthus DK 1622
MVSSPLLDRIKKRDARVGVVGLGYVGLPLGMAFAEAGFPVMGLDVDKRKIDKIEKGESYIKHIPGAPLAELSKSGKLKATTDFAKAKDMDCVIICVPTPLTASREPDMSYIIQTGEALAPHVRPGQLFILESTTYPGTTEEVLKPLLEKNGLKAGKDFYLAFSPEREDPGNKSFNTKTIPKIVGGYSPECSEMAAALYGSALKEVVPVSSTRVAELTKLLENIFRCVNIAMVNEMKMLCDRMGVDVWEAIQAASTKPFGYMPFYPGPGLGGHCIPIDPFYLTWKAREYEFHTKFIELAGEVNWQMPYYVVQRTMEALNKNKQTLNGAKVLCLGAAYKKDIDDMRESPSLRVMTLLAEKGAELSYHDPYVPELHKGHGFNLEMKSVPLKPETLGQYDAVLILTDHSDIDYAMLVDRAKVVVDTRNATKGVSKGREKVTKA

SEQ ID NO: 45246 - protein, 289 aa, Phaseolus vulgaris
MEGKEQDVSLGANKYAERQPIGTAAQSQDDGKDYQAPPPAPLFEPSELTSWSFYRAPIAEFVATFLFLYITVLTVMGVLRSPTKCQSVGIQGIAWAFGGMIFALVYCTAGISGGHINPAVTFGLFLARKLSLTRALFYIVMQVLGAIAGAGAVKGFEGKTRFGRLNGGANFVAPGYTKGDGLGAEIVGTFVLVYTVFSATDAKRCARDSHVPILAPLPIGFAVFLVHLATIPITGAGINPARSLGAAIIFNKDLGWDDHWIFWVGPFIGAALAALYHQVVIRAIPFKSK

SEQ ID NO: 45247 - protein, 232 aa, Triticum aestivum
  misc_feature (10)..(11): Xaa can be any naturally occurring amino acid
  misc_feature (20)..(20): Xaa can be any naturally occurring amino acid
  misc_feature (22)..(22): Xaa can be any naturally occurring amino acid
  misc_feature (75)..(75): Xaa can be any naturally occurring amino acid
STPKMRGILXXWILEVHQKXDXMPESLYLTVYIIDMYLSLQSVLRRELQLVGVSALLIACKYEEIWAPEVNDFIXLISDSAYTREQILKMEKAILNMLEWNLTVPTPYVFLVRFAKAASSSDQKNDKEMENTVFFFAELALLQYGLVQSKPSMVAAAAVYAARLTLKKTPLWTDTLKHHTGFTEAQLMEAAKILVASHSTAPDSKLKVVYKKYSSEKLGGVALRPPATDFCK

SEQ ID NO: 45248 - protein, 513 aa, Desulfovibrio desulfuricans G20
MSSSGPLNPVLLLILDGWGIAPAGKGNAVSAARTPVLDSLMAAPCRSRLQCSGRSVGLPDGFMGNSEVGHMNLGAGRIVYQDMTRIDIAVEERQLSARPAIADMFDALKSSGGTLHLLGLVSDGGVHSHVRHLYALVEAARDACVPVCIHAFMDGRDTAPKSGLQFINDLEEVLVRLGHGRIASVTGRYYAMDRDRHWERNETAWNALVHGQGEFADSAAQAVENAYAAGQTDEFIKPVIVGSAAGIADGDGIFFYNFRADRARQLTRCFIDPSFDAFDRGRVPVLARFATMTSYDASFDVPVAFDKDPLEGTLGEVVSLAGISQFRIAETEKYAHVTYFFNCGREEPFTGEDRLLVPSPRDVATYDLKPEMSVYEVTDSLLAALDKGYGLIVCNLANLDMVGHTGVFSAAVKACEAVDACTGRIIDAFVERGGVVMVTADHGNAEQLLDAQGNPHTAHSMNPVPVALLGAPAAWRLVPEGKLGDVAPTIIDILGLHRPEAMTGQSLLVKESV

SEQ ID NO: 45249 - protein, 179 aa, Vibrio angustum S14
MTSSLRSYKNIHPTLGNNVYVDPSCVLVGDIRCDDDSSIWPLVAARGDVNYITIGKRTNIQDGTVLHVSRISEDHPQGFPLIIGDDVTVGHKAMLHGCQIGHRVLVGMGAIILDGAIVEDNVIIGAGSLVPPNKRLVSGFLYVGSPVKQTRPLTEKEKAFLPRSANNYVILKNEYLCDL

SEQ ID NO: 45250 - protein, 541 aa, Manihot esculenta
MAMNVSTTATTTASFASTSSMNNTAKILLITLFISIVSTVIKLQKRASYKKASKNFPLPPGPTPWPLIGNIPEMIRYRPTFRWIHQLMKDMNTDICLIRFGKTNVVPISCPVIAREILKKHDAVFSNRPKILCAKTMSGGYLTTIVVPYNDQWKKMRKVLTSEIISPARHKWLHDKRAEEADQLVFYINNQYKSNKNVNVRIAARHYGGNVIRKMMFSKRYFGKGMPDGGPGPEEIMHVDAIFTALKYLYGFCISDYLPFLEGLDLDGQEKIVLNANKTIRDLQNPLIEERIQQWRSGERKEMEDLLDVFITLQDSDGKPLLNPDEIKNQIAEIMIATIDNPANAVEWAMGELINQPELLAKATEELDRVVGKDRLVQESDIPNLNYVKACAREAFRLHPVAYFNVPHVAMEDAVIGDYFIPKGSWAILSRYGLGRNPKTWPDPLKYDPERHLNEGEVVLTEHDLRFVTFSTGRRGCVAALLGTTMITMMLARMLQCFTWTPPPNVTKIDLSENIDELTPSTPITGFAKPRLAPHLYPTSP

SEQ ID NO: 45251 - protein, 396 aa, Aeromonas hydrophila
MFEKVVAAPPDPILGLTEAFRADSRSHKINLGVGIYKDETGATPILHCVKKAEQKLLTDEKTKNYLGIEGNIEYGRIVQQLLFGQDSALIASGRAKTAQAPGGTGALRIAAEFVVRNGLAKTIWISDPTWANHVSVFQAAGLTVKWYKYYDAATKGLDFAAMQASLNDVQAGELVLLHGCCHNPTGIDPTAEQWRALAKQSAAAGWLPLFDFAYQGFARGIEEDAEGLRIFAECHDELLVASSFSKNFGLYNERVGAFTLVSATKAIADVAFTQVKTVIRANYSNPPSHGAAVVTTIVSDPALYVEWVEEVAAMRVRIREMRELLVEKLAALGVSQDFSFIREQNGMFSFSGLSKDQVEQLKSEFAIYIVGSGRISVAGITRANIDPLCDAIAKVL

SEQ ID NO: 45252 - protein, 368 aa, Vibrio parahaemolyticus RIMD 2210633
MPFVDYPYHLSRSANMVDQILFYEPDEPHGFLSNFCHAPVEISSQSWPTSEHYYQAQKFVDAQLQTKIQKAQSPDEAFALSRQYEHLVRSDWDNMKLSVMAFIVREKFLQNPKLAQKLMRTGNACLTEHSHKDAFWGDGGDGKGLNHLGEILMNVRAELRHVEPYNLVKFIDKAKLPTQWGTFMMHGFIETATGKEHLALVYGDPTSQPAPLIRLHSECLTGDALFSTRCDCGFQLNRALQNIVEEGCGVLLYLRQEGRGIGLINKIRAYHLQDDGADTVEANERLGFAADMRDYAFCKGMLEHLGIDEVRLMTNNPRKLAALKNAHINVVERVPLQEGRNPSNQHYLKTKANKLGHMFDPHFVDQTE

SEQ ID NO: 45253 - protein, 84 aa, Brassica napus
RPTRPVAAKITPTVLLLTGVAFFSLILFGGPFAPLVAKLGMTPLLAAVYVGALQNIFSKSAKYSLFDPCKEMAYIPLDEDTKVC

SEQ ID NO: 45254 - protein, 218 aa, Yersinia pestis CO92
MTQDELKKAVGWAALDYVKPGTIVGVGTGSTAAHFIDALGSIKHQIEGAVSSSDASTAKLKSYGIPVFDCNDVDVLDIYVDGADEINGQMQMIKGGGAALTREKIIAAIARKFICIADESKQVGVLGKFPLPVEVIPMARSYVARELIKLGGLPEYRQNVLTDNGNVILDVHNLSILDAIALENQINGIAGVVTVGLFANRGADVALIGTANGVKVIG

SEQ ID NO: 45255 - protein, 2528 aa, Cochliobolus heterostrophus
MTVRDSKTGGITPIAVVGMSFRGPGDATNVEKLLNMISEGRESRAEVQAKKWDPEGFYHPDSSRHGTHNVEYGHWFQQDVYNFDAPFFNVSPAEAAALDPQQRMLLECSYEAFENSGTPMSKIVGTDTSVFVSSFATDYTDMLWRDPESVPMYQCTNSGFSRSNLANRISYSFDLKGPSVLVDTACSGGLTALHLACQSLLVGDVRQALAAGSSLILGPEMMVTMSMMKFLSPDGRCYAFDERANGYARGEGVAVLLLKRLEDALADNDTIRAVIRGTGCNQDGKTPGITMPNSVSQEALIRSVYKKAALDPLDTTYVECHGTGTQAGDTTEASALSKVFSPGRRLPLLIGSVKTNIGHLEGASGLAGVVKSILMLEQGVILPNRNFERPNTKIPLEKWNLRVPTTLECWNNVKTRRVSINSFGYGGANVHAILESATDFLRDNSMGTDSTRFASRRSVVVGNVGQTKPAVSLVQDMSSNDRSHEDPTPLLFALSAFDSSAGDAWARSLSIYLSQRQGSDEKTILSSLAYTLSDRRTWHPWKAALSATTIQELITKLEKVRFVNMAPRHNIGFVFTGQGAQWCGMGRELISIFPRFRQSLIACDIALQSFGADFHVIDELEADVESSRINKALYSQPLCTALQIALVDLLVSWGIYAQSVTGHSSGEIAAAYAAGALSLSDAMLVAYARGCATANLAKKGAKGAMAAVSMETQELSHILSALENGKVGIACFNSPTSCTVSGDKSALDELQDVLRQKGVYNRRLIVDVAYHSHHMELIADSYRSAISSIQPLPGSDVKFFSSVTGELLDKNKLGVDYWVSNLVGQVKFAQSLSSLVSSHHGTGTPQIQALIEIGPHAALGGAISQVIDSEPLANPTGYFSALVRKKNAVTTILSLAADLFLSGYPIQLSAVNQNCNSRHTPLVDLPSYSWNHSKAYTAESRISKTYRQRRYPRLDLIGVFDVHSSVLEPRWRQVIRLSELPWLQDHKIQSSILYPVAGYIAMAIEAATQRNQMREMGNDILGYQFRDVAISSALTIPDMPGQVEVFITLRSFSESVRSPSNLWDEFSISSVNDENRWTEHCRGLISVLKSSKLSNLVNGKMQDASTIACQHDLREVFATCCKTEWDVKDMYEHFWETGMQYGPTFANLCDVRCTSNKCIGKVKVPDTAAVMPMKHEAPFIIHPGTLDSIIQTYLPALVQAGHLKSATIPVAIESMFISRNVTRQAGDLLTSYASSTRKDYRYFSTSMSVFADGPSSENQLVITIDDMTLVALDRPNSSEESGEALPLAFNLHWKPDVDMLTEEQLVEMINASTKVKDHIAAKKMKQTAAQLGKEILARVPFEQAQVVGESSRHLWKLLHASLESLSTPDHRGALDEISSLKNVDSTLAQAADRLSNVLTGRVAPSDVASMYDLMEAVRIPELYDNNLPTATYLHLLGHKKPSLRVLTVGPQSGPTSLNLLMLLAELGGGEIPFAVLHHSDAELNIDQTVRSRFPSWADSVGFRDVFNESGASQQNPPIVNETYDIVVAFNVLGSSPGFSKTLSAAAPLLNARGKILLVDNSHKSPMAALVWGPLPSFLSTWVDEKSADSPDVDCAVQSMGYDIYARLCPNVTVIQRAAQVQKAEKTIGLDVLVVTDGEPAGVDLQQLQTLCEDQYAEVHVASLEHARPRPGQACIVLSELSRPVLAAPTAAEWEAVKRITDTCSGIVWVTRGAADNVCSNPQVSLIQGFARTVRAEAGDKPITTLDLDNDKVLSAQAAAAYIAAVFQRMMQGGEDIDVELQERRGILHVARLIEDGDAAKQLQGEATAMELRLDQAGPCRLFAGTPGLLDSLHFTVDDRVQESLETGQIEVQVHATGINFKDVMMAMGQIAVEDLGCECSGVVSAVGDGVVGLRVGDRVACMGPGSFCTQLRVDARLAHRIPHHMELETAAALPITYVTAYHSIHNIAHLRHGETILIHAAAGGLGQALVELSQLVGARVLVTVGSTEKKRLIMQRFRLSEEDILFSRDTSFVHDVMRLTNGRGVDVIMNSLAGESLRQSWTCIAPNGRFVELGQRDITVNSRLDMAPFARNVSFTAYNLAYMLRHDPQAAHEVLAEVLALYDQGKLRGPEPLEKCTFSQLGNAFRKIQTGRHMGKMVAVANPDDMVWYKPPPASRRTLFRPDASYLLVGGVGGLGSATALWMSTRGARHLLLLNRSGADTEAARTTLATLRANGCTATVLACDVADKAQLSSVLAEARSNWPPIRGVIQGAMVLRDSMLANMTLEDYMAVVRPKVQGTWNLQTHLPADLDFFILESSISGIIGNPGQAAYAAANTFLDAFARWRRARCQPATVIDIGAVHGIGYLERNVDVKLSMERQGFAFTDEQLLMRLLEFAISHSSREPHRAQIVTGLGPWHPDTSLPGLNAPLFSRYRMLSCQNSTGSTDVDTLRGILAQSSSFDSAVTIVLSALVDQVVSRTEIPIENVHTTKSLQDYGIDSLVAVELRNWLIKDMDSVVPMLELLGAESLSALAVKIAARSQLISTNNRG

SEQ ID NO: 45256 - protein, 400 aa, Methylococcus capsulatus str. Bath
MNRRQHEAGQPIPAAEQGGCLADAIRPFHVMAILARARELESSGRSIVHLEIGEPDFPTPEPVAAAATRFLAGGQVRYTPAAGLPELRERIAAYYAERYGVAVAPQRIFLTPGASGALSLALAVALSPGRRVMLADPGYPCYSNFVRLYSGDPHAVPVGAEQDFQLNAALCRMHCGGDVPVAISASPSNPTGTVMRTGVLRELVEWFEAEGGILISDEIYHGLEYGGRAVSALEFGQHTFVVNSFSKYFGMTGWRLGWVVVPEAYAAAVERVAQNIFISAPTLSQYAALAAFSEESRAELERRRRAFEARRDFLWGELVKLGFGVPVAPSGAFYIYADCSAFAEDSAEFAARLLETAGVAVTPGKDFGAQSPERYLRFAYTADIPVLQEAVGRIRRFVTG

SEQ ID NO: 45257 - protein, 415 aa, Thermus caldophilus
MLRLDTRFLPGFPEALSRHGPLLEEARRRLLAKRGEPGSMLGWMDLPEDTETLREVRRYREANPWVEDFVLIGIGGSALGPKALEAAFNESGVRFHYLDHVEPEPILRLLRTLDPRKTLVNAVSKSGSTAETLAGVAVFLKWLKAHLGEDWRRHLVVTTDPKEGPLRAFAEREGLKAFPIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVEGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 45258 - protein, 955 aa, Flaveria brownii
MSSLFVEGMPLKSANESCLPASVKQRRTGDLRRLNHHRQPAFVRGICRRKLSGVSRIELRTGGLTLPRAVLNPVSPPVTTTKKRVFTFGKGNSEGNKDMKSLLGGKGANLAEMASIGLSVPPGLTISTEACEEYQQNGKKLPPGLWDEILEGLQYVQKEMSASLGDPSKALLLSVRSGAAISMPGMMDTVLNLGLNDEVVDGLAAKSGARFAYDSYRRFLDMFGNVVMGIPHSLFDEKLEQMKAEKGIHLDTDLTAADLKDLAEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLVTMETCMPEAYRELVENCVILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVFTIGDRVIKEGDWLSLNGSTGEVILGKQLLAPPAMSNDLETFMSWADQARRLKVMANADTPNDALTARNNGAQGIGLCRTEHMFFASDERIKAVRKMIMAVTPEQRKAALDLLLPYQRSDFEGIFRAMDGLPVTIRLLDPPLHEFLPEGDLEHIVNELTADTGMSKDEIYSRIEKLSEVNPMLGFRGCRLGISYPELTEMQVRAIFQAAVSMNNQGVTVIPEIMVPLVGTPQELRHQIGVIRGVAANVFAEMGLTLEYKVGTMIEIPRAALIADEIAKEAEFFSFGTNDLTQMTFGYSRDDVGKFLPIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 45259 - protein, 463 aa, Arabidopsis thaliana
MKFPGISTKLLNISVNSLCKFRNLERAETLLIDGIRLGVLPDVITYNTLIKGYTRFIGIDEAYAVTRRMREAGIEPDVTTYNSLISGAAKNLMLNRVLQLFDEMLHSGLSPDMWSYNTLMSCYFKLGRHGEAFKILHEDIHLAGLVPGIDTYNILLDALCKSGHTDNAIELFKHLKSRVKPELMTYNILINGLCKSRRVGSVDWMMRELKKSGYTPNAVTYTTMLKMYFKTKRIEKGLQLFLKMKKEGYTFDGFANCAVVSALIKTGRAEEAYECMHELVRSGTRSQDIVSYNTLLNLYFKDGNLDAVDDLLEEIEMKGLKPDDYTHTIIVNGLLNIGNTGGAEKHLACIGEMGMQPSVVTCNCLIDGLCKAGHVDRAMRLFASMEVRDEFTYTSVVHNLCKDGRLVCASKLLLSCYNKGMKIPSSARRAVLSGIRETVSYQAARKTHIKIKAAIECNTLMYP

SEQ ID NO: 45260 - protein, 490 aa, Frankia sp. EAN1pec
MDEQRVTGEQSITVIGSGYLGATHAVCMAELGCRVLAVDVDTAKVARLAGGTAPFFEPGLEPLLRKNLETGRLRFTTSYDEVAEFGDVHFLCVNTPQRGDGYAADLSYLDAAVAALAPRLRRDCLVVGKSTVPVGTAAALAGRLARLAPVGEGAELAWNPEFLREGFGVEDSLRPDRLVFGVTSLAAETRLRRVFAPIIDAGAPVIVTDYATAELVKVAANSFLATKISFINAMAEVCEATGADVLTLAAALGQDPRIGSRFLRPGVGFGGGCLPKDIRAFVARADELGVGRALSFLREVDTINLRRRTRVVDLVRAAAGASLDGCPIAVLGTAFKPNSDDVRDSPALDVAATLHRLGAAVTVYDPAANDNARRVHPELGYADSVPAAVAGADAVVVLTEWAQFAELGPVELAGLVRRRAVVDARHCLDRDRWRDAGWDYRAPGRPAALPWAPPAVPAQRAAQPHSPSQRHSQPKVPPRLAAGLATDQSF

SEQ ID NO: 45261 - protein, 953 aa, Flaveria bidentis
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLPLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPDAYKELVENCEILEGHYKDMMDIEFTVQENRLWMLQCRTGKRTGKGAVRIAVDMVNEWLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPNLKVGICGEHGGEPSSVAFFDGVGLDYVSCSPFRVPIARLAAAQVIV

SEQ ID NO: 45262 - protein, 387 aa, Yersinia pestis CO92
MSVIKMTDLDLAGKRVLIRADLNVPVKEGKVTSDARIRASLPTIEAALKQGAKVMVTSHLGRPTEGEYNEEFSLLPVVNYLKEKLSSPVRLAKDYLDGVEIAAGELVVLENVRFNKGEKKDDEALSKKYAALCDVYVMDAFGTAHRAQASTHGVGKFAPIACAGPLLSAELEALGKALGNPARPMVAIVGGSKVSTKLTVLGALSKIADKLIVGGGIANTFVAAQGHNVGKSLYEADLIPEAKRLLETCDIPVPTDVRVATEFSETAAATLKPANEIKDDEQILDLGDESAERLAEILKNAKTILWNGPVGVFEFPNFRKGTEIVARAIAESEAFSIAGGGDTLAAIDLFGIADQISYISTGGGAFLEFVEGKKLPAVVMLEERAKQ

SEQ ID NO: 45263 - protein, 956 aa, Flaveria pringlei
MMSSLFVEGMLLKSADESCLPAKGKQRRTGDLRRLNHHRQPAFVRWICRRKLSGVSRIEFHSGGLTPPRAVLNPVSPPVTTTKKRVFTFGKGRSEGNKDMKSLLGGKGANLAEMASIGLSVPPGLTISTEACEEYQQNGKKLPPGLWDEILEGLRYVQKEMSASLGDPSKPLLLSVRSGAAISMPGMMDTVLNLGLNDEVVAGLAGKSGARFAYDSYRRFLDMFGNVVMGIPHSLFDEKLEEMKAEKGVHLDTDLTAADLKDLVEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLATMETCMPEAYRELVENCKILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVLTIGDRVIKEGDWLSLNGSTGEVILGKQLLAPPAMSNDLETFMSWADQVRRLKVMANADTPNDALTARNNGAQGIGLCRTEHMFFASDERIKAVRKMIMAVTPEQRKAALDLLLPYQRSDFEGIFRAMDGLPVTIRLLDPPLHEFLPEGDLEHIVNELAVDTGMSEDEIYSKIEKLSEVNPMLGFRGCRLGISYPELTEMQVRAIFQAAVSMNNQGVTVIPEIMVPLVGTPQELRHQIGVIRGVAANVFAEMGLTMDYKVGTMIEIPRAALIAEEIAKEAEFFSFGTNDLTQMTFGYSRDDVGKFLQIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 45264 - protein, 481 aa, Neptuniibacter caesariensis
MSDSVFRNYIAGEWVEGSKGSVANISPADTSDVIGHYAQADKVQTEAAIAAAQEGQKEWQKSGLEQRYSVLMAIGDELIARKDELGEILAREEGKTLAEGVGETYRSGQFFHYYAAEVLRQMGETADSVRPGIEIETRREPVGVVGIITPWNFPTATGAWKIAPALAFGNAIVWKPANQVPASAWALTEIISRQNLPAGTFNLVMGPGAEVGDVLINSRDINALTFTGSLETGRKVAAATAVNLVKCQLEMGSKNALVVLDDADLENAVECAVGGAYGGTGQKCTASSRLIVTEGIHDRFVEAMVERMKKLVVGHPLKAGVHIGAVADARQMEQNLEYLELAKKEGGNLVYGGEVLNEETEGYFMQPALFTETTNAMTINRDEAFAPIACVIKVKDYDEALATLNDTNFGLTGGICTQSLKHASDFKRNAKTGCVMVNLPTAGTDYHVPFGGRKDSSFGPREQGTYAKEFYTVVKTTYISA

SEQ ID NO: 45265 - protein, 338 aa, Yersinia pestis CO92
MAIRIAINGFGRIGRSVLRALYESGRRAEISVVAINELASAEGMAHLLKYDSSHGRFAWDVRQECDSLYVGDDIIRLIHQSEIEQLPWSELGIDVVLDCSGVYGSREDGEAHVASGAKKVLFAHPGGHDLDATVVYGVNHQDLRAEHRIVSNASCTTNCIIPIIQLLDIAYGIESGTVTTIHSSMNDQPVIDAYHQDLRRTRAASQSIIPVDTKLAAGITRIFPKFCDRFEAISVRVPTINVTAIDLSVSVTHPVGVAEVNQLLQKAARGAFRGIVDYTELPLVSMDFNHDPHSAIVDGTQTRVSGQHLIKTLVWCDNEWGFANRMLDTTLAMAKSGF

SEQ ID NO: 45266 - protein, 949 aa, Mesembryanthemum crystallinum
MASAFKGILIRSPPDVCAETVAKVSQCNRAQLVKNSSTGFKNIFKLSEARKFHAPVASHLRSQAVMAPASDPTSTAIKRVFTFGKGRSEGNKGMKSLLGGKGANLAEMASIGLSVPPGLTISTEACQEYQEHGKQLSAGLWEEILEGLRVIEKDMGSYLGDPSKPLLLSVRSGAAISMPGMMDTVLNLGLNDDVVAGLAAKSGERFAYDSYRRFLDMFGNVVMGISHSSFEEKLEKLKQAKGVKLDTELTASDLKEVVEQYKNVYLEVKGEKFPADPERQLQLAIQAVFDSWDSPRAIKYRNINQITGLKGTAVNIQCMVFGNMGNTSGTGVLFTRNPSTGEKKLYGEFLINAQGEDVVAGIRTPEDLDTMRSCMPEAYKELVENCEILERHYKDMMDIEFTVQENRLWMLQCRSGKRTGKGAVKIAVDLVKEGIVDTYTAIKMVEPQHLDQLLHPQFEDPSAYKDRVIATGLPASPGAAVGQIIFSADEAESWQAQGKSVILVRNETSPEDVGGMHAAIGILTARGGMTSHAAVVAGGWGKCCVSGCSEIRVNDTDKVLLVGDKVISEGDWLSLNGSTGEVILGKVPLSPPALSGDLETFMSWADDIRVLKVMANADTPEDALAARNNGAEGIGLCRTEHMFFASDDRIKTVRKMIMAVTSEQRKVALDQLLPYQRSDFEGIFRAMDGLPVTIRLLDPPLHEFLPEGDVEQIVSELTLETGMAEDEIFSRIEKLSEVNPMLGFRGCRLGISYPELTEMQARAIFQAAVSMSNQGVKVFPEIMVPLVGTPQELGHQVSLIRNVAEKVFSETGSSLSYKVGTMIEIPRAALVADEIAMEAEFFSFGTNDLTQMTFGYSRDDVGKFLPVYLSKGILQSDPFEVLDQKGVGQLIKLATEKGRSARPSLKVGICGEHGGEPSSVAFFAEAGLDYVSCSPFRVPIARLAAAQVV

SEQ ID NO: 45267 - protein, 255 aa, Phytophthora infestans
MSVNVPTKILPSGARIPMIGLGVYQSEPGPETYNAILTSLKLGYRHIDTAEIYGNEEDVGRAVRDSGIPREEIFVTTKLFTTNWGYSKALAAGKASNDRLGIVYIYLYLLHAPGPPKERADTWRAVEDLREQETLRDIGVSNFNETLLATLRKTAHIKPAVNQVELHPWMMRQSLVNYQDGRPCLGLYCRRDRSYTRPSAGGVRRRQRIRDAAHRDRLKSNLESVKLKVTPEQVVKLASPDSYLRTAGCDQDRVM

SEQ ID NO: 45268 - protein, 620 aa, Klebsiella pneumoniae subsp. pneumoniae MGH 78578
MSFDIAKYPTLALVDSTQELRLLPKESLPKLCDELRRYLLDSVSRSSGHFASGLGTVELTVALHYVYNTPFDRLIWDVGHQAYPHKILTGRRDKIGTIRQKGGLHPFPWRGESEYDVLSVGHSSTSISAGIGVAIAAAKEDKQRRAVCVIGDGAITAGMAFEAMNHAGDIKPDLLVVLNDNEMSISENVGALNNHLAQLLSGKLYSTLREGGKKVFSGVPPIKELLKRTEEHIKGMVVPGTLFEELGFNYIGPVDGHDVLGLVSTLKNMRDLKGPQFLHIMTKKGRGYEPAEKDPITFHAVPKFDHTSGVLPKSSGGLPSYSKIFGDWLCETAAKDNKLMAITPAMREGSGMVEFSKKFPDRYFDVAIAEQHAVTFAAGLAIGDYKPVVAIYSTFLQRAYDQVIHDVAIQKLPVLFTIDRAGIVGADGQTHQGAFDLSFLRCIPDMVVMTPSDENECRQMLYTGYHYSDGPCAVRYPRGSGTGATLEPLASLPIGKGVVKRQGEKIAILNFGTLLPEAAAVADKLNATLVDMRFVKPLDTALILQLAGEHDALVTLEENAIMGGAGSGVNEVLMAHRRAVPVLNIGLPDYFIPQGTQEEIRADLGLDAAGIEAKIRDWLA

SEQ ID NO: 45269 - protein, 160 aa, Fusobacterium nucleatum subsp. nucleatum ATCC 25586
MLRIGNGYDVHKLVEGRKLMLGGVEVPHTKGVLGHSDGDVLLHAITDAIIGALGLGDIGLHFPDNDENLKDIDSAILLKKINNIMKEKNYKIVNLDSIIVMQKPKLRPYIDSIRDNIAKILEINSELINVKAKTEEKLGFTGDETGVKSYCVVLLEKKKC

SEQ ID NO: 45270 - protein, 299 aa, Klebsiella pneumoniae subsp. pneumoniae MGH 78578
MDFPQQLQACVEQANEALRRFIAPQPFQNTPLVEAMHYGALLGGKRLRPFLVYATGEMFGVCRTTLDAPAAAVECIHAYSLMHDDLPAMDDDDLRRGLPTCHIKFGEANAILAGDALQTLAFSILSDAPMVDVPDRDRLAMVSELAQASGVAGMCGGQALDLQAEGQQVDLQALERIHRHKTGALIRAAVRMGALSAGERGRAALPALDRYAENIGLAFQVQDDILDVVGDTATLGKRQGADQQLGKSTYPALLGLEQARKKAHDLIADARRSLDELAAQSLDTSALEALANYIIQRDK

SEQ ID NO: 45271 - protein, 393 aa, Listeria monocytogenes EGD-e
MKISKRLQNLPDQFFSSLVEKVGKKVAEGHDVINLGQGNPDQPTPKHIVEAMKTASEKPLNHKYSLFRGKQELKQAAADFYAREYNVTIDPNTEVAILFGTKTGLVELPMCLMDPGDTMLLPDPGYPDYLSGVVLGEVQFEKMPLIAENDFLPDFTKIPEDIAEKTELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQACVRELTARYENRRDAFISACREIGWEAVAPAGSFFAWMPVPEDFTSSEFADYLLEEVSVAVADGSGFGEFGEGYVRVGLLMDEERLEEAVTRVSKLHLFDKVTQQ

SEQ ID NO: 45272 - protein, 337 aa, Pseudomonas frederiksbergensis
MALQAGHPAVCTQGLCGRPVAPHCAAPSGHGAPLHGRRQPLMKSFNGRVAAITGAASGMGRALALALAREGCHLALADKNAQGLEQTLALIKTSTLSPVMVTTQVLDVADRQAMEAWAARCVAEHGQVNLVFNNAGVALSSTVEGVDYADLEWIVGINFWGVVHGTKAFLPHLKASGDGHVINTSSVFGLFAQPGMSGYNATKFAVRGFTEALRQELDLQRCGVSATCVHPGGIRTDICRSSRIDANMTGFLIHSEQQARADFEKLFITDADQAAKVILQGVRKNKRRVLIGRDAYFLDLLARCLPAAYQALVVLASKRMAPKQRRPVFETNDEPRL

SEQ ID NO: 45273 - protein, 626 aa, Synechococcus elongatus PCC 7942
MTNTVPSVPAVPNLPTQSDPFFNERSLEQLTQTVLQDLQQAGVSEAESAPTPLSVPTPALPTTSALAVPQSPTAIANVPAPPSSIDERSLAQLAQAVLQDPQLASAIASIFPSVTLPTSASVPRSVPVPPSFLPSLVPTAPPIHDEVGVIPHHQLPVPSQPTPAGLQQTASSKSGSGFYFIDEQVETAIAALHSNLTVFPQLTTSSIPTLTGAHSAGAVGFDIHQVRRDFPILQERVNGRPLVWFDNAATTQKPQVVIDRLSHYYQHENSNIHRAAHELAARSTDAYEAAREQVRHFLNAASTEEVVFVRGTTEAINLVAKSWGSQNLKEGDEIVITWLEHHANIVPWQQLSAETGARLRVVPVDDYGQVRLDEYQKLLSDRTKIVSFTQVSNALGTITPAKEIIELAHRYGAKVLLDGAQSVSHLAVDVQALDCDWFVFSGHKVFGPTGIGVLYGKQELLDATLPWQSGGNMIADVTFEKTVYQPAPARFEAGTGNIADAVGLGAALEYVQKIGLEAIAAYEHELLVHGTALLSQIPGLRLIGTAPHKAAVLSFVLEGFSPEAIGQALNREGIAVRAGHHCAQPILRRFGLETTVRPSLAFYNTFEELETLAAAIRRIQTGSLAL

SEQ ID NO: 45274 - protein, 579 aa, Fusobacterium nucleatum subsp. nucleatum ATCC 25586
MEWVMKQNNLIKGIPASPGIAIGKAFLYKENKLEIDEKSNLSKEEEIERLVKGREIAKKQLEEIKENTLKKLGKDKADIFEGHITLLEDEELFSEIDSKISQKKCTAEFALNEAIDEYATMLANLEDTYFKERAGDLRDIGKRWLYGVMNEQIVDLSKLEPETIIVAKELNPSDTAQINLDNVLAFVTEIGGKTAHSSIMARSLELPAVVGVGAVLDELEDNQILIVDALKGEVIVSPDVETLQIYKEKREKFLKEKEELKALKDKEAISKDGIKVDVWGNIGSPNDVKGIISNGGFGVGLYRTEFLFMEKDSFPTEDEQFEAYKIVAEELKGYPVTIRTMDIGGDKSLPYMELPKEENPFLGWRAIRVCLDREEILRTQFKALLRASKYGKIKIMLPMIMDIVEVRKAKAIFEECKKELQEKGIEFDKNIMLGIMVETPAVAFRAKYFAKECDFFSIGTNDLTQYTLAVDRGNEKIANLYDTYNPSVLQAIKMLIDGAHDGGIKISMCGEFAGDENAIAILFGMGLDAFSMSGISIPRVKRIIMKLEKKECQNLVERVLSLSTASEIKEEIKKFMEKI

SEQ ID NO: 45275 - protein, 176 aa, Triticum aestivum
  misc_feature (132)..(132): Xaa can be any naturally occurring amino acid
  misc_feature (158)..(158): Xaa can be any naturally occurring amino acid
MAPTVMASSATSVGPFQGLKSTVGLPVSRRSNGASLGSVSNGGRIRCMHVWPIEGGGKVDTLSYLPPLRTEALLEQVDYLIRSKWVPCLEFSKVGFIFRDHNTSPGYYDGRYWTMWKLPMFGCTDATQVINXVEEVKKEYPDAYVRIIGFDNMRQVQXCVSFIAFKPPGCEESGKV

SEQ ID NO: 45276 - protein, 194 aa, Exiguobacterium sibiricum 255-15
DEKPGTSCRVNRKIRQQSSSISNCLTMKPMLYVANVGEDEVADADSNENVRLVREFAAKEGAEVIIICARIEEEIAELEPEERQEFLVDLGIEESGLDQLIHAAYNTLGLATYFTAGEKEVRAWTFKKGMKAPQCAGVIHSDFERGFIRAEVVAYEDLAAAGNMATVKEQGRYRSEGKEYVFQDGDVVTFRFNV

SEQ ID NO: 45277 - protein, 159 aa, Listeria monocytogenes EGD-e
MNIQIVTVGKLKEKYLVQGIAEYLKRLSAYAKVTIVEVPDEKAPEVLSDAEMKQVKDKEGARILAKIPDDAYVIALAIDGKMKSSEEFAADLDKLATYGKSKVTFVIGGSLGLSEAVLKRSNERISFGRLTLPHQLMRLVLVEQVYRAFRIVRGEPYHK

SEQ ID NO: 45278 - protein, 320 aa, Glycine max
  misc_feature (159)..(159): Xaa can be any naturally occurring amino acid
  misc_feature (196)..(196): Xaa can be any naturally occurring amino acid
  misc_feature (209)..(209): Xaa can be any naturally occurring amino acid
  misc_feature (229)..(229): Xaa can be any naturally occurring amino acid
MVLPLFAAFILFFAFIPNGLLAVPSTVPAFLWSSHYELASENGLKESVNYQVISPKDLAKSVFSEAGWSNFLCKGKKLHEPLDLALLFVGRELQSSDLNMNKHADSALLDLLKISFARSNTSVAFPYVSTSEDVLLENSLISGFAEACGDMGIGNVAFXGSCSIDDANHEEITTLHSVQDYLTQRIGESHKGKTDXLVVFCNERLSASXEIVDGKHPERGSFIPFLTNXEESGAKYAVLYVSDPSRSIQYLSYRDLQRFLAESTAGNESTNSTICDEVCQLKSSLLEGILVGIVLLIILISGLCCMMGIDTPTRFETPQE

SEQ ID NO: 45279 - protein, 399 aa, Thermococcus kodakarensis KOD1
MIKPSERAMGVEYAIRDVVLPARELEKKGIEVIRLNIGDPGKYDFQPPEHMKEAYCRAIKEGHNYYGPSEGLPEMREAVVQREKRKNGVDITPDDVRVTTAVTEALQLLFGALLDPGDNILVPSPSYPPYTGLVKFYGGIPNEYDTIEENGWQPDIDDMRKRINERTKAIAVINPNNPTGALYEKKTVKEILDLAGEYDIPVISDEIYDLMTYEGEHVSPGSLTKDVPVIVMNGLSKVYFATGWRLGYFYYVDPENKLAEVREAVDKLMRIRICPSTPAQFAAIAGLTGPMDYLEEYMKKLKERRDYIYKRLTEIPGVSTQKPQGAFYIFPRIDERSKWKSDKEFVLDVLHEAHVLFVHGSGFGRAGNWHFRIVFLPPVEILEKAMDRFEEFMRKRLAE

SEQ ID NO: 45280 - protein, 303 aa, Solanum chmielewskii
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELDQTHLSTVVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 45281 - protein, 133 aa, Oryza sativa
MTTTPYSIPKPFKVCIIGSGNWGTAVAKLVAENTAEKPQIFEKNVQMWVFEEQIEGKNLTSIINEQHENVKYLPGIKLPENLIANPDVVSTVEGADLLVFNILHQFLPRVCKQLVGKVSPNARAISCLKGLEV

SEQ ID NO: 45282 - protein, 503 aa, Ralstonia sp. PHS1
MLITDPQATASTGNQSVARAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNAAGVPPGVYNVVHGFGPSSTGEFLTTHRGINAITFTGETRTGAAIMKAAADGARPVSLEMGGKNAAIVFADCDFDAAIEGTLRSCFANCGQVCLGTERVYVERPIFDRFVSALKKGAEGMQLGRPEDPATGMGPLISQEHRDKVLSYYKKAVEAGATVVAGGGVPDMPDALKGGAWVQPTIWTGLGDDSVIAREEIFGPCALVMPFDSEEEVIRRANDNDYGLATAIWTTNLSRAHRVAGAIEVGIAWVNSWFLRDLRTPFGGAKQSGIGREGGVHSLEFYTELKNVCIKL

SEQ ID NO: 45283 - protein, 303 aa, Solanum chmielewskii
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELHQTHLSTVVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 45284 - protein, 542 aa, Manihot esculenta
MAMNVSTTIGLLNATSFASSSSINTVKILCVTLFISIVSTIVKLQKSAANKEGSKKLPLPPGPTPWPLIGNIPEMIRYRPTFRWIHQLMKDMNTDICLIRFGRTNFVPISCPVLAREILKKNDAIFSNRPKTLSAKSMSGGYLTTIVVPYNDQWKKMRKILTSEIISPARHKWLHDKRAEEADNLVFYIHNQFKANKNVNLRTATRHYGGNVIRKMVFSKRYFGKGMPDGGPGPEEIEHIDAVFTALKYLYGFCISDFLPFLLGLDLDGQEKFVLDANKTIRDYQTPLIDERIQQWKSGERKEMEDLLDVFITLKDSDGNPLLTPDEIKNQIAEIMIATVDNPSNAIEWAMGEMLNQPEILKKATEELDRVVGKDRLVQESDIPNLDYVKACAREAFRLHPVAHFNVPHVAMEDTVIGDYFIPKGSWAVLSRYGLGRNTKTWSDPLKYDPERHMNEGEVVLTEHELRFVTFSTGRRGCVASLLGSCMTTMLLARMLQCFTWTPPANVSKIDLAETLDELTPATPISAFAKPRLAPHLYPTSP

SEQ ID NO: 45285 - protein, 1399 aa, Myxococcus xanthus DK 1622
MQLCFLPQLPRATFLIAVEYWAAMPKDIIDFQLERGRHEQLLGRQDALTTLDSFLLSGESARGWLLVKGGPGRGKSALLSSWLGARELAGQRVPHHFLRRGVEDWDRPEVVVRNLAAQVEALYPLHADLEAKPESRLREVLQRVSTAVLVPQRKQLVLLVDGLDELDASGPNPLPRFLPHALPPGVKVLCSSRPMYPHLSWLEARDNVRTLDLDGQRWAASNEEVVREYWAHVAPKFTPSLEPSLMAQAIKNAQGNVLHAVKLAEWLLEQPAEERRAAMLPSGLDAFLEDAWQRIQDQPMEVRGIVLEGLELVAVAREALPLSVLADVAEWKGISAREQFLRVARPFLLEESGHWGGEKAWRLFHKAFHDFILSKLGEQGELQQHRRLAENICKWSVDAPISGFRRNYTLRHGVTHWLKAQEWQHVRKLCMDLSFLEAKCQEIGIFAVEEDMPQAVDGVGELYKTALRDLHQAVRAESHWLREDAAAFPRLIYNRLLSQGWKAARIAEMLHFPGGLPALRLRHPVRLRHGEVRTLKGHDGPVNGCTVTPSGWVVSASDDKTLRVWELETGKELARMEGHEGWVRSCAVIPDGRVVSASDDKTLRVWELETGKELARMEGHKGPVWGCSVTPDGRLVSASFDEMLRVWELKTGIKLAQLVGHKGAVNGCAVTVDGRVVSASSDGTLRVWELETGKELARMEGHEGPVNGCAVTVDGRVVSASSDGTLRVWELETGKELARMEGHEEPVNGCAVAADGWVLSASNDKTLRVWELDTGREVAQLEGHEGPVKSCAVTEDGWVVSASDDKTLRVWELETARQSARRQDHKGPVWGCTATSDGRLVSASSDKTLKVWELKTKKELARLEGHDGWVRGCAVTANGRLVSASSDRTLRVWNLEAGKELMRLEGHAGPVNDCAVTARGQVVSASSDRTLRVWDLETGKELMRLEGHDGPVWDCAVTARGQVVSASSDRTLRVWDLETGKELVRLEGHDGPVLGCVMTADGRLVSASSDKTLRIWEPTTGKELARLEGHRGPVWDCAMTADGMVISASDDKTLGVWDIASGQRIHTFHGMSGFRSVAVTRDTVCAGDTLGNIWMTEIEPARVNQERSPKEKLESGTTVSVKIPAPVLEAYRSNKLALFVGSGLSLGKDVQGDFPTWGKLPERLLDACKRYDSLDEETIRLKHALFRNRMRLESMLSELGTLRTSLGRDYQNALNHIFRPPDAAPGKAQHAVIQLGVRAILTTNYDQLLELTPEMPRRQPYTWKDSDKALADLRAGRKILLKVHGTSEHHDTVVMSEVEYREAHSNSGYQAVLRHLLQEHLFLFVGYGMNDPLDLDLALKSNVESFGITTQRHYVLLRDAAANDHDRIEREYNIRIIDCSRHEQVPEFLESLAAAKAIP

SEQ ID NO: 45286 - protein, 329 aa, Lactobacillus johnsonii NCC 533
MKKEELHEMLHPMKLIGLGGNQALAERIAAALDKPLLETAVQHFSDGEIQVNITESVRGCDVYVIQSIQDPVNENFMELMIVLDALHRASAHSVNVVIPYMAYSRQDTKNRSREPITAKLLANLLQLTDIDDLIAVDLHASQIQGFYNIPVDHLHAMPILAQYFLDNGIASKENDDVVVVSPDHSGAKLVRTFGSYFDAPIAIVDQRGARYDAEAHDMIGDVKDKTVIIVDDLIDTGSRIASSTRSVLAAGAKKVYVAATHALLSQNAIDVLNELPVEQIVVTDTIKHKKYPDRMVRLSVARLLAKGIDYIYNDKSIHQIFDEQNRIQG

SEQ ID NO: 45287 - protein, 510 aa, Oryza sativa
NTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRSSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 45288 - protein, 627 aa, Corynebacterium glutamicum ATCC 13032
MVLSEDVMRVLIIDNYDSFTFNLATYVEEVTGQAPVVVPNDQEIDEMLFDAVILSPGPGHAGVAADFGICAGVIERARVPILGVCLGHQGIALAYGGDVDLAPRPVHGEVSQITHDGSGLFAGIPETFEAVRYHSMVATRLPESLKATATSDDGLIMALAHEVLPQWGVQFHPESIGGQFGHQIIKNFLNLARTYRWQLTEKTIPLSVDSAAVFETFFAHSSHAFWLDDAQGTSYLGDASGPLARTKTHNVGEGDFFTWLKEDLAANSVAPGQGFRLGWVGYVGYELKAEAGARAAHTSSLPDAHLIFADRAIAVESDQVRLLALGEQDEWFEETIKKLHNLVAPRIPASGHLALQVRDSKDEYLDKIRRAQELITRGESYEICLTTKLQGTTDVAPLAAYLALRGANPTAYGAYLQLGDTSILSSSPERFITIDSAGYVESKPIKGTRPRGRTAQEDQEIIAELRSNPKDRAENLMIVDLVRNDLARGALPTTVKTSKLFDVETYATVHQLVSTVSAELGPRSPIECVRAAFPGGSMTGAPKLRTMEIIDELEAAPRGIYSGGLGYFSLDGAVDLSMVIRTLVIQNNHVEYGVGGALLALSDPEAEWEEIRVKSRPLLNLFGVEFP

SEQ ID NO: 45289 - protein, 338 aa, Xanthomonas campestris pv. campestris str. ATCC 33913
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYHVEFDKAQG

SEQ ID NO: 45290 - protein, 400 aa, Xanthomonas campestris pv. campestris str. ATCC 33913
MSFFANVEQVPGDPILGLTEAYNADSRPNKVNLGVGIYYDENGRIPLLRAVQKIEQQLALDAKPRGYLPIDGLAAYDKATQELLFGAESALVASGRVATSQTVGGSGALRVGADLLKKLLPTSTIAISNPSWENHRAVFGAAGFEVVDYTYFDAASHGLNFDGMLADLAKLEPGTVVLLHACCHNPTGADLSREQWKQLAGLLKERNLFPFVDIAYQGFDKGIEADAYAVRLLAAEGIDTYVVASSYSKSFSLYGERVGALSVVSATAAEAKAVQSQVKRIIRTIYSSPSTHGAALVAGVLTSPELRDVWEQELTEMRERIHALRAGLVAKLAALGAPEFEFIQRQAGMFSYSGLTKSQVDRLRDEFAIYAVGTGRICVAALSQRNLDYVAQAVATVSRG

SEQ ID NO: 45291 - protein, 520 aa, Solanum habrochaites
MKSTVHLGRVSTGGFNNGEKEIFGEKMRGSLNNNLRINQLSKSLKLEKKEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 45292 - protein, 278 aa, Actinidia chinensis
MAAAAFVPIPTDTYKLGFIGAGKMAESIARGVVKSGVLPASRIRTAHLGSARREAFESFGVKVLDRNDQVVEDSDVIIFSVKPQIVKEVVLQLRPLLSEKQLLVSIVAGVKLKELEDWAGHSRFIRVMPNTPAAVGEAASVMSLGATATGEDGELITKLFGAIGKIWKADEKLFDAVTGLSGSGPAYIFLAIEALADGGVAAGLPRELALGLASQTVLGAASMVARGGKHPGQLKDDVASAGGTTIAGIHELEKGGFRGTLMNAVVSATKRSQEIFKR

SEQ ID NO: 45293 - protein, 509 aa, Xanthomonas campestris pv. campestris str. ATCC 33913
MNALPSAKSLNTDPQSIFKPRYDNFIGGAWVAPQGGQYFDNTTPITGKVFTSIARSTAPDIEAALDAAHAAKEAWGKTSTTDRSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMEVIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDTFMEKALKRVAAIKQGNPLDPNTMVGAQASSEQLEKILSYIDIGKQEGAEILIGGERNMLDGELSDGFYVKPTVFKGHNKMRVFQEEIFGPVVSVTTFKDEAEALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 45294 - protein, 379 aa, Pichia pastoris
MSTEGQIIKCKAAVAWEAGKDLSIEEIEVLPPRAHEVRVKVEFTGVCHTDAYTLSGADAEGSFPVVFGHEGAGVVESVGEGVESVKVGDSVVLLYTPECRECKFCLSGKTNLCGKIRATQGKGLLPDGTSRFRCKGKDLFHYMGCSSFSQYTVVADISVVKVQDEAPKDKTCLLGCGVTTGYGAAINTAKISKGDKIGVFGAGCIGLSVIQGAVSKGASEIIVIDINDSKKAWADQFGATKFVNPTTLPEGTNIVDYLIDITDGGFDYTFDCTGNVQVMRNALESCHKGWGESIIIGVAAAGKEISTRPFQLVTGRVWRGCAFGGIKGRTQMPSLVQDYLDGKIKVDEFITHRHDLDNINKAFHDMHAGNCIRAVITMH

SEQ ID NO: 45295 - protein, 299 aa, Zea mays
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHARSRNRSPPPQRRGPRARDDYRGGGGGGRGKGTRYYRSHNGTGKGGKHSRYYYGAGKGGKHSRYYYGGRRRHGSPPRGARSPVRENNEERRAKIYQWNRERKGKQ

SEQ ID NO: 45296 - protein, 214 aa, Leifsonia xyli subsp. xyli str. CTCB07
MREGVADAARAAGRSPDELTTIVVTKFHPASLVRELASLGVRDVGENRHQEAQEKVSVLADLELTWHFVGQLQSKKARQARRYAGVVHSIDRLSLVDALRNDDGTVLGAFVQLNLTDDPARGGVAGRDLEPLVDHILAAPGLRLLGVMAVAPLDEEPARAFERVRVASERVRALAPEAVAISAGMSQDYREAIAAGATHLRIGTAITGNRPLVR

SEQ ID NO: 45297 - protein, 440 aa, Glycine max
MASRLEQQQQPTNVGGENKQKNMGGEGRNRRVLQDIGNLVGKQGHGNGINVSKPVTRNFRAQLLANAQAATEKNKKSSTEVNNGAVVATDGVGVGNFVPARKVGAAKKPKEEPEVIVIISDDESDEKQAVKGKKAREKSAMKNAKAFSSVLSARSKAACGLPRDFVMNIDATDMDNELAAAEYIDDIYKFYKETEEDGCVHDYMGSQPDINAKMRSILVDWLIEVHRKFELMPETLYLTLNIVDRFLSVKAVPRRELQLVGISSMLIASKYEEIWAPEVNDFVCISDNGYVSEQVLMMEKQILRKLEWTLTVPTPYHFLVRDTKASTPSDKEMENMVFFLAELGLMHYPTVILYRPSLIAASAVFAARCTLGRSPFWTNTLMHYTGYSEEQLRDCAKIMANLHAAAAPGSKLRAVYKKFSNSDLSAVALLSPAKDLSALS

SEQ ID NO: 45298 - protein, 423 aa, Aspergillus niger
MGDVAVETPANNVTPLTKAAPLDTIPNIDSLEGTGNDGSDEYATLKRLQRHLEYIQLQEEYIKDEQRSLKRELVRAQEEIKRIQSVPLVIGQFMEAIDQNTGIVQSSTGSNYVVRILSTLDREKLKPSSSVALHRHSNALVDILPPEADSSIAMLGENEKPDVTYADVGGLDMQKQEIREAVELPLTQFDLYKQIGIDPPRGVLLYGPPGTGKTMLVKAVANSTTASFIRVNGSEFVQKYLGEGPRMVRDVFRMARENSPAIIFIDEIDAIATKRFDAQTGADREVQRILLELLNQMDGFEQSSNVKVIMATNRADTLDPALLRPGRLDRKIEFPSLRDRRERRLIFSTIASKMSLSPEVDLDSLIVRNEPLSGAVIAAIMQEAGLRAVRKNRYNIIPRSDLEDAYAAQVKTGQEADRLEFYR

SEQ ID NO: 45299 - protein, 110 aa, Glycine max
MDSSRRPSGIQQLLAAEQEAQQIVNAARAAKTARLRQAKEEAEREIAEYRAQMEADFQRKLTETSGDSGANVKRLEQETNVKIEQLKQQAANISPEVIQMLLRHVTTVKN

SEQ ID NO: 45300 - protein, 855 aa, Frankia sp. EAN1pec
MSTALYNRYRPATFAQVVGQEHVTEALGHALRSGRLHHAYLFSGPRGCGKTSSARILAASLNCEKGPTPEPCGVCDQCVSIRTGSSMDVTEIDAASHGLVDDARDLRERAFFAPASARFKVFVVDEAHMVTAAAFNALLKVVEEPPSYLKFVFATTEPDKVIATIRSRTHHYAFRLVPPGVLRKHLESICAQEGVVVEPSVLPLVVRAGAGSVRDSLSVLDQLLAGAGDGGLSYERAVALLGMTDGILLDETVDALAERDGAALFTVVDSVVSSGHDPRRFATDLLDRLRDLIVVAAVPDAVERGLLEAFSTDQVDRMRAQAGRIGPVELSRTADVLHAGLVEMRGTASPRLLLELILARALLPGAAGDPAALAVRLERLERRAVVGGGAGAGTTPTGGAEVGGATHADARFGGARPADGGPGFGGAADSAHGQAAAHAPAPAAHTQTARPASPARPAMPAAAAPGGGGLDAAALNARWDEVLALAVQRSRRTHAILKDYASVAEVRGDEVVLAFSAPAMAKMFGQGNNVEILATLLAEKFGGTWRVTIGGGPGSSGGRPQAPRGGPGNGRPDNGNGGGPGGYSGPGGPGGPGGPGGGQRGPTEQAGGGRPAEAVAPQRPNGYGGPAGQASPGGPSSPGAVDPSGGHPGGYSDAHGGPAVPVNAGAPGGWSAAGAGASRGSGAPGATLPAPSGVSAAPASMAHAGSSGPAAQDGLPRPPAGLHSATATASLGNASVSGAAAGSGVGSTAVAVPRLGTAEAGLAAARAAVSARTGLNGSTRTPTGPGGGPRAAGAARPGGASVAAASMSATDTAPDEVSLDDEDAPTQLGGARGGEDAAVALLRTSLGATVIEQSG

SEQ ID NO: 45301 - protein, 398 aa, Neptuniibacter caesariensis
MLEHIDAELEDPILKVMASFKASTVSHKLDLGIGVYRDSKGKTPIFKAVKEAELIIQMQETSKAYLGPVGDTQYTGLIHQLLFGQLDCPPDFFQIIQTPGGTGALRVAGEFLHSALPFATLWLSDPAWSTHKPIFSGAQLPTKEYRYFDHETRVLDFAAMCEDIAAIPTGDIVLLQSCGHNPSGCNLSYEQWLSVSQLMADRGLLPLLDLAYHGLDQGQILDLQSIKAIEAHHDEWLLCYSASKTFSLYNDRTGALAVRNRTIQNAHHALSLILNLVCANYYMPPAHGASVVRTILTSSDLTELWKHELEAARTRIIDCRKALIDALSSSGTDDYQFLERQEGMFAYLGLTEKELAWLREKHALYFGPGGRLNIAGLNPQSLPQISQALTELAKKKRG

SEQ ID NO: 45302 - protein, 514 aa, Vitis vinifera
MVQLLLSEPSWSDGGDEDSVKLRISLLNKLESIICSLISSRARSEARVWLCNAMAGIRSIMPRHQRDLFVDLFRSKPWKRGLAAQLWRMIFEKMPHKAGKIIAKKSYMLENFFKGNPTRIMHWFSNFSTGGGLETRKGAKALSQFAFVNRDICWEELEWQGKHGQSPAMVATKPHYFLDLDVQRTVENFLEYVPEFWSSDEFAESLKDGEICSIDRKFFVDVFVDLMYKEDSRSVWEAIDEFLMEESFSSLCQHLLIVIEEPDFCLFLELIHKYINPKMEHKDFGRSSCWLEIILSKCSHFESIDHILLLNAVINQGRQLLRLVHDEDTQEEQAKIKDVVLQICTISSNANGLAPILKCFKTKTTEVIKWLGLQSWVLHYRLSEECLTPESWESLFLNNGISFHKSDKYALLHDDGFAEENGSDLDDRTSIRARRKKKEKSRKKRKKNFDHDDIYENELLDFGTSSDRLGLGSHTGSWLLSTDGYSTSWSSVCSSGLVSPLERVVGARGDPQRL

SEQ ID NO: 45303 - protein, 291 aa, Chlamydia trachomatis D/UW-3/CX
MDYFSVYRSKVEKKLRDSLGDFGNTQGGLRDPIEYALLGGGKRVRPLLVGLFAEGVHKERDVLDTAIAIEYIHTSTLIADDLPCMDDDDMRRGKPSVHKAFDEASALLASYALIPAAYARIRKNAKALKAVVSCEQDVEEAYEDILELIELRFGVGGILGGQYEDIFFHDFSKENVLGIIKKKTGALFEIACVSGWLFGGGERESSTLVAEFAEHFGLLFQIRDDLADLSQDDQEEKHMNYALLFGEVAAKELLDHSFESCIKNLHLLQERGLECLEPLEMLCKNVFCGWK

SEQ ID NO: 45304 - protein, 451 aa, Lactobacillus johnsonii NCC 533
MDEKEKLKLKRSLKSRHVTMIAIGGAIGTGLFLGSGTAIQSAGPSIILSYLIVGIISFFMMRALGELILADPEQHSFIESVKKYLGNRMEFVAGWTYWLCWLSLAMADLTATGIYLKYWFKNLPQWVGPLVIVILLMLVNMVNVGLFGELESWFSMIKVLAILALIITGLILLIMHTKIDSRTVSLSNLVNYGGFFPTGSWGFLKSFQMVVFAFVGIEIVGLTAGETANPDKDIPKAINTLPVRIGLFYVGSMIAIMAVYPWNKIVTTTSPFVQVFGAIGIPAAAGILNFVVLTAAMSATNSAIFSTSRSLYALSRGNNAPKRFGKLSKKAVPNNALTFSSLILFIVVILNYIMPAQVFDIISSVSTINFIMVWIIIMWTHLKYRAENKEQLGKFRMPGFPITSWITIIFYLVILVILALIPATRLPLIISIIFILALALSYTLLERRKSK

SEQ ID NO: 45305 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPENGGPRICLGQQFALTEASYVTVRLLQEFGNLKQDPNTEYPPKLQNTLTLSLFEGAEVQMYLIL

SEQ ID NO: 45306 - protein, 160 aa, Exiguobacterium sibiricum 255-15
MMQITIITVGKLKEKYLKQGIAEYTKRLGAYCSIQEIEVPDEKAPEQLSDAEMQQVKKKEGERILAKIGPDVHVYALAIEGKQRTSEQFATELDRLATYGKSKIAFVIGGSLGLAPEVMQRANDTISFSKMTFPHQLMKMILCEQIYRAYRINRNEPYHK

SEQ ID NO: 45307 - protein, 77 aa, Brassica napus
  misc_feature (11)..(11): Xaa can be any naturally occurring amino acid
  misc_feature (14)..(14): Xaa can be any naturally occurring amino acid
  misc_feature (32)..(32): Xaa can be any naturally occurring amino acid
  misc_feature (34)..(34): Xaa can be any naturally occurring amino acid
GRVGFLPRKFXVAXTVPTDNGVYLLTNDIGRXVXSDENGEPHGFNLYVGGGMGRTYIMESTFDRLAKPLGYVPKEYI

SEQ ID NO: 45308 - protein, 523 aa, Lactobacillus johnsonii NCC 533
MELMISTFTLAIAAAISIIIAQAVDKVSVNYVSMLVGIIIGLIPFLNSQVASFDSEIFMELIVAPLLFFEGQKTRIHNIGRRIKEIIGLTVIMVLLALIISGFSIYLFTSISLPLAFIIGSISTPTDATASEAVTNGLRMPRRVTSSLKAESLFNDASGIILLNMSLLWFANGYINYGQTIHDFFVSSLGGAVLGFAVAWIIIIFRQSLIRSRFNSLNAQNLIYILTPLALYALAEDLHVSGIIAVVVAGLLHNAESQQSLLLNSRQIHMGRDLQNLISDIFNSMVFIILGLMMVRISRNKLFNGDLAKWILVGFIVYLANLLVRYVYGRLVIRYDRRESTVFSLGGIHGAVTLALALTISANFLGTKNYNLVIMSEAVLIILSMLVPTIVFQFILPHEVSDEEAHIVMEKIRNEMVKRALISVHKMYLPKRVKRHVIYTLLNQKRVVKTREYMRVLLKTIDQPNLTKSEQYLQRLAFFRAFAIEREYLEMIGQKESKYRTYILSLYNDVLLAESLIIESDDE

SEQ ID NO: 45309 - protein, 191 aa, Rhodopseudomonas palustris CGA009
MAAERERGGRERSREREERDSEFVDKLVHINRVAKVVKGGKRFGFAALVVVGDQKGRVGFGHGKAREVPEAIRKATESAKRNLTRVALREGRTLHHDIAGRHGAGRVYLRAAPAGTGIIAGGPMRAVFETLGIADVVAKSVGSSNPYNMVRATFDALKHLDSPRSVAARRNIKVSTLQARRVGGDAEVVAE

SEQ ID NO: 45310 - protein, 211 aa, Oryza sativa Japonica Group
MATEIEAYYDDGSGTYLLSFDEDFFDATLTKSGGKVESWLGETYRIHRSCGHPLVVGLDVEWRPAAPVPGPVAVLQLCVDRRCLVFQILHADYVPDALSRFLADPRFTFVGVGVRDDAARLRVGYGLEVPRAVDLRALAADTLGRPDLRRAGLRALVREVMGVQMDKPHHVRVSAWDKRNLSEDQFKYACADAFASREVGRRLYTCNCDGA

SEQ ID NO: 45311 - protein, 399 aa, Bordetella bronchiseptica RB50
MRFADRMARIAPSPSSMAGQRMRELRAAGRDVIGLTAGEPDFATPDNIQQAALRAMRNGQTKYTDVGGVPELKAAVAEKFRRENSLAYRQDQIIVSSGAKQVIFNALLCLVQRGDEVVIPAPYWVSYPDMVRFAGGTPVAVACAQQHRFKLQPDELERAVTPRTRCLILNSPNNPSGAAYDETELKALAQVLLRHPDICVITDDIYEHLLYDGRRFATIAAVEPALADRVLTVNGVSKSYAMTGWRIGYAGGPAALIANMVKLQSQSTSCPSAVSQAAAIEALTGPQDIIASSRKLFQARRDLLVRRINAIPGLHCDTPDGAFYVFASCAGLAGKRTPQGRTIDNDTDLALHLLDAEGVVVIQGDAYGMPGFFRLSIAASETLIEEAQRRIAAACAALH

SEQ ID NO: 45312 - protein, 371 aa, Yersinia pestis CO92
MSVQDTMLQQQALPGTPRQDGFFMPAEWAPQDAVWMLWPYRQDNWRGKAIPAQQTFAKVAEAISRATPVFMGVPAEFMAQAKATMPANVTLVEMASDDAWMRDTGPTMVINGAAERRAVDWQFNAWGGLNGGLYADWQQDEKVAVQVSDFLKNAHYSAPLILEGGSIHTDGEGTLLTTAECLLNPNRNPHLNQAQIEQLLCDYLGVTHFIWLQDGVYNDETDGHIDNMCCFVRPGEVALHWTDDQQDPQYARSVAAFEVLSNTVDAKGRKLKIWKLPAPGPLYNTEEETFDVLTSDAVPRTAGERLAGSYVNFLISNQQIIFPLLDSRTDGQANDLLQQMFPGYAIVGVPAREILLGGGNIHCITQQIPAA

SEQ ID NO: 45313 - protein, 311 aa, Neurospora crassa
MGISILSGILSSLSSIAQDPSPPPTNPPALPRHFIATVRSPSSVAKVESALSPLVKPSVSTLRVLQSTSNVSAAAEADIILLGCKPYMVSGLLSASGMKDALTVKHTEGHARSQKIIISICAGVTVPDLERVLREDVGLSADNLPIVVRAMPNTASKIRESMTVINTVDPPLPDTVTELLTWIFERIGEVVYLPPHLMDACTSLCASGTAFFALMMEAAADGGVAMGLPRAEANRMAAQTMRGAAGLVLEGEHPAILREKVSTPGGCTIGGLLVLEEGGVRAAVARAVREATVVASLLGGGGAKNVNGTRH

SEQ ID NO: 45314 - protein, 320 aa, Zalerion arboricola
MASTAKEGSELTLAVIGCGTMGIAILSGILASLDEIHAPNSQSSETDETPSKLPTKFIACVRSPKGAEKIKKALSPYKTPVKIIQSDNVTACREADVVLLGCKPYMAEGILGEEGMVDALKGKLLISILAGVPAEQIYGYMYGKTPVNPEKEGLCQVVRAMPNTASGIRESMTVIATSSPPLSATTSSLITWIFKRIGDVVQLPAATMDASTALCGSGPAFFALILEAAIDGAVAMGLPRAEAQRMAAQTMKGAAGLVLSGEHPALLKDKVTTPGGCTIGGLMVLEEGGVRGTVARAVREATVVASQLGKGVQGVNGTRF

SEQ ID NO: 45315 - protein, 188 aa, Glycine max
  misc_feature (96)..(96): Xaa can be any naturally occurring amino acid
  misc_feature (109)..(109): Xaa can be any naturally occurring amino acid
MAQDIATPPVPFDFELLVGDHLRTVTASSNSSRTDPWIEPERLKLRHRIGRGPFGDVWLATHHQSTEDYDEYHEVAAKMLPPIREEHMKTALEKFXELYFHCLRPARVXLATWNSNLKGKICIIMNFYEGSVGDKMAKLREGRISLPGVLRYGINLAKGILELHSKGILVLKLKPSNVLLDDTDQAIL

SEQ ID NO: 45316 - protein, 232 aa, Yersinia pestis CO92
MSTIQQNLQDVRARIATAAHNCGRSPEEVTLLAVSKTKPVAAIEKAIAAGQYAFGENYVQEGVDKIHSFVDNKTLEWHFIGPLQSNKSRLVAENFAWCHTVDRLKIAQRLSAQRPAAMPALNVLIQINISDEQSKAGISLSELPALADSISTLPNLCLRGLMAIPAPEHDYQRQLAVFTQMNQAFLTLKARYPQIDTLSMGMTDDMDAAISAGSTLVRIGTAIFGARVYNAD

SEQ ID NO: 45317 - protein, 273 aa, Yersinia pestis CO92
MQHRNITFIGAGNMARAIIAGLVAGGYPAKMISVCAPSAKNRDALATEFGVISSDDNIRESQKAEVVVLAVKPQLMADVCQQLQKQVDFSDKLVLSIAAGVQVARFYALLGNKLNLVRIMPNTPSLVGKGMSGLYAPEQVSAADRDFTTELMSAIGKVCWVDNEDGINSIIAAAGSSPAYFFLFMEAMQQETERLGFDSETARQLVQQAASGACALVEANPHVPLSALREQVTSKGGTTAEAIRVFNEQHLPEMVANAMRAAIARAKEMEKLF

SEQ ID NO: 45318 - protein, 479 aa, Methylococcus capsulatus str. Bath
MGKPTGFMEIARQDRRYTLVADRIQHYREFVVPLSDEEVSRQGARCMDCGIPYCHQGCPINNIIPDWNDLVYQGDWEEALEVLHSTNNFPEFTGRICPAPCEAACTLNLNDEPVTIKTIECAIADKAWEENRIRPQIPSRRTDKRVAVVGSGPAGLACAQQLARAGHGVVVYEKADRIGGLLRYGIPDFKMEKHLIDRRIAQMQAEGVIFRPNSHIGANIPLSRLMAEFDAIVLAGGSEKPRDLPVPGRELAGIHFAMEFLKQQNRRVAGDTIDEAEGILATDKHVIVIGGGDTGSDCIGTSVRQGAASVVQLEILPQPPAKEDKSLTWPNWPNRLRTSSSQEEGCERHWSIATKRFSGENGKVTAIHCIKVNWKQEGGRWVMEEIPGTEFTLQADLVLLAMGFVHPVQEGLLQETGVRLDERGNVQADTRNYRTSVDKIFAAGDMRRGQSLVVWAIREGRQAARAVDEFLMGRSDLPR

SEQ ID NO: 45319 - protein, 400 aa, Chlamydia trachomatis D/UW-3/CX
MSLFEQLPSFSPDSILGLAQAFQEDPREDKINLLLGTYEREKKRYGGFSSVRKAQSVFFDDEKDKNYLPIKGSSTFLEEMAALCFGEVDASRWVGVQAIGGTGALHLGASVYANASLAGKVYIPSQTWGNHSRIFAHQGLALEYYPYYDQETKELDLQGLKAILRSAPETSLVLLHCCCHNPTGKDIPLSEWPEIITIIKERDLIPFFDMAYLGFASGIEEDRRPVRLCIEAGVTTFVAGGASKIFSLYGSRVGFFGAIHQDKLDLNRILSFLEEQIRGEYSSPAREGVAIVTSILSNPYLRQEWELELNGIRQSLEEIRSSFVIAMRNVAGHSFDFIASQKGFFGYPGFSKEQVLFLREELGIYTTAGGRFNLNGITDKNINRVTHGFAQAYEYPRSVS

SEQ ID NO: 45320 - protein, 465 aa, Thermococcus kodakarensis KOD1
MKTVLLAGGKGTRLWPLSRELMPKQFVRFLDDESLFQKTVERALLFSKPSEIFVVTNKDYRFRVMDDLREIRIELPADNILLEPVGKNTLPAIVWAVLKIEEKFGPSKVAVLPSDHLIETGEAYERAFENAERLADKFLVTFGIKPNRPHTGYGYIKPGERIEEGGRLLGYRVDEFKEKPDLETAKRYVESGYYWNSGMFAFSTSLFLEEVEKHAPEVLEAFESSSSIEEAYEKAPEISIDYGVMEKTEKAAVVPLNVKWSDLGSFDAIYEVLEKDDAGNAVQIRGKKGYHIGVNSKNNLIMTERLTATVGVSDLVIIDTGDALLVAHRGETQKVKEIYRALREMNDERAIVHRTAYRPWGSYTVLEEGDRYKIKRLTVLPGKKLSLQMHYHRSEHWVVVRGTAKVIVGDRELLLRPGESTFIPAGVKHRLENPGKVVLEVIETQIGEYLGEDDIVRFVDDFGRD

SEQ ID NO: 45321 - protein, 452 aa, Triticum aestivum
MASTAAVPATNTNGNHALSVDSHSSQDVRRRTVVAKKKPTPELLTEGGVNGVSDDKVSSKKDIGHTSRGESVIDKPKYSSEGRKDALPPAPSAEHRKKSTTKQEKAKWETALSVLMKLCLLFTAFAWMGQVLWGWQNGDLSFTALDMKSRLSKVEVFKKTTRMLQVQLDILDKKLGDEIGKAKRDITKQFDDKGKKLETKVKTLEGKADILDKSLAELRNMGFVSKKEFDEILTQLKRKKGLDGTGSDITLDDVRIFAKEIVEMEIARHAADGLGMVDYALGSGGGKVVKHSGAFKKAKSILPRRSESHKMLEPSFGQPGECFALEGSAGFVEIRLRTGIIPEAVTLEHVDKSVAFDRSSAPKDFQVSGWYQGADDDSDKQPRTPTSLGEFTYDLEKSNAQTFQLDRTTADASVVNMVRLDFSSNHGQPELTCIYRFRVHGSEPGSLGTAAS

SEQ ID NO: 45322 - protein, 148 aa, Triticum aestivum
MAPAVMASSATTVAPFQGLKSTTGLPISRRSGSAGLNNVSNGGRIRCMQVWPIEGIKKFETLSYLPPLSTEALLKQVDYLIRSKWVPCLEFSKVGFVFREHNSSPGYYDGRYWTMWKLPMFGCTDATQVQCVSFIAFRPPGCEESGKA

SEQ ID NO: 45323 - protein, 317 aa, Glycine max
KAVKEKAGEREETTERSGMTECKYYQRSGGCKFGKSCKYNHTRGKISTAPAPLLELNFLGLPIRLGERECPYYMRTGSCKFGANCKFNHPDPTAVGGVGGDPASGYGNGGSISLQGVSQTSVPSWSSPRTLNESSPFVPMMLSPTQGVSTQSSDWNGYQASVYLPERNMHPPSTFVMNNPAIDTNVYMHHQKQMPVDEFPERPGEPECSYFLKTGDCKFKSNCKFNHPKNRVARLPPCNLSDKGLPLRPDQSVCSHYSRYGICKFGPACKFDHPINLQPVMIPGLGQQSYSNSASVEVAGIFGSTGVVTDATIQQSV

SEQ ID NO: 45324 - protein, 368 aa, Exiguobacterium sibiricum 255-15
MGQDYQQWVDRLAQKKTGERQDGVEVVIKPVPDRTESGVLDPRVLEVMMQQQQDSSPVGPFSLEAARAGMGWINTDLTTTDITTEDIMIPSAEQPIPARIYRPRSTEPLPAVVYFHGGGFFGGTLEPVEHPCRLLAERANVVVISIDYRLAPEHPFPAGLNDCFTAVKWVYEQGEELGINREQLAVAGDSAGGNLATVCALLDREQQTEMIQYQVLLYPVVNLAALPTDDFNWRLDAYEMNENRELLEGIVTALEDSDGLLNRLYLQGTTDVQDPHVSPLFSDKLTGLPDALIITAEYDYLRLEGEAYGRKLARSGVKTKRIQYNGMDHAFIEKLGQYPQAEDCITEIANGLQNRFAVMKSDTNTIGG

SEQ ID NO: 45325 - protein, 382 aa, Oryza sativa
  misc_feature (21)..(21): Xaa can be any naturally occurring amino acid
EAESEAAAHHSPPPSARANPXSLGGGDDQGGGGGSGARGRGSPMAPLVPSSQPWVEKYRPRQVKDVAHQEEVVRVLTTTLQTADLPHMLFYGPPGTGKTTTALAIAYQLYGPELYKSRVLELNASDDRGINVVRTKIKDFAAVAVGSARKGGYPCPPYKIIILDEADSMTEDAQNALRRTMETYSKVTRFFFICNYISRIIEPLASRCAKFRFKPLSEEVMSNRILHICNEEGLSLDAQALATLSTISNGDLRRAITYLQSAARLFGSSISSTDLISVSGAIPEDVVKSLLASCKSGEFDVANKEVNNIIADGYPVSQLISQFLDVIVNADDIPDEQKARICKKLGEADKCLVDGADEYLQLLDVASETIRALFDMPQTLVF

SEQ ID NO: 45326 - protein, 191 aa, Triticum aestivum
  misc_feature (107)..(107): Xaa can be any naturally occurring amino acid
  misc_feature (119)..(119): Xaa can be any naturally occurring amino acid
  misc_feature (121)..(123): Xaa can be any naturally occurring amino acid
  misc_feature (137)..(137): Xaa can be any naturally occurring amino acid
  misc_feature (144)..(144): Xaa can be any naturally occurring amino acid
FVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVXGLSTGQIKTGAXCXXXRLAKYNQLLRIEEXLGAIAVXQVQIRALWLQTGGINALFSNVTHCNLGPDNYKNHITVRPTIIYKSIC

SEQ ID NO: 45327 - protein, 510 aa, Xanthobacter autotrophicus Py2
MKDILEELESRRSVARLGGGARRIEAQHARGKLTARERIELLLDRGTFEEYDTFVQHRCVDFGMADQKVPGDGVVTGWGTVNGRKVFVFAKDFTVFGGSLSEEHARKITKIQDMALKTRAPIIGLFDAGGARIQEGVAALGGYGEVFKRNVVASGVIPQISLIMGPCAGGDVYSPAMTDFIFMVRDTSYMFVTGPEVVKTVTNETVTSEELGGAKVHTSKSSVADGSYENDVEMLLETRRLIDFLPSNNQEGAPEWPSFDDPGRYDESLDTLVPDNPNKPYDIKELILKVVDEGDFFEIQAAYARNMVTGFGRIEGRTVGFVANQPMVLAGVLDSDASRKAARFVRFCDAFEIPIVTFVDVPGFLPGTAQEYGGLIKHGAKLLFAYSQATVPLVTVITRKAFGGAYDVMASKHVGADVNYAWPTAQIAVMGAKGAVEIIFRADMGDPDKIAAQTKNYEERFLSPFVAAERGYVDEVIMPHSTRRRLARALAMLRTKKLEQPSRKHDNMPL

SEQ ID NO: 45328 - protein, 331 aa, Exiguobacterium sibiricum 255-15
MKNNFWQDLPRPFFVLAPMEDVTDVVFRHVVAKAARPDVFFTEFTNTESYCHPKGKQSVRGRLEFTEDEQPMVAHIWGDKPEYFREMSIGMAEMGFKGIDINMGCPVQNVAVNGKGSGLINRPDVAAELIQAAKAGGLPVSVKTRLGYSKVEEWHDWLRHILEQDIANLSIHLRTRKEMSAVPAHFELIPEIKKLRDEVAPQTLLTINGDINDRQHGLELVEQYGVDGVMIGRGIFHNPFAFEVEKKDHSSEELLDLLRLQLDLHDQYSSEFEPRLFKPLRRFFKIYVRGFRGASELRARLMDTNSTDDVRALLDEFVEQEGIHAVNSFSI

SEQ ID NO: 45329 - protein, 142 aa, Rhodococcus sp. RHA1
MRIADVLRNKGPAVVTVDPEMPVSTLIGELARHNVGALVVTENDAVVGIVTERDVVRRIHERGPDILNARVVDIMTTSVFTCLPTDTVDSLAETMTERRIRHLPVIVDGQLVGIVSIGDVVKSRIGELQTERDQLESYIDHG

SEQ ID NO: 45330 - protein, 369 aa, Vibrio fischeri ES114
MAISSAKDIIEDIRLGKMVILMDDEDRENEGDLIIAAEKITPEAINFMATHGRGLICLTMTKDRCEKLGLPPMVQDNNAQFTTNFTVSIEAAEGVTTGISAADRSRTVEAAVAKNAVAADLVQPGHIFPLAAQEGGVLTRAGHTEAGCDLARLAGYEPAGVIVEILNDDGTMARRPDLEIFAEKHGIKLGTVADLIEYRNNNETTIERVAECKLPTEFGEFDLVTYRDTIDNQLHYALKKENTSSEAPLVRVHLQDTFTDILHSDRCAERSWTLPTAMQRIANEGGVLVILGNEESTDSIVHKVKVLERQDSGEAPTMAKKQGTSRRVGVGSQILADIGISDMRLLSSTSKRYHALSGFGLNVVEYVTK

SEQ ID NO: 45331 - protein, 607 aa, Oryza sativa
  misc_feature (42)..(42): Xaa can be any naturally occurring amino acid
METHIGSVDGAAAAADNGAVGCPASAVGCPMTSARPAPVSAXGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 45332 - protein, 254 aa, Chlamydophila pneumoniae AR39
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 45333 - protein, 276 aa, Oryza sativa Japonica Group
MADRVHPMPAPPPPSSSPPLEHAAAATETTPLHPSFRGARPPSPGTYIIQIPKDQVLRVPPPDRARRYKKLAARPARRRRLRHACCAAFCAALLLLLLAAAFVGAVYLVFRPRAPSFSVASLSIRGLDALAVSSLTPQIDAAVRADNGANKKTGIDYRGGGEVTVSYAGERLAAGPWPAFHQAPRNVTVFSTALAGGGVSFPEEQRKRLAAEQAAGAVPLTVEAIVPVRLRFGKVLRTWTVDVKTRCEVTVNKLAAAAPPANRGCRVKVRPLWWWW

SEQ ID NO: 45334 - protein, 78 aa, Oryza sativa
  misc_feature (15)..(15): Xaa can be any naturally occurring amino acid
  misc_feature (57)..(57): Xaa can be any naturally occurring amino acid
VPFSCFVFVVAVSLXGKLYLLVGKWIQVIFEPPVLKVGSLGFQYGGESEFKLEITYXCDEKIRLGKGSRGACCCCMRR

SEQ ID NO: 45335 - protein, 517 aa, Zea mays
MAMAAIASPSSRTLIPPRHHGAAPSPSTSGDSSLRLLCAHPRHGRRGRAMSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRKAIIDKNARIGDNVKILNADNVQEAARETDGYFIKGGIVTVIKDALLPSGTVI

SEQ ID NO: 45336 - protein, 190 aa, Agrobacterium tumefaciens
MRGKDKNMSAKSDPGSHYTVTEVVRDVEIENSIGTFSAACIRVKANNETTDHLAFYKSIGVPLTLRIQSGCVLGHVFGDNECDCKAQLDKSLRYIHSQNEGMVIYTPSHDARGRGIYSKLQIYRTRQERCIDSAAACRETGVPFDTRDFSQFSSILGVFDVKSVALLGRSAAKAKALIEAGISVVSSVPL

SEQ ID NO: 45337 - protein, 340 aa, Xanthomonas campestris pv. campestris str. ATCC 33913
MSRARILCFGELLLRLGAPGHELLLQQPRLEVHCGGAEANVGVSLAHFGHDVAMVSTVADNPLGAAVLGELRRHAVDTRHVRRVDGRVGLYFLTTGAIHRASEVVYDRADSAFALAPADAYDWPRLLDGAQWLHLSGVSPALGADVAQATLAAARAARAAGVKVSFDGNYRPKLWQRWQGDARGILHDLFACADVVFADYRDIGVVLGGEFPQDTLEARVEAAAQQAFAAFPQLQLMACTQRVAHNVDHHSLGAMLVPRDGAVAFAPAEELTPIIDRIGGGDAFAAGVLHGLIEGWSLDDTVRFGLAAGCLKHSIPGDFNPLSVADVQACVGDARFDVKR

SEQ ID NO: 45338 - protein, 308 aa, Yersinia pestis CO92
MVTTLDNALLNDILQQVRPLIGQGKVADYIPALAEVPANKLGIAVCTLDGQIFQAGDADERFSIQSISKVLSLTLALSRYSEQDIWQRVGKEPSGQPFNSLVQLELEKGKPRNPFINLGALVVCDMLQSRLSAPKQRLLEVVRQLVKDDSISYDPRVARSEFEHSDRNAAIAYLMKSFGNFDNDVLTVLQTYFHYCAMRMSCVELARCFVYLANQGRSISGSESLITPMQARQINALMITSGMYDGAGEFAFRVGMPGKSGVGGGIIAIVPDEFCIAVWSPELDHAGNSLAGTAALERLAQQMGRSIF

SEQ ID NO: 45339 - protein, 522 aa, Physcomitrella patens subsp. patens
MAQRKNTSYKMYYILNRLKDGYLYNSGSNLTTVSITVVGASGDLAKKKIFPALFALYYEGCLPKHFTIFGFARSKMTDESLREMISGTLTCRIDQSENCGEKQEEFLKRCFYHAGQYSSEESFGQLSDKLRKQEGSRVANRLFYLSIPPNIFVDVARSSSLAASSANGWTRVIVEKPFGRDSESSAELTRGLKTYLKEDQIYRIDHYLGKELVENLSVLRFSNLVFEPLWSRQYIRNVQLIFSEDFGTEGRGGYFDNYGIIRDIMQNHLLQILALFAMEPPVSLDAEDIRNEKVKVLRSMRVLDVDNVVVGQYKGHTRGGVKYPAYLDDKTVPKNSITPTFAAAAVFIDNARWDGVPFLMKAGKALHKKRAEIRVQFRHVPGNLYKRSFGTDLDLATNELVIRVQPDEAIYLKINNKVPGLGMRLDRSNLNLHYADRYDREIPDAYERLLLDAIEGERRLFIRSDELDAAWALFTPLLNELEKRKISPELYPYGSRGPVGAHYLAAKYNVRWGDNSSELDSA

SEQ ID NO: 45340 - protein, 194 aa, Klebsiella pneumoniae subsp. pneumoniae MGH 78578
MALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMAHHTGQSLEQIERDTERDRFLSAAEAVEYGLVDSILTHRN

SEQ ID NO: 45341 - protein, 370 aa, Glycine max
MALGDDAQHHSHSPSFLDSLLCEERETFEEDFDANGDECETENNDPSVIKSQPLPLVLYDNDLFWEDDELVSLIAKEGETHLRSFSDGALEGPRVEAVNWVSKVSGHYGFSALTTVLAVNYFDRFITSLKFQRDKPWMTQLAAVACLSLAAKTEETHVPLLLDLQVEESRFVFEAKTIQRMELLVLSTLKWRMLPVTPISFFEHIVRRLGLKSRLHWEFLWRCERVLLNIIADSRVMSYLPSTLAAATMIHVIKEIESFNATEYIDQLLGLLKISEEQVNKCYRIIQKLLGCHEGIYGLPQKCKRLSELGSPSAVTDASFSCDSSNDSWAVSSSVSLSLEPQLKRRRSQDQQMRLPSVSRVSIDVLNSPH

SEQ ID NO: 45342 - protein, 633 aa, Leifsonia xyli subsp. xyli str. CTCB07
MTTSQTDPLIGRLIDGRYQVRSRIARGGMATVYLATDLRLERRVAIKVMHGHLADDTTFKNRFVQEARSAARLAHPNVVNVFDQGQDSDMAYLVMEYLPGITLRDLLKDYGKLTPEQTIDIMEAVLSGLVAAHKAGIVHRDLKPENVLLADDGRIKIGDFGLARAASANTATGQALLGTIAYLSPELVTRGVADARSDIYALGIMMYEMLTGEQPFQGEQPMQIAYQHANDAVPTPSGKNPAVPAELDDLVQWATEKDPDRRPKDARELFDRLVEAEKSLRGEAALQLTMVLPPAFEAAEGETQIINPAIRQQVAASAPSATDRLSAASARRRAKGWWLFALVILLAGLAGGTGWYFGAGPGSLVTVPNVVSKTPAAAAAKLTELGFRTKQAQEYSVTVPAGQVSSTVPVAETPAGRGSTVTLRVSQGPKPVTIPPLAGHPLDTAKAAITGVGAKVGTIAEQFDGKVHSGTVISATKTSDGGDISGGGPYFEAASVDLVVSVGPVPDVAGKSVESATALLHKAGLVVVAGPESYSETIAKGDVISAQPQAAVVRPGDTVALKTSKGPEPVPVPDVVGQTWDKAKKTLTEAGFALKYSTAADLLPGAFVVSKISPDAGTQADKGSTVTVNFASF

SEQ ID NO: 45343 - protein, 577 aa, Physcomitrella patens subsp. patens
MKGPILTAMEIYKICDPLVAPTNDRDWAAIESIKVDMNLTSWRGDPCLPKPHHWINCSSVDKTENPAVLTVVLSAENLTGAISPSFNDLLDLTTLKLDGNSLTGQLPDLSALTNLKTLHLQDNALSGPLPEWLAFLPKLRELIVQNNNFSGKIPSAFSSKNWNFTYYGNPLLNATLPASPSTNTAAIVGGVAGGVAFVAIVVALVYYLVCRRNRRPAKDMDTLIVGNSNPNIVSKEININLTSNIHGGARKFSPDEIVAATANYKKVIGRGGFGPVYYGRLTDGREVAVKVLDKESRQGETEFLNEVDILSRVHHKHLVNLVGYCRVPGMQMMLIYEYIHRGSLRDHLSGTVTSEGSANSGPDVLDWKTRLNIALHAASGLEYLHKGCSPSLIHRDVKSSNILITTKYEGRLTDFGLSRLVGDEDITKVVTFVKGTAGYLDPEYFSTNVLSAKSDVFSFGVVLLELITGRLPVDRSKPTEWNICDWVRASLAQGNIEAILDPAVRASHPNVDALWKVAEIALQSVEPRSKHRPTINEVVLELTGAIALEGSASNDSSYGNFSSSAEIHGTQFLPWAR

SEQ ID NO: 45344 - protein, 229 aa, Leifsonia xyli subsp. xyli str. CTCB07
MFYWLLKYVIAGPLLRGVFRPWVVGLENVPKDGAVILASNHLSFIDSVFLPIVVDRHVSFLAKSDYFTRRGLKGWATKAFMTATGQLPIDRSGGKASEASLNTGLAVLARGEILGIYPEGTRSPDGKLYRGRTGAARMILEAGVPVVPVAMVDTAEIMPIGKRLPKFGRIGIVIGEPLDFSRFDGMEGDRFILRSVTDEIMYVLQGLGDQEYADVYASTVKEKRAAPSA

SEQ ID NO: 45345 - protein, 172 aa, Synechococcus elongatus
MSIDLSRIPAQPKPGVVNVLVEIAGGSRNKYEFDKEMKVFALDRVLYSAVVYPYDYGFIPNTLADDGDPLDGLVMMDEPTFPGCVIPARPIGMLEMIDSGDRDEKILCVPVDDPRYAEVKSLKDIAPHRLEEIAEFFRTYKNLQKKVTEILGWQDVDAVQPLVEKCIKAYKG

SEQ ID NO: 45346 - protein, 156 aa, Vibrio fischeri ES114
MNVIEGGVAAPNAKIAIVISRFNSFINESLLSGAIDTLKRFGQVSEENITVVRCPGAVELPLVAQRVAKTAKYDAIVSLGSVIRGGTPHFDYVCSECNKGLAQVSLEYSIPVAFGVLTVDTIDQAIERAGTKAGNKGAEAALSALEMINVLSQIES

SEQ ID NO: 45347 - protein, 357 aa, Catharanthus roseus
MRSNLCHPLKNQLPISFFLSGTIRKPIFSCSRLSISAIITKEQTQEESESKSKKEVAFSSSSSFDFKAYMIGKANSVNKALEDAVLVREPLKIHESMRYSLLAGGKRVRPMLCIAACELFGGTESVAMPSACAVEMIHTMSLMHDDLPCMDNDDLRRGKPTNHKVFGEDVAVLAGDALLAFAFEHIATATKGVSSERIVRVVGELAKCIGSEGLVAGQVVDVCSEGIADVGLEHLEFIHIHKTAALLEGSVVLGAIVGGANDEQISKLRKFARCIGLLFQVVDDILDVTKSSQELGKTAGKDLVADKVTYPKLLGIDKSREFAEKLNREAQEQLAEFDPEKAAPLIALANYIAYRDN

SEQ ID NO: 45348 - protein, 455 aa, Exiguobacterium sibiricum 255-15
MEQQGLKRDLSNRHVQLIAIGGTIGTGLFLGSGKAIQLAGPSIVFAYLLVGIAIFFVMRALGELLLSKAGYQSLTDIAEDYLGPRAAFVTGWTYWFCWIMTAMADVIAVGVYVKYWFDIPQWIPAVIALLILLGFNLLTVKLFGELEFWFALIKVVTILALIGVGIVLLVIGFNTDAGPVTVKNLWQHGGMFPNGVTGFLLSFQMVVFAYVGVELVGVSAAETADPKKNIPSAINKIPLRILFFYVGALLVLLMINPWTGLNATESPFVKTFSLIGIPVAAGIINFVVLTSAASACNSGMFSTSRILYNLGNQKQAPQSFSKLNKNHVPANALFVSTLVVSGGALLSKLLPGQAFSIVTTISAICFIWVWGVILVCHLKYKKTQPELHAASTFKAPLTPFVNYLVLGLFTLILIVMLVADETRPALLLTPVWFIGLFILYQLRTKKHQKAERHSA

SEQ ID NO: 45349 - protein, 210 aa, Bradyrhizobium sp. ORS278
MRDPVETYMNLVPMVVEQTNRGERAYDIFSRLLKERIIFVTGPVEDGMATLIVAQLLFLEAENPKKEIAMYINSPGGVVTSGLAIYDTMQFIRPAVSTLCTGQAASMGSLLLCAGHKDMRFSLPNSRIMVHQPSGGFQGQATDIMLHAQEILSLKKRLNEIYVKHTGQPYKAIEDALERDKFLTAEAAQEFGLIDKVLDKRPEDPAAMGK

SEQ ID NO: 45350 - protein, 643 aa, Xanthobacter autotrophicus Py2
MTLLKTPLLDTIRDAADVRRLPQDKLAQLAAELRAETIDAVSVTGGHLGAGLGVVELTVALHHVFNTPHDRLIWDVGHQCYPHKILTGRRDRIRTLRQGGGLSGFTRRAESEYDPFGAAHSSTSISAGLGMAVARDLSGEERNVVCVIGDGAMSAGMAYEAMNNAGAMDSRLIVILNDNDMSIAPPTGAMSAYLARLISGQTYRSLREIGKQIAGHLPKFVERGAARAEEFARGFWTGGTLFEELGFYYVGPIDGHNLDHLLPVLKNVRDAKTGPILVHVVTQKGKGYAPAEASADKYHGVVKFDVVTGAQVKAKSNAPSYTRVFAESLISQARHDPKVVAITAAMPSGTGLDLFGQVYPERTFDVGIAEQHAVTFAAGLAAEGFKPFCALYSTFLQRAYDQVVHDVALQGLPVRFIIDRAGLVGADGATHAGAFDIAFLACLPGMTVMAPADEAELVHMMATMVAFDDGPSAVRFPRGEGVGVERPERGEVLPIGKGRIVHGTGEGDIALLSLGTRLAACLDAAERLEAAGFTVTVADARFAKPLDRELVLKLAAGHGALVTVEEGSVGGFGSHVLQLVTDEGLLDRGAVKVRAMVLPDIYIDQETQARQLAAAGLDADAIVAKVEGLLGKAKAGVSLHKAG

SEQ ID NO: 45351 - protein, 303 aa, Solanum chilense
TNSINDALSSSYLVPFESYRVPLLDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 45352 - protein, 184 aa, Arabidopsis thaliana
  misc_feature (21)..(21): Xaa can be any naturally occurring amino acid
  misc_feature (46)..(46): Xaa can be any naturally occurring amino acid
  misc_feature (88)..(88): Xaa can be any naturally occurring amino acid
  misc_feature (101)..(101): Xaa can be any naturally occurring amino acid
  misc_feature (130)..(130): Xaa can be any naturally occurring amino acid
  misc_feature (145)..(146): Xaa can be any naturally occurring amino acid
MAISMLSSATMDASPDRVTMXAPFKVIHSSAAFPATRRAKKDITSXITINGRRVNCMPGCSPMGRKKFETLSYLPDHTESKLDIVDDXLMLMKGMPCGEFXLEQGFGYREDVISPRYYDCDGHCTMWKLXMIGCTDSAQVSNELXXCYKEYPNVLLYGFVGFEHTRQALCINCIGYHSEASQKS

SEQ ID NO: 45353 - protein, 303 aa, Solanum chilense
TNSINDALSSSYLVPFESYRVPLLDLEEATNNFDDKFFIGEGGFGKVYKGVLRDGTKVALKSCKPESSQGIEEFETEIEVLSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKMRPESLRKFGETAVKCLALSSEDRPSMGDVLWKLEYA

SEQ ID NO: 45354 - protein, 187 aa, Exiguobacterium sibiricum 255-15
MSLIGSEVKPFSASAFHNGEFVDLTDANLRGKWSVVCFYPADFTFVCPTELEDLQNQYATLKALDVEVYSVSTDTHFTHKAWHETSETIGKIEYVMIGDPSHVISRNFEVLNEQDGLADRGTFIIDPDGVIQTVEINAGGIGRDASTLVNKIKAAQYVRNNPGEVCPAKWEEGSATLTPSLDLVGKI

SEQ ID NO: 45355 - protein, 466 aa, Exiguobacterium sibiricum 255-15
MLHSIGVIGLGVMGRNIALNMASRQEDVAVYNYTRDLTDDLMAHNEGLPVHPYYEVADFVQSLARPRKIFVMVTAGSAIDSVIESLIPHLETGDIIMDGGNSHFHDTERRFDQLQQHGIEYIGVGVSGGEVGARTGPAIMPGGTKEAYEQVAPILTKIAAQVNGDPCCVYIGPKGAGHFVKMVHNGIEYADMQLIAEAYSFLRVRLGLDVEEIADVFASWNEGELKSYLIEITADILRKKDDETGLPLIDVILDQAGQKGTGKWTSMQSIDNGIASSIITEALFARYLSAVKEERVAAATVLGGPEARETLDKDVWIERIRQALYMGKIAAYAQGFTQYRTSSELYDWNLRLEEIALIFRGGCIIRADFLNVISEAFAKDESLANLMLAPYFADKVQDYQTALRQVVAESSLSGLAAPCLSTSLTYYDSYRTANSNANILQAQRDYFGAHTYARTDREGTFHTEWQ

SEQ ID NO: 45356 - protein, 627 aa, Vibrio fischeri ES114
MSLDISKYPILALANTPDELRSLPKESLPALCDELRTYLLNSVSKTSGHLASGLGVVELTVALHYVYNTPFDQLIWDVGHQAYPHKILTGRREQLSTIRQKDGLHPFPWRGESEYDVLSVGHSSTSISAALGLAICAEKEQENRKIVSVIGDGAITAGMAFEALNHAGDIHPDMLVVLNDNEMSISENVGALNNQLARVLSGSLYTSIREGGKKVLSGTPTIKELLKRTEEHLKGMVVPGTMFEELGFNYIGPVDGHDVNELVRTLKNMRNLKGPQFLHIMTKKGKGYEPAEKDPISYHGVPKFDPSNTSLPKSSGGKPTFSAVFGDFLCDMAKEDSKLMAITPAMREGSGMVRFSKEYPNQYFDAAIAEQHAVTLASGMAIAGYNPIVAIYSTFLQRGYDQLIHDVAIMDLPVMFAIDRAGLVGADGQTHQGAFDISFMRCIPNMVIMTPSDENECRQMLYTGHKHTGPSAVRYPRGSATGIQVNNEMQALEIGKGRLLRETKVTEKGERVAILNFGTFLANSLEAAEKLDATVADMRFAKPLDEALICELVTNHDVLVTIEENAISGGAGSGVIEFLMKNRLVKPVLQLGLPDEFIAQGTQEEMHTELKLDANGIEQQIRDYLDL

SEQ ID NO: 45357 - protein, 301 aa, Vibrio fischeri ES114
MDKMTDSLKQQLTFFQNRNIEQLNQWLEKIEIQQQPLTEAMKYSLLLGGKRARPYLVYITAQMLGIKAEFADSAAAAIECVHSYSLIHDDLPAMDNDDLRRGHATCHIKYDEATAILAGDALQTLAFEILANGQLSDDAETSRIDMIRVLSKASGASGMCMGQSLDLQAEGKKVDLASLERIHANKTGALIKCAVQLGALCAGDKGKAILPQLEIYADAIGLAFQVQDDILDIISDTETLGKPQGSDLELDKSTYPALLGLEGAKHKAEQLYQTAIEALNDIPYNTDAMQAFAQYVIERKN

SEQ ID NO: 45358 - protein, 243 aa, Pseudoalteromonas tunicata D2
MLQDKTGQHIPTVTFPFRKDDQWHAITTEEIFKGKNVIVFSLPGAFTPTCSSTHLPRYNELAPIFKANGIDSIICMSVNDTFVMNAWVKDQEADNIDVIPDGAGLFTEAMGMLVDKSDIGFGKRSWRYSMLVKDGVIDKMFIEPDLPGDPFEVSDADTMLNYINPNQEPCKAITLITKPTCPYCHKAKLLLTENNMPFEEIVLGKDASLTSLKALSGRQTVPQVFIDGVHIGGSDDLAEFLAR

SEQ ID NO: 45359 - protein, 665 aa, Coprinopsis cinerea okayama7#130
MLFSKFFSHPPVKDDSDESASLLVKSGGSGERVVPVVEASSSSSRWEEEGVPASGTLEDDEGDSSGRREQSGERFDDVPDSKRRLGLFSAALLIFNRVIGTGIFATPSNILRSSGSVGMALAMWLIGAMIAACGSAVYTELGTGLPRSGGEKNYFEFIYRRPKYIATCIFSIYSVLSNTGTANSVVFSEYLLNALSIPATYFNTRFIAWLCLTFIVLMHGTRLAPWGLRLQNTLGAGKFLVLAAIAFSGLLCLADVPGFRVREGYEMPDNFSSWDKFWEGSKGKGSNAFVSGLYNVIWSFIGYSNANYALSEIKDPVRTIKRAAPLAMCAVTAVYIFINVAYFAAVSKSDILGSKRIVAALFFRNLFGPATERVLSGFIALSTLGNLLAGQFSQGRVVQELGREGIIPFSSKIASSKPFNAPLVAMLVQYSLSCTFLFLVPSGDAYLFMLSCEFSAPLNVIFVFPYSHPPLPSFPLPCSTMLLVSSYSLNIINTLVAVGLFLLYTRPFKGLHWDPPFKANKAVVGMYLASNLFLLGAPWIPPLPGSRPYRNLPYWSHAAGSFAISLVGIAYWYIWSRWLPSKKGYKLERTVVRMEDGVSRVVFRKVYVAPVVEGGDGEGRVAGEEVAERDGERERVGGYERVPGEVEDEGGWDSGVIQLCYLGRV

SEQ ID NO: 45360 - protein, 499 aa, Vitis vinifera
MELLSCLLCFLAAWTSIYIMFSARRGRKHAAHKLPPGPVPLPIIGSLLNLGNRPHESLANLAKTYGPIMTLKLGYVTTIVISSAPMAKEVLQKQDLSFCNRSIPDAIRAAKHNQLSMAWLPVSTTWRALRRTCNSHLFTPQKLDSNTHLRHQKVQELLANVEQSCQAGGPVDIGQEAFRTSLNLLSNTIFSVDLVDPISETAQEFKELVRGVMEEAGKPNLVDYFPVLRRIDPQSIRRRLTIYFGRMIEIFDRMIKQRLQLRKNQGSIASSDVLDVLLNISEDNSSEIERSHMEHLLLDLFAAGTDTTSSTLEWAMAELLHNPETLLKARMELLQTIGQDKQVKESDISRLPYLQAVVKETFRLHPAVPFLLPRRVEGDADIDGFAVPKNAQVLVNAWAIGRDPNTWENPNSFVPERFLGLDMDVKGQNFELIPFGAGRRICPGLPLAIRMVHLMLASLIHSYDWKLEDGVTPENMNMEERYGISLQKAQPLQALPVRV

SEQ ID NO: 45361 - protein, 144 aa, Brassica napus
  misc_feature (2)..(2): Xaa can be any naturally occurring amino acid
  misc_feature (11)..(12): Xaa can be any naturally occurring amino acid
  misc_feature (17)..(18): Xaa can be any naturally occurring amino acid
  misc_feature (21)..(22): Xaa can be any naturally occurring amino acid
  misc_feature (26)..(26): Xaa can be any naturally occurring amino acid
  misc_feature (29)..(29): Xaa can be any naturally occurring amino acid
  misc_feature (43)..(43): Xaa can be any naturally occurring amino acid
  misc_feature (49)..(50): Xaa can be any naturally occurring amino acid
  misc_feature (59)..(59): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (95)..(95): Xaa can be any naturally occurring amino acid
  misc_feature (98)..(98): Xaa can be any naturally occurring amino acid
  misc_feature (107)..(107): Xaa can be any naturally occurring amino acid
  misc_feature (109)..(109): Xaa can be any naturally occurring amino acid
  misc_feature (122)..(122): Xaa can be any naturally occurring amino acid
  misc_feature (126)..(126): Xaa can be any naturally occurring amino acid
  misc_feature (141)..(142): Xaa can be any naturally occurring amino acid
MXSSMLSSAAXXTSPAXXTMXXPFTXLKXSAAFPVTRKANNDXTSIASXXGRVSCMKVXPPXGKXKXETLSYLPELTEVEWDKEVDYLLRNKWIXLCXEFELEHGFXVXREHGSTPGILTMXRYWXQWWKASPWVGCTDSXXRG

SEQ ID NO: 45362 - protein, 499 aa, Vitis vinifera
MEMLSCLLCFLVAWTSIYIMFSVRRGSQHTAYKLPPGPVPLPIIGNLLNLGNRPHESLAELAKTYGPIMTLKLGYVTTIVISSAPMAKEVLQKQDLSFCNRFVPDAIRATNHNQLSMAWMPVSTTWRVLRKICNSHLFTTQKLDSNTHLRHHKVQELLAKVEESRQAGDAVYIGREAFRTSLNLLSNTIFSVDLVDPISETVLEFQELVRCIIEEIERPNLVDYFPVLRKIDPQGIRRRLTIYFGKMIGIFDRMIKQRLQLRKMQGSIATSDVLDTLLNISEDNSNEIERNHMEHLLLDLFVAGTDTTSSTLEWAMAELLHNPEKLLKARVELLQTIGKDKQVKESDITRLPFLQAVVKETFRLHPVVPFLIPHRVEEDTDIDGLTVPKNAQVLVNAWAIGRDPNIWENPNSFVPERFLELDMDVKGQNFELIPFGAGRRICPGLPLATRMVHLMLASLIHSCDWKLEDGMTPENMNMEDRFGITLQKAQPLKAIPIRV

SEQ ID NO: 45363 - protein, 172 aa, Zea mays
MADREHRTVFVTVGTTCFDALVMAVDSPEVKKALLQKGYSNLLIQMGRGTYVPLKVSGDATLQVDHFTFSPSIADNMRTASLVISHAGSGSIFETLRLGKPLIVVVNEDLMDNHQSELAEELAERKHLFCARPQTLGETIRAMDLETLVPYEPGDAKPVVTLINRFLGFPVD

SEQ ID NO: 45364 - protein, 770 aa, Oryza sativa Japonica Group
MALIGTVAAEVLIPLAAVIGILFAVLQWYMVSRVAVPPHDGVGGAGKVERESDGGDGDGDGVDDEEDGVDYRGVEARCAEIQHAISVGATSFLMTEYKYLGAFMAAFAAVIFVSLGSVGRFSTSTEPCPYDAARRCRPALANAAFTAAAFLLGATTSVVSGYLGMRVATFANARTALEARRGIGRAFAVAFRSGAAMGFLLASSALLVLFAAVNAFGLYYGDDWGGLYEAITGYGLGGSSMALFGRVGGGIYTKAADVGADLVGKVERNIPEDDPRNPAVIADNVGDNVGDIAGMGSDLFGSYAESSCAALFVASISSFGADHDFAAMMYPLLVSAAGIVACAATTLVATDAGELGAADEVAPALKRQILISTVLMTAAVAAVTFLSLPRSFTLFDFGERKLVKNWHLFICVSAGLWAGLVIGYVTEYFTSNAYGPVQTVAQSCRTGAATNVIFGLAVGYKSVIVPIFAIAGAIYASFRLAAMYGIALAALGMLSTIATGLTIDAYGPISDNAGGIAEMAGMPRRVRERTDALDAAGNTTAAIGKGFAIGSAALVSLALFGAYVSRAGIRTVNVVSPRVFVGLLAGAMLPYWFSAMTMRSVGSAALRMVEEVRRQFDEIPGLAEGLAAPDYATCVRISTDASLREMVAPGALVMASPLVAGTLFGVEALAGLLAGALVSGVQVAISASNSGGAWDNAKKYIEAGATEEARSLGPKGSEAHKAAVIGDTIGDPLKDTSGPSLNILVKLMAVEALVFAPFFAAHGGIVFNHL

SEQ ID NO: 45365 - protein, 500 aa, Arabidopsis thaliana
MLYFILLPLLFLVISYKFLYSKTQRFNLPPGPPSRPFVGHLHLMKPPIHRLLQRYSNQYGPIFSLRFGSRRVVVITSPSLAQESFTGQNDIVLSSRPLQLTSKYVAYNHTTVGTAPYGDHWRNLRRICSQEILSSHRLINFQHIRKDEILRMLTRLSRYTQTSNESNDFTHIELEPLLSDLTFNNIVRMVTGKRYYGDDVNNKEEAELFKKLVYDIAMYSGANHSADYLPILKLFGNKFEKEVKAIGKSMDDILQRLLDECRRDKEGNTMVNHLISLQQQQPEYYTDVIIKGLMMSMMLAGTETSAVTLEWAMANLLRNPEVLEKARSEIDEKIGKDRLIDESDIAVLPYLQNVVSETFRLFPVAPFLIPRSPTDDMKIGGYDVPRDTIVMVNAWAIHRDPEIWEEPEKFNPDRYNDGCGSDYYVYKLMPFGNGRRTCPGAGLGQRIVTLALGSLIQCFEWENVKGEEMDMSESTGLGMRKMDPLRAMCRPRPIISKLLL

SEQ ID NO: 45366 - protein, 361 aa, Corynebacterium glutamicum ATCC 13032
MTLTLGIVGLPNVGKSTLFNALTRNDVLAANYPFATIEPNVGLVELPDARLERLSEIFGSERILPATVSFVDIAGIVKGASEGEGMGNAFLANIREADAICQVVRAFADENVIHVDGEVNPATDISVINTELILADLQTVEKALPRLEKDARKDKGLGEVVDETKKALAILSDDRTLFSAAKAGDIDLALLRDLHLMTAKPFLYVFNSDEKVLTDDAKKDELRALVAPADCVFLDAQTETELLELEEDEAAELLEAVGQTEPGLHSLARAGFETLGLQTYLTAGPKESRAWTIHKGDTAPQAAGVIHSDFERGFIKAEIVSFEDLDAAGSMAEAKAQGKVRQEGKDYVMVDGDVVEFRFNV

SEQ ID NO: 45367 - protein, 485 aa, Methylococcus capsulatus str. Bath
MSSVTVKPLILSGGVGSRLWPHSREAYPKQFLPLLGERTLFQETTGRIGGMAESRFDIRSPLIVCNEQHRFLVAEQLRQMGYDDADILLEPSGRNTAPALTIAALHVSERLGGDCILAVMPADHHIADVEGFRAGLARALGVAGRGLIGTFGIVPDRPETGYGYIRKGRSLEDGTVFELEAFVEKPDAETAAQYLSSGDYLWNSGLFVLRANVWLERIGSHRPDILESCSAAYEKATADGNFIRVDRTDFLRCPSDSIDYAVMEKLNGTGQAVVIPLDVGWCDLGSWASLSEVKPRDEHGNVVEGDVYARDTRNSLLYADSRFLAAIGVDDLLVVDTADAVLVAHKSKAQDIKQIAEHLEAANRTEHKVHRRVHRPWGTYESIDTGQRYQVKRITVTPGAALSLQMHHHRAEHWIVVRGTARVVRGEESFLLTENQSTYIPIGVHHRLENPGTIPLEIIEVQSGSYLGEDDIVRFQDHYHRTKEG

SEQ ID NO: 45368 - protein, 363 aa, Methylococcus capsulatus str. Bath
MALHVGIVGLPNVGKSTLFNALTKAAIAAENYPFCTIDPNVGVVPVPDPRLEVLAGIVKPERVVPTAIEFVDIAGLVAGASKGEGLGNQFLAHIRETDAIAHVVRCFENDDIVHVAGKVDPLSDIEVIGVELILADMATVEKALQRAQKAAKSGNKEEIERVRVLELVSKGLNSGTPVRAIPLPPEDAALLRELHLLTAKPTMYIANVQEGGFDNNPLLEQVEAFARNEGAVVVPVCAAFEAELSQLEDEDKADFLAEIGFEEPGLNRVVRAAYRLLNLFTYFTAGVKEVRAWTIPAGATAPQAAGVIHSDFEKGFIRAEVIAYEDFVACQGEQGAKDAGKWRLEGKDYVMRDGDIVHFRFNV

SEQ ID NO: 45369 - protein, 274 aa, Corynebacterium glutamicum ATCC 13032
MARKHLLSLADWNRGELEALFELAEQYEAGGGPRFDGAAAMFFPPTSLRTRLSFERGATAMGLQPITFPSDSLDKDEDLVDVVGYLSQWADVVVVRHPQLTALQRLASADAAPVINAMTSENHPCEVLSDLYALSRHHDISALRYLFVGGDGNIARAWWEAAQAFGLEMRQSCPEELRVVGMPWEENLPHAIASADVVLTDGPGRHAELLEPYRVTAALLDRAPRGVRLAPCPPFIRGREVSADAIEHPAFVGYSFKRHLMPVQQAILARSINA

SEQ ID NO: 45370 - protein, 490 aa, Arabidopsis thaliana
MSVFLCFLCLLPLILIFLKNLKPSKWKLPPGPKKLPIIGNLHQRRELHPRNSRNLSEKYGPIVFLRYGFVPVVVISSKEAAEEVLKTHDLECCSRPETVGTRAISYNFKDIGFAPCGEDWRTMRKLSVVELFSSKKLQSFRYIREEENDLCVKKLSDLASRRSLVNLEKTLFTLVGSIVCRIGFGINLRECEFVDEDSIDDLVHKSEDVIRNSIFSDFFPGLMGRLIEWIFSERKRLNRLYSEVDTFFQNILDDHLKPGRESSDIIDVMIDMMKKQEKEGDSFKFTTDHLKGMISDIFLAGVGTSSTTLIWAMTELIRNPRVMKKVQDEIRTTLGDKKERITEEDLNQLHYFKLMVKEIFRLHPAAPLLLPRETLSHVKIQGYDIPAKTQIMINAYAIARDPKLWTNPDEFNPDRFLDSSIDYRGLNFELLPFGSGRRICPGMTMGIAIVELGLLNLLYFFDWGLPEKEEAKEIITGNEVALDLVQVFLH

SEQ ID NO: 45371 - protein, 275 aa, Bradyrhizobium sp. ORS278
MAMHQTHPQSGKLATLDPIWDRIRTEAEEIVRREPELATFIYSTVLHHSRLEDSVVHRVADRLDHSALSGDLIRQTFDDALRDEPDLGHAFRADLVAVYDRDPATSRFIDPLLYFKGFHALQTHRLAHWLYRKNRKDFSFYLQSRSSAVFQTDINPAARIGRGIFLDHATGFVCGETAVIEDNVSILHGVTLGGTGKENEDRHPKIRHGVLIGAGAKVLGNIEVGHCARIAAGSVVVKPVPNNVTVAGVPAKIVGEAGCAEPSRTMDQMINAIGI

SEQ ID NO: 45372 - protein, 163 aa, Methylococcus capsulatus str. Bath
MRHIISVLLENESGALSRVAGLFSARGYNIESLTVAPTQDPTLSRMTIVTSGSDEIIEQITKQLNKLIDVVKLVDLSESAHIERELMMVKVRATNGGREEVKRLADIFRGNIIDVTPTSYVIEVTGEKSKLDAFLQALRDEDLIEVVRSGTTGILRGERGLHV

SEQ ID NO: 45373 - protein, 409 aa, Vitis vinifera
  misc_feature (258)..(258): Xaa can be any naturally occurring amino acid
MKPPFSSPTSSSVLRKARFSPYLFTLLAFIVFVAVLYGEDFSCIVELGSESDGRPIEKRREKLPFAIGEIEGGRCDVFSGMWVRDESNRPLYEESECPYIQPQLTCQEHGRPEKEYQFWRWKPHDCSLPNFNATLMLETLRGKRMMFVGDSLNRGPVCFYDAKSMETFDSLTIFTAKEYNATIEFYWAPFLLESNSDDAVIHRVSDRIVRKGSINKHGKYWKGVDILVFNTYLWWMTGLKMKILRGSFDDEVKDIVEXTTEDAFRMAMKSMLKWVEKNMDPKKTRVFFTSMSPSHAKSIDWGGEAGKNCYNETTMIEDPTYWGSDCRKSVMEVIGEVFSKSKVPITFLNITQLSSYRRDAHTSIYKKQWSPLTPEQLANPVSYADCVHWCLPGLQDTWNELLFTKLFYP

SEQ ID NO: 45374 - protein, 209 aa, Leifsonia xyli subsp. xyli str. CTCB07
MDGVGAISSRVWTIPNALSFFRLALVPVFLAFVIAGHDALALLVLVVSSLTDFLDGWLARRVDQVSRLGQLLDPAADRLYIFAALIGLAWRDIVPWWLVAVIVLRDVMLAVLGVILANHGYGPLPVRHLGKVATFCLFWALPLLMLGEAFTLLAPSSLPLGWAFALWGAFLYWWAGIAYLRETARVIRLPADDSGARSDTLDGKEADGA

SEQ ID NO: 45375 - protein, 636 aa, Coccidioides immitis RS
MEALQSLANKCMGCSLAQILSSGSILLATWFAVRLAYRYTLARRERPVDFSVPIPPELSPSWQGKTWSEVGDADREILEAQSFGEFGPSKILSYCPADGRLLGDENGVKPASPEKIDLAVRRAVVAQLKWKRTTFAERRRVLRTLLTYILAHQDEIVTACCLDSGKTKVDACFGEILVTAEKLKWTIDHGEESLRTDSRPTNLLMMYKKNTVRYEPLGVIAGCVSWNYPFHNFISPVISAIFAGNSIIVKPSEHTAWSSMFFYNIIREAIVSCGHSEYLVQALMCLPRHADVLTSHPKVNHIIFIGSRPVAHEVCKSAAKSLTPVTVELGGKDPVIVLDDDSTLKDISSVTSILMRGVFQSAGQNCVGAERIIALPRAYNKILETVTPRIKALRLGSVLLESREDKSDASHKPHTPDVGAVISQRSFDLLEALISEAVGQGAKLICGGKRYNHPKYPHGHYFTPTLLANVAREMRIAQMELFAPVFLLMRATDVSDAVSIANSTEYALGASVFGHNKRDVEYCISNLHAGMVAVNDFAVYYAVGLPFGGLKGSGYGRFGGAEGLRNLSNLKAVCVDGWPLIQTKIPPTLDYPIQKGEGIGKDGRGAWEMCKGVVETGYHPSLGGKARGIQKILKNI

SEQ ID NO: 45376 - protein, 204 aa, Arabidopsis thaliana
  misc_feature (148)..(148): Xaa can be any naturally occurring amino acid
YISHVSSDSSASSKAKSPKPKRGKLDKDKMTALEKHVSFFDRNKDGTVYPWETYQGFRALGTGRLLAAFVAIFINMGLSKKTRPGKGFSPLFPIDVKNSHLCMHGSDTDVYDDDGRFVESKFEEIFNKHARTHKDALTAEEIQKMLKXTNRDPFDITGWLSDYGVNSPDRACSLAKQAFDDAIAELDPLGEESYKGQYTDYAAC

SEQ ID NO: 45377 - protein, 110 aa, Glycine max
MASNRGQGGIQQLLAAEQEAQRIVNAAKNEKLARLKQAKEEAEKEIAQYRAQLEAEFQKKVSDSTGDSGANVKRLEQETDEKIQHLKTEAARISDDVVAMLLKHVTSVKN

SEQ ID NO: 45378 - protein, 263 aa, Klebsiella pneumoniae subsp. pneumoniae MGH 78578
MQEIQFYLVDAFSDKNFGGNAAAVCPLSEWLADDVLLKMAQQHNQSETAFFVRTDEGYELRWFTTLAEINLCGHATLAAAHVIFEYLDHPSATILFSTRFVGELRVTRNGDWLTLDFPAWSTSPVENPPVDLLTGLGLEAAVEVREGRDYLVVLADRQQVEAVRPDMARLRTLGKMICVSAPDEEYDFISRFFCPGEGVPEDPVTGSAHSMLIPWWGEKLGKTTMMARQVSARGGDLRCQWQGDRVLISGQATTYMRGTVYLR

SEQ ID NO: 45379 - protein, 466 aa, Exiguobacterium sibiricum 255-15
MKEGTFRRKMESRHIVMLSLGGVIGTGLFLSTGYTLEQAGRVGTILSYLVGALAIYLVMLCLGELAVHMPETGAFHSYATKYIGSGTGYTVAWLYWLTWTVALGSEFTAAGLLMQRWFTDVPVWLFSALFVVMILGINVLTVRLFAEVEFWFSAVKVLTILVFIVLGTAAIVGFLPLADGSQAPLLAPLTEGGLFPNGAFAILMTMLAVNFAYSGTELIGIAAGEAVDPKRTVPLAIRTTVFRLVLFFVGTIIVLAILLPNDSKGVLESPFVAVFERIGLPFAADIMNFVILTAILSAANSGLYAASRMLWSLSDQRMITPYFSKLNASGVPTRAVLFSMLGGLLALFSSVYAPGSVYIALVSISGLAVVVVWMSISASQFMFRKRYLQEGHDLNDLVYRTPWYLFVPILSFLMCLASLIGIAFDPTQRVALYFGVPFIAVCYIVHHLTKTSWKRSVEDVKEQQSS

SEQ ID NO: 45380 - protein, 122 aa, Vitis vinifera
MSRLFLNSPAPTSALVTPHPPKFSTTYHTSYLVRLPQWKWKTTCFRNSGVDAFFSDPILQQALKEPVAFAGGMFAGLLRLDLNEDPLKEWVTRTVEASGISEEEIDDEGSKPEEVPQQIEIE

SEQ ID NO: 45381 - protein, 341 aa, Vitis vinifera
MEIRIKVVSTSLCRSDITAWSQAPIFPRIFGHEASGIVESVGEGVTEFEEGDHVLTLFTGECMTCRHCTSGKSNMCQVLGLERKGVMHSDQKTRFSIKGKPIYHYCAVSSFSEYTVVHSGCALKVSSLAPLDKICLLSCGVSAGLGAAWKVANITEGSTVVIFGLGTVGLSVAQGAKQRGASRIIGVDINSEKMEKAKAFGITEFVNPHDCNEPVQQVIKQMTDGGADYSFECIGDTGMVTTALQSCCDGWGLTVTLGVPKVNPEISSHYGLFLSGRTLRGSLFGGWRPKSDLHSLVDMYMRKEIQIDEFITHNLPFEDINKAFDLMMEGKCLRCVIHMPK

SEQ ID NO: 45382 - protein, 586 aa, Aspergillus nidulans FGSC A4
MDNHPVDRPAKRPKISSHSEPENLKNSSLSDIASLRRSITPPPARSERPSVSTTSVISPHQHSDQDINKANASQIIPSPIQLNHISDFSDSLRNNDDTVKLRDILGDPLIRECWQFNYCFDVDFLMDQFDEDVRNLVRVKVVHGSWKKDSENRVRIEKACQRYPNVEPIVAYMPEPFGTHHSKMMILLRHDDFAQVVIHTANMLAGDWGDMCQAIWRSPLLPLTDGHEDKNSTAWGTGARFKRDLLAYLKAYGVKKTGPLVEQLGKYDFSAVRAALIASVPSKQKVDASSIDGNSKTKWGWPALKEALRNVPLRENVGADGTATVPHIVTQISSIATLGQTDKWLKDVFFNALAASSSSTKTRPRYSVIFPTAEEIRRSLKGYGYGGSIHMKLQSAAQKKQLQYLRPYLCHWAGDVSGQAPKRLQDAGRRRAAPHIKTYIRFADQHMRSIDWALVTSANLSTQAWGAAANAAGEVRVCSWEIGVLVWPELLTTEPQGQRKHQQQSRSVAMVPCFKKDKPDPSSKVGNAAPAALIGFRMPYDLPLTPYSTQDEPWCATMSHIEPDWLGQTWINSIASFHHHGQLPYW

SEQ ID NO: 45383 - protein, 315 aa, Klebsiella pneumoniae subsp. pneumoniae MGH 78578
MVGKEPRVATVINNAMLEAILAEIRPLIGRGKVADYIPALASVSGDKLGIAISTVDGQHFAAGDAHERFSIQSISKVLSLVVAMNHYQEEEIWQRVGKDPSGQPFNSLLQLEIEQGKPRNPFINAGALVVCDMLQSRLSAPRQRMLEIVRRLSGVADIAYDPVVARSEFEHSARNAAIAWLMKSFGNFHNDVATVLQNYFHYCSLEMSCVELARTFLFLADRGIAPHLDAPVIAPIQSRQVNALMMTSGMYQNAGEFAWRVGLPAKSGVGGGIVAIVPQEMAIAVWSPELDDAGNSLAGVAMLEKLTQRMGRSVF

SEQ ID NO: 45384 - protein, 578 aa, Zea mays
  misc_feature (379)..(379): Xaa can be any naturally occurring amino acid
MAGQTAKAKEAEKDDRQEPGAEGAKDKLLPSHQQQESPASVADNDSSGVSSVPGDESPVLDGDSGELKVEENLDGNGSKEKKTSQKSSTSDGFASAKVSDGTSSLRKTSGSATMSTRADFTESGKSSMCRVSTASDISDESSCSSMSSATTKPHKGNDSRWEAIHVVKSRDNVLGLNHFRLLKKLGSGDIGSVYLSELSGTRSYFAMKVMDKTSLASRKKLLRAQTEREILQSLDHPFLPTLYTHFETDKFSCLVMEFCPGGDLHTLRQRQPGKYFSEQAAKFYVAEVLLALEYLHMLGIIYRDLKPENVLVREDGHIMLSDFDLSLRCSVSPTVIKSANPGLDAMQRNNAAYCAQPACIEPSCIQPSCVAPTTCFGPXRFFSKSKSKSKSKSKKDKSKPDAPNQENLFPELIAEPTDARSMSFVGTHEYLAPEIIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPVELECRPKQVPSANGKVAPAPNQKGPDNYLEFEFF

SEQ ID NO: 45385 - protein, 295 aa, Bacillus cereus ATCC 10987
MKKVRKAIIPAAGLGTRFLPATKAMPKEMLPIVDKPTIQYIVEEAVKSGIEDIIIVTGKTKRSIEDHFDNAFELEQNLLEKKKYELLEKVQASSKMVDIHYIRQKEPKGLGHAVWCARKFIGDEPFAVLLGDDIVQAEKPCLRQLIEEYDKTLSSVIGVQTVPEDETHRYGIIDPLEQEGRRYQVRNFVEKPAAGTAPSNLAIMGRYVLTPEIFMFLDQQHIGAGGEIQLTDAIQSLNEIQRVFAYDFEGKRYDVGEKLGFVQTTIEMALQHPELRDDMVTMMKKILEEQTNQES

SEQ ID NO: 45386 - protein, 296 aa, Pseudoalteromonas tunicata D2
MKKIQKAVIPVAGLGTRMLPATKAIPKEMLPIVDKPLIQYVVAEAIAAGIKEIVLVTHASKNSIENHFDTSFELEATLEKRVKRQLLAEVQSICPKDVTIIHVRQGEAKGLGHAIACAAPIIGDQPFAVILPDVILDDATCNLKQDNLAAMIAKYNQDGLSQIMVEEVPHHDVDKFGVVDIQGVRLNAGESAKIVAMVEKPPVDEAPSNLAVVGRYVLNEKIWQMLKRTPPGAGDEIQLTDSIALLMETDDVEAYYMKGKSHDCGSKLGYMKANISYALRRDDLKDELTTYIKTLL

SEQ ID NO: 45387 - protein, 176 aa, Bradyrhizobium sp. ORS278
MAIYELDGQAPELPTDGNYYIAENATVIGRVKLAKEVTVWFGAVIRGDNDWIEIGESSNIQDNATCHVDPGFPLRVGRNVTVGHNVILHGCTVEDDALIGMGSIIMNGAHIRRGSVVGAGAIITEGKDFPEYSLIIGAPARVVRTLEPSQVERMGIAAKAYVAKGPRYTKGLKKIG

SEQ ID NO: 45388 - protein, 469 aa, Zea mays
FGSSDSAIFDLGVPILGICYGCQELAWQINSANVARGEAREYGHADVIIHKVDNHVDRLFAGLGETMHAYMSHFDKLVSLPEGFVVVASTSNSEFAGIANKTKPIFGVQFHPELEHTPRGSELLRNFSVDICGANPSWVMGDFVQQEISRIRHLVGDRAQVIGAVSGGVDSTVAAKLMKEAIGDRFHAVLVDNGLMRLNECEQVKATLGEHLGINLTVVDAADLFLGRLAGVLEPEKKRKIIGSTFIDLFEKEAERIEKEAENTPNAGKVEWFLQGTLYPDVIESLSFKGPSATIKTHHNVGGLPERMMNGQGLRLLEPLRLLFKDEVRAIGRTLNIHHDLIMRHPFPGPGIGIRILGEVTPERVEIARKADHIYISMIKEAGIYDQMSQAYAGVDTNKAVGVMGDTRVYGYIIILRAVTTSDFMSAEAFEFPWALLQKIARTIVNSVDGVSRVTYDLTSKPPGTIELE

SEQ ID NO: 45389 - protein, 488 aa, Burkholderia mallei ATCC 23344
MGKITGFLEYERRHEAYEAPLTRVKHYKEFVAALTDADAKIQGARCMDCGIPFCNNGCPVNNIIPDFNDLVYRQEWRQAIDVLHSTNNFPEFTGRICPAPCEAACTLGIHDDPVGIKSIEHAIIDKAWAQGWVAPQPAAHKTGKKVAVVGSGPAGLAAAQQLARAGHDVTVFEKSDRIGGLLRYGIPDFKLEKWLIDRRMRQMEAEGVTFRTSVFVGRDPLPETIGNMAKETISPETLKDEFDAVVIAGGSETPRDLPVPGRELAGIHFAMEFLPQQNRVNAGDKLADQLLAKGKHVVVIGGGDTGSDCVGTSNRHGAKHVTQFELLPQPPEAENKPLVWPYWPIKLRTSSSHEEGCERDWAVATKRFEGRNSKVEKLIAARVAWVDGKMQEVPDSEFEIKADLVLLAMGFTQPAAPVLEAFGVAKDARGNARAGTDGDRAYYTSVDKVFAAGDMRRGQSLVVWAIREGRQCARSVDAYLMGSSELPR

SEQ ID NO: 45390 - protein, 501 aa, Arabidopsis thaliana
MFYYVIVLPLALFLLANKLFFTSKTKRFNLPPSPPYSLPILGHHNLLKPPVHRLFHRLSKTHGPIFSLQFGSRRAVVISSSSLATQCFTGQNDIILSNRPCFLTAKYVAYNYTTVGTAPYGDHWRNLRRICSLEILSSNRLTNFLHIRKDEIHRMLTRLSRDVKKEIELEPLLSDLTFNNIVRMVTGKRYYGDEVHNEEEANVFKKLVADINDCSGARHPGDYLPFMKMFGGSFEKKVKALAEAMDEILQRLLEECRRDKDGNTMVNHLLSLQQNEPEYYTDVTIKGLMLGMMIAGTDTSAVTLEWAMSSLLNHPEALEKAKLEIDEKIGQERLIDEPDIANLPYLQNIVSETFRLYPAAPLLVPRSPTEDIKVGGYDVPRGTMVMVNAWAIHRDPELWNEPEKFKPERFNGGEGGGRGEDVHKLMPFGNGRRSCPGAGLGQKIVTLALGSLIQCFDWQKVNGEAIDMTETPGMAMRKKIPLSALCQSRPIMSKLQAHLKG

SEQ ID NO: 45391 - protein, 120 aa, Physcomitrella patens subsp. patens
TSRAGWACVKNCGACCVLDKGPDYPPIEEVLSDPAEAALYRSMVGPDGWCINYDKLSRSCTIHADRPRFCRVEPETFKVLYGIEEKDMDKEACGFCKDQIRSVYGGRSKELKTFQRVVRN

SEQ ID NO: 45392 - protein, 373 aa, Oryza sativa
  misc_feature (237)..(237): Xaa can be any naturally occurring amino acid
MPTCLPPPPRAAIAAVLTSLLPPPPGASASLAPAGPAAAVARQIRRNDGHHPGAAVGMSSASVAERERESEAGEFTEVVVVRHGETAWNASRIIQGHLDVELNEIGRQQAVAVARRLSNEAKPAAIYSSDLKRAAETAEIIAKACSLPNVVFDPALRERHIGDLQGLKYEDAGKEKPEAYRAFLSHKRNRQIPGGGESLDQLSERCVSCLYNIVEKHQGERIILVSHGGTIRELYRXMPSPMKPLHGKIHNKIPKAENPLGSGGHRGPVAIGQRARRGAQTTPPLKGKTRGVSGEKKPLLGGGRKKKHSGQLKPPNLSKKGGRATIWKNNLIFKPIGTQKKKTPTSSFLCAGGELPLFVGGGGEEKKKTLFLF

SEQ ID NO: 45393 - protein, 133 aa, Brassica rapa
MASFTASASTVSVARPALLLKPTVAVSAPVLGLPPMGKRKGGVRCSMEPKQGNVSAVGAGVSAAATAALTAVMSNPAMALVDDRMSTEGTGLPFGLSNNLLGWILLGVFGLIWTFYFTYTSSLDEDEESGLSL

SEQ ID NO: 45394 - protein, 483 aa, delta proteobacterium MLMS-1
MSQLSEIGGLDAATLQQKDRALLWHPFTQMHDYAQRDLLLIDRGRGVRLYDHHGREYFDTISSWWCIVHGHCHPLIQEYIGRQLKRLDQIQLAGTGHEPAILLAEKLVALTPPRLSKVFYSDNGSTACEVAVKISLQYWQQSGHPERRGLVALERGYHGDTIGTMSLGGVPEFHQAFGHLMFPSHRVPPPNCYRCPAGMPAPELMEGGLAVEAAGPEMEKLRCDCQCLAPLEQLLAAQGEQLAAFILEPRIMAAGGMIVYPAQWLRRAAELTRRHGVHLILDEVASGFGRTGRMFALESAGVEPDFLCLSKGLTGGALPLAATLTSDEIYNAFYDDYAAGKTFFHGHTFSGNPLAAAAALGSLAVFAEEQTIAGLPAKVAHLRQAMQRFKDLPWVGDLRCLGMIAALELVQDKERKIPFGPDQRVGWPIYLAGLEEGLLLRPLGNIIYLWLPLSVTTAEIDEICQRMWRVLSNPVNIRGMGKE

SEQ ID NO: 45395 - protein, 509 aa, Zea mays
  misc_feature (261)..(261): Xaa can be any naturally occurring amino acid
EGLFEAITGYGLGGSSMALFGRLGGGIYTKAADVGADLVGKVERNIPEDDPRNPAVIADNVGDNVGDIAGMGSDLFGSYAESSCAALVVASISSFGINHEFTPMVYPLLLSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYXVAVAALGMLSTIATGLAIDAYGPISDNAGGIAEMAGMSHRIRERTDALDAAGNTTAAIGKGFAIGSAALVSLRLFGAFVSRAAISTVDVLTPEVFIGLIVGAMLPYWFSAMTMKSMGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDLK

SEQ ID NO: 45396 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAMAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFQGLDGVRDGYKMMPFGSGRRSCPGEGLAVRMVALSLGCIIQCFDWQRIGEELVDMTEGTGLTLPKAQPLVAKCSPRPKMANLLSQI

SEQ ID NO: 45397 - protein, 368 aa, Thermococcus kodakarensis KOD1
MQRSHEILISKYERAYWDAVERGEFSRARVLAIKCAGLFRELASLNLEFSDYYLEMAKQWEKRAGELENGHRYSQRKSVNLPNVVQTSRVAWDDVGGLWEAKKVLSRTIGLHLARVPGKFEPWKGILLFGPPGTGKSLLASAVAGSLGATFLNVKVSDVLSKYFGESSKLVASIYHLAREKSPSIVFIDEFDALAMKRSSLEDAARRVLSTFLVEIDGFKRSDTNERVVTLAATNRPWDLDDAILSRFPLRVYVPLPDESSAVEILRIHLSGFRVKANLRAVAKEAVRRRYSGRDLANLARLAITKMLSDMNPELSEPQLIPSLVGKELTVRPIEMEDFRYGLRRIKSPITPALIKKYEMWAREYGSY

SEQ ID NO: 45398 - protein, 267 aa, Arabidopsis thaliana
MSQHNILEALNVRVVGTGDRILFLAHGFGTDQSAWHLILPYFTQNYRVVLYDLVCAGSVNPDYFDFNRYTTLDPYVDDLLNIVDSLGIQNCAYVGHSVSAMIGIIASIRRPELFSKLILIGFSPRFLNDEDYHGGFEEGEIEKVFSAMEANYEAWVHGFAPLAVGADVPAAVREFSRTLFNMRPDISLFVSRTVFNSDLRGVLGLVRVPTCVIQTAKDVSVPASVAEYLRSHLGGDTTVETLKTEGHLPQLSAPAQLAQFLRRALPR

SEQ ID NO: 45399 - protein, 511 aa, Nicotiana tabacum
MVNMFTPIIYAPLLLAFYIITKHFLRKLRNNPPAPFLTFPFIGHLYLFKKPLQRTLAKISERYGSVLLLEFGSRKVLLVSSPSAAEECLTKNDIIFANRPLLMAGKHLGYNFTSLAWSSYGDHWRNLRRITSVEMFSTHRLQMLHGIRIDEVKSMVKRLNSSAIAEKSVDMKSMFFELMLNVMMRTIAGKRYYGENVEDIEEATRFKGLVQETFRIGGATNIGDFLPALKLLVRKLEKSLIVLQENRDEFMQELIKDCRKRMEKEGTVTDSEIEGNKKCLIEVLLTLQENEPEYYKDEIIRSLMLVLLSAGTDTSVGTMEWALSLMLNHPETLKKAQAEIDEHIGHERLVDESDINNLPYLRCIINETFRMYPAGPLLVPHESSEETTVGGYRVPGGTMLLVNLWAIHNDPKLWDEPRKFKPERFEGLEGVRDGYKMMPFGSGRRSCPGEGLAIRMVALSLGCIIQCFDWQRLGEGLVDKTEGTGLTLPKAQPLVAKCSPRPIMANLLSQI

SEQ ID NO: 45400 - protein, 358 aa, Vitis vinifera
MTCYKGKYHDELIANAAYIGTPGKGILAADESTGTIGKRLASINVENVEGNRRALRELLFCTPGALQYLSGVILFEETLYQKTASGKPFVDVMKEGGVLPGIKVDKGTVVLTGTDGETTTQGLDGLGERCAKYYAAGARFAKWRAVLKIGPTEPSELAIHENAYGLARYAMICQENGLVPIVEPEILVDGPHDIEKCAYVTERVLAACYKALNDHHVLLEGTLLKPNMVTPGSEAKKVSPEVVAEYTVRTLQRTVPAAVPAIVFLSGGQSEEEATLNLNAMNKLKGKKPWNLSFSFGRALQQSTLKAWSGKEENVVKARGAFLVRCKANSEATLGTYKGDAKLGEGAAESLHVKDYKY

SEQ ID NO: 45401 - protein, 577 aa, Bacillus anthracis str. Ames
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENGVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENFSDNDIKIAVKEAIWEPEYRQIKAVEKVTI

SEQ ID NO: 45402 - protein, 284 aa, Aspergillus nidulans FGSC A4
MATSTKQTYPVLPKNLLLISLKMYFEPSRTLEYCRALLDPKNDIVRPENRSKLLLALIPDFLTIYPCAEIIKEYVSTLPKDDSPSLPAPFLLGAQDCFWEPLGAYTGEVSPLSLSSLGVSIVELAHAERRSIFGETDEQAARKAAAACAQGMVPLVCIGEISAPGPVASAAVGLAVRECEPLVRAILNAIPADAPIIFAYEPVWAIGKPKPASVDHISAVVDGLRALIGRRSGDVRILYGGSAGPGLWGPGGLGKAVDGMFLGRFAHDIEGVRKVVREVEESLT

SEQ ID NO: 45403 - protein, 537 aa, Xanthobacter autotrophicus Py2
MSFSELGLSEKVLAAVADTGYTQPTPIQAQAIPHVLARRDVLGLAQTGTGKTAAFTLPMLTLLEHGRARARMPRTLILEPTRELAAQVEENFTRYGKNHKLNVALLIGGVSFGDQDSKLLRGVDVLIATPGRLLDHVERGRLLLSGIEVLVIDEADRMLDMGFIPDIERVCKLVPFTRQTLFFSATMPPEIQRLVSQFLSNPVRVEVSKPASTAATVTHMLVASGREDYDKREVLRELIRNCDGLQNGIIFCNRKRDVAVLHRSLQKHGFNAVALHGDMDQHARIKALDQFRSGEATLLVASDVAARGLDIPAVSHVFNYDVPHHSEDYVHRVGRTGRAGRAGTAYTLVTHTDAKSVTAIEKLIGNAVPWHGAPLGDAPPASERRERREDGGRLRGKRRVEKEPREARPEREPRAEREPRPEREPRADREPRVAREPRPEREPRAERAPRPEREPRREREPRREREAPAGEVRASEPRAEAETRAPRPDRQERGRRPAREDGPEARLARRERAPAAEPADMSHLPAFLLRPVRVKAG

SEQ ID NO: 45404 - protein, 764 aa, Robiginitalea biformata HTCC2501
MSKEKKRREALIYHAKPTPGKIKIVPTKPYATQRDLALAYSPGVAEPCLEIHKDVEQVYKYTAKGNIVAVISNGTAVLGLGDIGPEASKPVMEGKSLLFKIFADIDGIDIELDTKDVDKFVETVKIMAPTFGGINLEDIKAPEAFEIERRLKEELNIPVMHDDQHGTAIISAAALLNALDLAEKKIEDVRIVISGAGAAAISCSRLYRSLGASRENMVMLDSKGVIRSDRPELSAEKKEFATDRKIDTLEEAVRDSDVFIGLSIADILTPAMLKTMNKNAIVFAMANPNPEIDYNLAMKTRKDIIMATGRSDHPNQVNNVLGFPFIFRGALDVRATKINEEMKMAAVKALADLAKQPVPEQVNIAYGETRLTFGREYIIPKPFDPRLIAEVPPAVARAAMESGVARAPIADWGRYREELLQRSGDDKKVIRWLMSRAKSMPKKIVFAEADQLDVLKAAQIAHDEGIAHPILLGNRKVIEELKEELEFDAEIPIIDQYEEDSLEKREAYARSYWELRQRKGSTLYNSRSKMRERNYFGAMMVREGDADGMISGYSRSYSSVVKPIFEVIGRASEVSRAATVHVMITSRGPIFLADTSLNIDPTAEELAEITRMTANLARAFNFEPNIALLSYANFGSSEHPRAVKVREAIRILHEQEPDLVVDGEIQTDFALNRKLRQSQFPFSKLAGKNVNTLVFPNLESANITYKLIKELQATDTIGPIMLGLRRAVHILQMGASVEEIVNMTAVAVIDAQEREKRRRAKRKK

SEQ ID NO: 45405 - protein, 518 aa, Rigidoporus microporus
MFRFNTFSTLIPLALSLGVRAAIGPVADLHISNANISPDGFTRAAVLAGGSFPGPLITGNKGDNFQINVINDLTDADQLKTTTIHWHGFFQHGTNWADGPAFINQCPIASGNSFLYNFQVPDQAGTFWYHSHLSTQYCDGLRGAFVVYDPDDPHASLYDVDDESTVIALADWYHGLARLGPKFPTTNSTLINGLGRYDFGPSSDLAVISVQAGKRYRFRLVSISCDSNYVFSIDEHTFTVIEVDGVNHQPVDADSLQIFAGQRYSIVVNADKSEGGNYWIRASPTPGPQGFANGINSAILRYVGSDEVEPTTNQTTSTNPLVEANLVPLENPGAPGDPTPGGVDVPLNLAVAFDGTGLDFQVNGQTFIPPTVPVLLQILSGAQSATDLLPSGSVYVLPSNATVEISIPAGAVGGPHPIHLHGHTFDVVRSAGSSTYNYVNPPRRDVVSIGNAGDNVTIRFRTDNPGPWFLHCHIDWHLEAGFAVVFAEDIPNVASVNSPPQAWSDLCPIYDALDPSDH

SEQ ID NO: 45406 - protein, 571 aa, Buchnera aphidicola (Acyrthosiphon pisum)
MISGILASPGIAFGTALLLKEDEIVINRKIINIKNITKEIERFFEGRRKSIHQLTEIKTKPKEKFGEKKESIFEGHIMLLEDEELEQEVISLIKEKNMSAAAATELIIEGQAKALEKLKDEYLKNRAIDVRDIGNRLLKNILNLNIIDLNNINNEVILIAKDLTPSETAQINLKYILGFITDLGSRTSHTSIMARSLEIPAIVGTGNITKIVKNNDFIILDSINNQILINPSHKLINQTEVIKKKYLTKKNQLINLKNLQAITTDGHAIKIGSNIGNVEDIKSAKKNGAECIGLYRTEFLFMGRNCLPDENEQFQAYKTIAELMKNKSVIIRTMDIGGDKDLPYMNLPKEENPFLGWRAIRISMDRKEILHTQLNAILRASAFGKIYILFPMIISVEEIRILKSEVRKLQIQLKNNNIPFDKNIKIGIMIETPASAIIAEYLIKEVDFFSIGTNDLTQYTLAVDRGNDLISHLYNPMNPSVLKLIQQVINVSHTHGKWTGMCGELAGDERATILLLGMGLDEFSMSSISIPKIKEIIRKTSFSSAKKLAQKALTLPTNKEILNLVENFVNH

SEQ ID NO: 45407 - protein, 526 aa, Trametes versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 45408 - protein, 430 aa, Pseudoalteromonas tunicata D2
MSKIVKVIGREIMDSRGNPTVEADVHLECGAWGRACAPSGASTGTREALELRDGDKSRYLGKGVLTAVNFVNTDIANAVAGQNAIEQAKIDGIMIELDGTENKEKFGANAILAVSLAVAKAAAQAKGVQLYEHIADLNGTPGQYSMPVPMMNIINGGEHADNNVDIQEFMIQPVGAPNFREALRMGAEIFHTLKKVLSARGLSTAVGDEGGFAPDLKSNEEALAVIVEAVEGAGYVMNKDITLALDCASSEFYHDGVYDLKGEGKTFNSEGFADFLADLSVRYPIVSIEDGLDESDWDGWKVLTDKIGDKVQLVGDDLFVTNTKILKRGIDNGIGNSILIKFNQIGSLTETLEAINMAKAAGFTVVISHRSGETEDATIADLAVGTAAGQIKTGSLCRSDRVSKYNQLLRIEEQLGAAVKYNGRSEIKGQ

SEQ ID NO: 45409 - protein, 181 aa, Rickettsia akari str. Hartford
MRIDKNLPNYLTIARIMVIPVIILAFYINNSLARKIGALLFVLASITDFFDGYIARKYNLVTSFGKMFDPIADKILVGCVIIMLLKKGNIDEIPCLLILAREFLVSGLREFLALVKVSVPVSRLAKVKTFLQMFALSILILGSKGAGIIYLDIVGEIILWIAAFLTIITGYSYFKACKKYF

SEQ ID NO: 45410 - protein, 442 aa, Robiginitalea biformata HTCC2501
MSLPKPQLSFWQIFNMNVGFLGIQYSFGLQQSAINPIFLFLGASEELLPILNIAGPVTGLIVQPIIGAISDKTWSPRWGRRKPFFLIGALIGSICLFLFPLSPALWFAVGLLWLLDVGNNMAMEPYRAFVGDKLPDKQMSLGYQMQSLFVGAGILLANASIFLFQDWFGGGEELTGSVPKWLYYSFFIGSFLSLATILWSVLKTPEIPPDAKELAEINRHKALPFAQRLKVPFVEIAEAVRDMPKFMWKLAGVYLFQWYALFVYWQFITPLFRTTMGFDTSQAAAQAAKMSTTYNIVTALVALVLVPLTMRFGGKKVYALSLFGTAVALFWIPFIDDPVNVLFPMILFGIGWAAMMGIPYSMVSKIVPQDRRGVYMGILNMMIVIPMGIETLSFGAIFSNFLGSDSVNAMLFAGAFFAIAGLLALRLNVAKARAEVAEVMGE

SEQ ID NO: 45411 - protein, 423 aa, Salix gilgiana
MFGRAPRRSDNTKYYEVLAVSKGASQDELKKAYKKAAIKNHPDKGGDPEKFKELSQAYEVLSDPDKREIYDQYGEDALKEGMGPGGGGGGHNPFDIFESFFGGGGFGGGSSSRGRRQKQGEDVAHPLKVSLEDLYNGTSKKLSLSRNILCAKCKGKGSKSGAFGKCRGCQGTGMKVSIRQIGLGMMQQMQHVCPECRGSGELISEKDKCPHCRGNKVTQEKRVLEVHVERGMQHGQKIVFEGQADEAPDTITGDVVFVLQLKKHSKFERKMDDLFVEHSLSLTEALCGYQFALTHLDGRQLLIKSNPYEIVKPGQYKAINDEGMPHHHRPFMRGKLYIHFNVVFPDSGTLSPEQCRTLETILPPRQSKNLSEMEIDNCEETIMHDVNMEEEKRRKQQQRHQHEAYDEDEEEESSMPRVQCAQQ

SEQ ID NO: 45412 - protein, 482 aa, Saccharomyces cerevisiae
MLRNGVQRLYSNIARTDNFKLSSLANGLKVATSNTPGHFSALGLYIDAGSRFEGRNLKGCTHILDRLAFKSTEHVEGRAMAETLELLGGNYQCTSSRENLMYQASVFNQDVGKMLQLMSETVRFPKITEQELQEQKLSAEYEIDEVWMKPELVLPELLHTAAYSGETLGSPLICPRELIPSISKYYLLDYRNKFYTPENTVAAFVGVPHEKALELTEKYLGDWQSTHPPITKKVAQYTGGESCIPPAPVFGNLPELFHIQIGFEGLPIDHPDIYALATLQTLLGGGGSFSAGGPGKGMYSRLYTHVLNQYYFVENCVAFNHSYSDSGIFGISLSCIPQAAPQAVEVIAQQMYNTFANKDLRLTEDEVSRAKNQLKSSLLMNLESKLVELEDMGRQVLMHGRKIPVNEMISKIEDLKPDDISRVAEMIFTGNVNNAGNGKGRATVVMQGDRGSFGDVENVLKAYGLGNSSSSKNDSPKKKGWF

SEQ ID NO: 45413 - protein, 213 aa, Saccharomyces cerevisiae
MNKESKDDDMSLGKFSFSHFLYYLVLIVVIVYGLYKLFTGHGSDINFGKFLLRTSPYMWANLGIALCVGLSVVGAAWGIFITGSSMIGAGVRAPRITTKNLISIIFCEVVAIYGLIIAIVFSSKLTVATAENMYSKSNLYTGYSLFWAGITVGASNLICGIAVGITGATAAISDAADSALFVKILVIEIFGSILGLLGLIVGLLMAGKASEFQ

SEQ ID NO: 45414 - protein, 267 aa, Corynebacterium glutamicum ATCC 13032
MVATSQFIDDSEAAQAVRAAIVAGYRNIDTALAYGNERGVGEGIRTAGVPREELFISTKLAAEIKDYDGAVAAIDESLAKIGLDYVDLMLIHSPQPWSDFRGGDYSEGNREAWRALEDAYKAGKIRSIGVSNFLEADLENILDSATVAPHVNQLLVHVGNTPSELISFCDSKGILVEAYSPIAHGEMLKNQQVKAIADKYNVSIPQLCIRYTIQLGTVSLPKTANPDHMSSNAQIDFEISEEDMAALQEVTARDYGEHSGFPVYSGK

SEQ ID NO: 45415 - protein, 157 aa, Magnetospirillum magnetotacticum MS-1
MAEASRENILPVILCGGSGTRLWPASRESMPKQFTPLVDPETSTFQATVRRVADGSVFARPTVIASAESRFIVAEQLAQARIAADILLEPERRDSAAAVAVAALHGARLGPETVVLVMAADHVIEDSAAFTQAAQQAAIGARLGQIMTLGITPTRAA

SEQ ID NO: 45416 - protein, 335 aa, Arabidopsis thaliana
MFTLVELKTATKNFRPESVIGEGGFGQVFKGWVDEKTLAPSRAGVGIPVAVKKSNPDSEQGLHEWQCEVRFLGKFHHPNLVKLLGYCWEENQFLLVYEYLPKGSLENHLFSKGAEALPWDTRLKIAIEAAQGLTFLHNSEKSVIYRDFKASNILLDSNFHAKLSDFGLAKNGPINGFSHVTTRVMGTQGYAAPEYMATGHLYVRSDVYGFGVVLLELLTGLRALDPNRPSAQQNLVEWAKPGLNQKKKVQKMMDPRLEQKYPLLAVTKTAELILRCLEADPKNRPPMDDVLRELEVVRTIRDQPQEERRKRSSGPDTNRVRGNDSPYGRRTGRTG

SEQ ID NO: 45417 - protein, 498 aa, Rickettsia akari str. Hartford
MSTPKSDNCLSELRKVIWPIERYENKKFLPMAFMMFCILLNYSTLRSIKDGFVVTDIGAEAISFLKTYIVLPSAVVAMVIYVKLCDILKQENVFYVIASFFLGYFALFAFVLYPYPDLVHPDPETIESLSLAYPNFKWFIRIVGQWSFASFYTMAELWGTMMLSLLFWQFANQITKTDEAKRFYSMFGLLANLALPVTSVIIGYFLHEKTQIVAEHLKFVPLFVIMMTSSLLVILTYRWMNKNVLTDPGLYDPALVKEKKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFTFIFFDSVIAMHLTGILASGPLALAVMIGMIQNVLSKGVKYSLFDATKNMAYIPLDKDLRVKGQAAVEVIGGRFGKSGGAIIQSTFFILFPAFGFVEATPYFASIFFVIVILWIYAVKGLNKEYQVLVNKTEK

SEQ ID NO: 45418 - protein, 484 aa, Saccharomyces cerevisiae; identical to SEQ ID NO: 1194

SEQ ID NO: 45419 - protein, 248 aa, Physcomitrella patens subsp. patens
MDPESKDRLMTDIIAYMEGEAYFKRVGRAWKRGYLLYGPPGTGKSSLIAAMANLLHYNIYDLELTQVYDNSMLKALLTNTTSKSIIVIEDVDCSLDLTGSRFEKPAGKLKSTSSKQTTSSPGSRVTLSGLLNFTDGLWSCCGNERIIIFTTNHIEKLDPALLRPGRMDMHIHMSFCNFEIFKVLASNYLSVSSDPLFEQIERFLHEQSVCITPAEVTEILFENKDDTDLALRKLVADLERRGVEGDAV

SEQ ID NO: 45420 - protein, 142 aa, Bradyrhizobium sp. ORS278
MTVRAILDTKGHKVESVEAQTTLAEAAKLLADRKIGAVLVMSGTRMEGILSERDIVRSLGERGAGALTEPVSSVMTRRVVSCRPQDTVAEIMEMMTNGKFRHLPVIEGGLVVGLISIGDVVKWRVQEYENEQEALRQYIKTA

SEQ ID NO: 45421 - protein, 335 aa, Arabidopsis thaliana
MSNLPRDLSDLPRNMAEEVLSRVPMTSLRRLRFTCKKWNTLSRCRSFAKKHLVCQAKVAAKKREYKVVMMMDFRVYLMRINLQNNVELCIKRERELLFPDASDQIYVRHVFHCDGLLLCIMKDNPRLVVCNPYSGQTRWIETTNNPQRLDAYSYALGYNSSTKSHKILSFGMMFDYVSSTSAEFKIYDFNSDSWRGDIWAAVCLRRPLSGIFKSSLLLSNVRDEQLAVLFQRMDTLQMEIWVTTKIEPNTVSWSSKFFLSVDMRELTGRYSMFSFSDASFFIDEEKKVAVVFDKGKKNLHRWRGWILEEVDLGESPNQNLRPLVCSYVPSSLQLD

SEQ ID NO: 45422 - protein, 121 aa, Brassica napus
  misc_feature (111)..(111): Xaa can be any naturally occurring amino acid
  misc_feature (116)..(116): Xaa can be any naturally occurring amino acid
MNQEQNLRQCAACGEQEAFFTYAVGKNKNLRRLCTDCLLREHRNLFCPIYLDVPPPEESIVCLNCPSITHLDCPPRPSSSASPFTCPPCSEPNFSFFPKSSHSTVLDQESXDALVXAAIIS

SEQ ID NO: 45423 - protein, 457 aa, Clostridium perfringens ATCC 13124
MNKYEYIIIGFGKGGKTLAGYLGKLGKKVAIIEKSDKMYGGTCINVGCIPTKTLVHKAKVSLYKGLNTFEEKEREYRKAIEEKKSLIEALRNKNYNMLNNNENVDVFNGTASFISNTEILINSEKEDIILEGEKIFINTGATTIIPNIQGIKSSSKIYNSTTIMELKELPKHLVIVGGGYIGLEFASIYESFGSKVTVIEAFDRIAGREDEDISKSIKEILEKKGIEFLLGSKVKSFEEIHGEVEVSYENSLGELNKITGDAVLIAIGRKPNTEELNLEAAGVKVTNRGAVAVNNKLKTNVPNIWAIGDVNGGPQFTYISLDDFRIIKDNLFGEGKRSTDDRKFIPYSVFIEPNLSRVGLSEKEALEKGFEIKTAKLEVNNIPRAKVIGETEGMMKAIVDVKTNKILGCTLLCAESAEIINIVTLAMKADEDYTFLRDNIFTHPTMSEALNDLFSLI

SEQ ID NO: 45424 - protein, 391 aa, Methylococcus capsulatus str. Bath
MAFKRMTDIDLAGKRVLIREDFNVPVKDGRVTSDARIRAALPTIRHALDAGAAVMLMSHLGRPTEGEYAEEFSMKPVADRLSELLGQPVTLVKDYLGGADPAVGSVVLFENVRFNKGEKKDDEVLARQLAALCDVYVMDAFGTAHRAEASTHGVGKYAPTACAGLLLATELDALGRALHDPARPLVAIVGGSKVSTKLTVLDSLSQVVDQLIVGGGIANTFIKAAGFNVGKSLYEEDLVAEARRLMEAAKAKGGEIPVPVDVVVGKRFDAAEPAMVKSVADIAEDDMILDIGPETSRRYAEFIGRAGTVVWNGPVGVFEFDQFGEGTRRLGLAIAESHAFSIAGGGDTLAAIDKYGIADRISYISTGGGAFLEFLEGKQLPAVAMLESRAD

SEQ ID NO: 45425 - protein, 334 aa, Physcomitrella patens subsp. patens
MSLQDTEELKANLFTYKEQLKQVKELLVVDSGNTEYQEMAIGLTEVLELTYDLLNEAQQAKEDAALELEQQEAAAANTHIHVDKELKMRTSGLRLEMIGNTNENFVHIPGRLSVGTKVQAIWSEDGEWYKATVEAVTPGGYFVLYDEWGNKEEVDASNVRELNIPDDEVEVLDQMLGGAEVVDNVNTNSWLDAEQEANLTRLALKKTIEDAADINVISRGVPPKLRIKPDDSEDVIAAKKKKIHAFKSKARLEQMELTQNKRQNAWQQFQTTKGKSKKQGGFFTGRKRESIFKSPDDPKGKVGVTGSGKGTTEFHKREKHLHLKLGVGDGETYV

SEQ ID NO: 45426 - protein, 411 aa, Thermococcus kodakarensis KOD1
MFRITDFTYEGKTVFLRADLNSPVEKGRITSDARFRAVLPTIQHLLDNGAKLVIATHQSRPYKGDYITTEEHAQILSRLLGQEVEYVEDIFGKYARERISSLKPGEAIILENLRFSAEEVFNRSIEECEKTFFVRKLAPLIDYVVNDAFATAHRSQPSLVGFARLKPMIMGKLMETEVDALSKAYESEERPRVYVLGGAKVDDSLRVAENVLRKGKADLILTGGLVGQIFTLAKGFDLGDANIEFLHRKGLLELVDWAEKILDEFYPYVRTPVDFAIDYKGERLEVDLLGGEKRLFDQYPILDIGSRTVEKYREILIGAKIIVANGPMGVFEREEFAVGTVGVFRAIGESPAFSVVGGGHSIASIYRYNITGISHISTGGGAMLSFFAGEELPVLKALKISYERFKDRVKE

SEQ ID NO: 45427 - protein, 177 aa, Aquifex pyrophilus
MGYKDLPPGKNPPEDIYVVIEIPQGSGIKYELDKDTGVIFVDRFLFTAMYYPFNYGFIPQTLADDGDPVDVLVISREPVAPGSVMRCRPIGMLEMRDEEGIDTKLIAVPHEKLDPTYSDIKTVDQLPEIIRERIKHFFEHYKELEPGKWVKVENWRGLQDAIEEIKKGIENYKKGGK

SEQ ID NO: 45428 - protein, 254 aa, Listeria monocytogenes EGD-e
MRKPLVGINMKNYINTRAQTSEWLEATIPLLGNFSDVDTFIFPSMGTLETTANLLAGTSFGFGPQNMAPEKSGPLTGEFSVESIIDLSANYVEIGHAERKNLFHEKTSEIAKKIQLALDEKITPVVCVGEGIRANDTNELKNALKKQIEALFDTIQVTQFKNVVLAYEPEWAIGKANSADTDYIESAHQALREIIRELGGDETLVRIIYGGSVSKENAAEIVRQKNVDGLFVGRFGHKPQNFADIVSIVSKTKG

SEQ ID NO: 45429 - protein, 345 aa, Cucumis melo
MASASSANAAITSFFFLALLIGGSSAQLSETFYDQTCPRLANVVRASVRKAIESDIRAGAKLIRLHFHDCFVNGCDGSVLLEDAPGIVSELNSPGNQGIQGLEIVDAIKADVEKECPGIVSCADILAQASKDSVDVQGGPSWRVLYGRRDSRIANKTGADSNLASPFETLDQLKAKFKNVGLNTVDLVALSGAHTFGRSRCRFFSHRFANFNNTGSPDPSLNPDYRRFLEGVCSAGADTRANFDPVTPDIFDKNYYTNLQVGKGLLQSDQELFSTPGADTIPIVNSFAAREGTFFKEFRQSMINMGNIQPLTGGQGEIRRNCRRVNSNSGLFFGGEGEGEGRDVM

SEQ ID NO: 45430 - protein, 580 aa, Vitis vinifera
  misc_feature (67)..(67): Xaa can be any naturally occurring amino acid
MAQVVATRAIQSSILCPSSGSVHERFEKLKPSGFAAKVLAREERRSRRVAWRGGPIAAAKRSVGAEXEVVPVTPEDAKGEEQYHRLRGIQQLGETSVGMWSKPTVRRKTKIVCTIGPSTNTREMIWKLAEAGMNVARLNMSHGDHASHQKVIDLVKEYNAQSKDNVIAIMLDTKASFLGPEVRSGDLPQPIMLKSGQEFTFTIQRGVGTADCVSVNYDDFVNDVEMGDMLLVDGGMMSLMVKSKTGDSVKCEVVDGGELKSRRHLNVRGKSATLPSITEKDWDDIKFGVDNKVDFYAVSFVKDAKVVHELKNYLKSCNADIHVIVKIESADSIPNLHSIITASDGAMVARGDLGAELPIEEVPLLQEEIIRICRSMGKAVIVATNMLESMIVHPTPTRAEVSDIAIAVREGADAVMLSGETAHGKFPLKAVKVMHTVSLRTEATLVGSPMPPNLGQAFKNHMSEMFAFHATMMSNTLGTSIVVFTRTGFMAILLSHYRPSGTIFAFTNEERVQQRLAVYQGVCPIYMQFSDDAEETFANALSLLQKQGMVKEGEEVALVQSGRQPIWRFQSTHNIQVRKV

SEQ ID NO: 45431 - protein, 409 aa, Bacillus anthracis str. Ames
METIVQKFGGTSVGSVERIQHVANLIIEEYERGHSIVSVVSAMGKSTDELVALANAITENPSKREMDMLLSTGEQVTISLLTMALQAKGYNAISLTGWQAGITTESVHSSARITEINTDRIQSYLTKGTIVIVAGFQGVSEDLEITTLGRGGSDTTAVALAAALNAKKCDIYTDVTGVYTTDPRVVKDAYKLDEISYDEMLELANLGAGVLHPRAVEFAKNHNVILEVRSSMEQENGTIVKGECNMEQQSIVKGIAFEDNITRITVKGLEQGSLSTVFSTLAAAHINVDIIIQSITNEGTVHLSFSIHSNDLRETLAVLEQNQEALHYESVEYENHLAKVSIVGSGMVSNPGVAANMFTTLKEEDIHIKMVSTSEIKVSVVIDRLHLVTGVEALHQSFMAKIEPLVQMS

SEQ ID NO: 45432 - protein, 453 aa, Ammopiptanthus mongolicus
SDCYDSNVTASSQNKTSGQRCECPFGYSGDPYIAGSCTAIPRFYGETIRSKKWALVGVLSSLGSIILLFGLWWLYKVVRKRMIKKRKEKFFKQHGGLLLQQRLSSGEVSVDRAILFSLKDLERATDNFNINRVLGKGGQGTVYKGMLVDGRTVAVKKFKVQGKVEEFINEFVILSQINHRNVVKLLGCCLETEIPLLVYEFIPNGNLFQYLHDQNEDLPMTWDMRLRIATEIAGALFYLHSVASQPIYHRDIKSTNILLDEKYRAKVADFGTSRIVSIEATHLTTVVQGTFGYLDPEYFHTSQFTEKSDVYSFGVVLAELLTGRKPISLVSSEEAKNLASYFALSMEEDSLFEIIDKRVAKKGEKEHIMGVANLAYRCLELNGKKRPTMKEVTLELERIRGPDKKFNAQQNHEEIELARIEDYQPYSTSNTFPTLSRGSPSSEVMPVLTSDNW

SEQ ID NO: 45433 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGVRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 45434 - protein, 232 aa, Glycine max
SARGAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 45435 - protein, 473 aa, Oryza sativa
MAVALEAGRRKRAAVVVLGDIGRSPRMQYHSLSLANQAGMEVDIVANGGSDPHLLLRENPSIHIHEMKSVQLTGILKISGALTLLLKAAIQFIILIWYLCFKIPRPDVFIVQNPPSVPTLAAVKLASWLRGAKFIVDWHNFGYTLLGLSHGRSHIIVKIYFWFEKHFGRMADGAFCVTKAMKHELDQKWGINATVLYDQSPEFFHPASLTEKHELFSRLGNSICSAMGNDDCLSVEKEVEDRNTTVFTSWVDGEIFLKPNRPALVVSSTSWTPDEDFSILLEAALMYDRRVAATLGEDDSMDEGKLWIDIKNGKQFVYPRLLFIITGKGPDRMKYEEQIKRLKLRRVAFRTMWLASEDYPLLLGSADLGVSLHTSSSGLDLPMKVVDMFGCGLPVCAASFSCIDELVKINNNGLLFSTSSELADELMMLFKGFPEECDDLKSLKVGALNTGSSSKWSTEWERYALPLVNQVIG

SEQ ID NO: 45436 - protein, 140 aa, Rickettsia akari str. Hartford
MTIQYTFSMIKPDAIKRNKIGQVNAYLENGGLKIVAQKMRFLTKYEAECFYDEHRARTFFNSLVEYITSGAVVLQVLKGEDAIILNRTIMGATNPAEAEAGTIRKDLGESIEANSIHGSDSENSAKREIAFFFNKSEIIE

SEQ ID NO: 45437 - protein, 560 aa, Mycobacterium tuberculosis CDC1551
MIPTMTSAGWAPGVVQFREYQRRWLRGDVLAGLTVAAYLIPQAMAYATVAGLPPAAGLWASIAPLAIYALLGSSRQLSIGPESATALMTAAVLAPMAAGDLRRYAVLAATLGLLVGLICLLAGTARLGFLASLLSRPVLVGYMAGIALVMISSQLGTITGTSVEGNEFFSEVHSFATSVTRVHWPTFVLAMSVLALLTMLTRWAPRAPGPIIAVLAATMLVAVMSLDAKGIAIVGRIPSGLPTPGVPPVSVEDLRALIIPAAGIAIVTFTDGVLTARAFAARRGQEVNANAELRAVGACNIAAGLTHGFPVSSSSSRTALADVVGGRTQLYSLIALGLVVIVMVFASGLLAMFPIAALGALVVYAALRLIDLSEFRRLARFRRSELMLALATTAAVLGLGVFYGVLAAVALSILELLRRVAHPHDSVLGFVPGIAGMHDIDDYPQAKRVPGLVVYRYDAPLCFANAEDFRRRALTVVDQDPGQVEWFVLNAESNVEVDLTALDALDQLRTELLRRGIVFAMARVKQDLRESLRAASLLDKIGEDHIFMTLPTAVQAFRRR

SEQ ID NO: 45438 - protein, 696 aa, Pseudomonas syringae pv. phaseolicola 1448A
MQTFFIAPTDFGVGLTSISLGLVRTLERAGLKVGFFKPIAQPHPGDLGPERSTELMARTHGLKPPKPLGLAHVERMLGDGQLDELLEEIINLYQQAAVGKDVLVVEGMVPTRSASYAARVNLHLAKSLDADVILVSAPENEVLAELSGRVELQAQLFGGPKDPKVLGVILNKVRTEESMEVFSSRLKEHSPLLRSGDFRLLGCIPYRAELNAPRTRDVAELLGAQVLNAGDYDQRRMSRIIICARTVLNTVPLLKPGVLVVTPGDRDDIILAVSLAAINGVPLAGLLLTSDTVPDPRIMELCRGAFQAGLPVLSVSSGSYDTANRLNQLNKEIPIDDRERAENITDFVAGHLDAGWLHQRCGTPRELRLSPAVFRYQLIQRAQAANKRIVLPEGNEPLTIQAAAICQARGIARCVLLARPEEVQAVAQAHGIELPPGLEILDPELIRERYVAPMVELRKNKSLNAPMAEQQLEDPVVIGTVMLALDEVDGLVSGVIHSTANTIRPALQLIKTAPGCTLVSSVFFMLFPEQVLMYGDCIMNPHPSASELSEIALQSADSATAFGISPRVAMISYSSGNSASGEEVEKVREATQLARETRRDLLIDGPLQYDAAANEHVARQLAPDSPVAGRANVFVFPDLNTGNTTYKAVQRSADCVSLGPMLQGLRKPVNDLPRGAQVDDIVYTIALTAIQADTLS

SEQ ID NO: 45439 - protein, 317 aa, Spinacia oleracea
IDHYLGKELVENLSVLHFSNLVFEPLWSRNYIRNVQLIFSEDFGTEGRGGYFDNYGIIRDIMQNHLLQILALFAMETPVSLDAEDIRNEKVKVLRSMKPLKLQDVVVGQYKGHSKGNKSYSGYTDDPTVPNNSVTPAFAAAALFIDNARWDGVPFLMKAGKALHTKRAEIRVQFRHVPGNLYKKTFGTDLEKATNELVLRVQPDEAIYLKINNKVPGLGMRLDRTDLNLCYSTRYRGEIPDAYERLLLDAIEGERRLFIRSDELDAAWSLFTPLLKELEEKKVAPELYPYGSRGPVGAHYLAAKHNVRWGDLSGEDS

SEQ ID NO: 45440 - protein, 248 aa, Methylococcus capsulatus str. Bath
MSENTTHFGFRTVPEHEKANMVRAVFDSVAGKYDVMNDLMSIGIHRLWKRIAVDLAHVRSGEKVLDLAGGTGDLTALFRKRVGARGFVVLSDINAEMLRRGRDRIIDDGLAESVAYAQIDAEKLPFPHDSFDCISIGFGLRNVTHKDKALNSMYRALKPGGRLIVLEFSEVHNELLRKAYDLYSFKVLPFLGKLVANDAESYRYLAESIRMHPNQEKLKAMMEKAGFERCEYFDLMQGIVAVHRGYKF

SEQ ID NO: 45441 - protein, 465 aa, Spinacia oleracea
EFSNGHPLNDVSLQNDVAVNPIVAKSIDPSADLQLLPLLESVKEEPTLSIIVVGASGDLAKKRIFPTLFALFYENCLPENFTVFGFSRTEMNDEELRTMISKTLTCRIDQRENCGEKMDHFLQRCFYHSGQYNSEDDFSGLDCKLKEKEAGRLQNRLFYLSIPPNIFVDVVRCVSHRASSASGWTRVIVEKPFGRDSDSSRELTRSFKQYLSEDQIFRIDHYLGKELVENLSVLRFSNLVFEPLWSRNYIRNVQLIFSEDFGTEGRGGYFDNYGIIRDIMQNHLLQILALFAMETPVSLDTEDIRNEKVKVLRSMKPLKLQDVVVGQYKGHSKGNKSYSGYTDDPTVPNNSVTPTFAAAALFIDNARWDGVPFLMKAGKALHTKRAEIRVQFRHVPGNLYKKTFGTDLDKATNELVLRVQPDEAIYLKINNKVPGLGMRLDRTDLNLCYSTRYRGEIPDAYERLL

SEQ ID NO: 45442 - protein, 730 aa, Arabidopsis thaliana
MKTKTYNFRYIVASVLTLLMNGSSAATPPNSNSSSSCNRTFGGISIPFPFGIGGKDCYLNSWYEVVCNSTTSGSCKTVPFLTRINREVVNISLPKSDFFSPYGVVHIKGPVTSLGCSSNISQGLQKTLPDLNITGRGSPYFLTDENRLVAVGCGTKALMTDIESEILGCESSCKDTKSNEVGNSLCNGYKCCQARLPVERPQAVGVNIESNNDTRGEGCKAAFLTSMKYFPSNITKPEWFQADGYAVVELGWYFDTSDSRFRNPLGCTNLTRSSGSYFLTDICLCRYGYFSRMSYRSCYCGSGYRGNPYIRGGCIDIDECEVPNKCGEDTCVNMAGRYSCVPKITKPAKLAHVLRGVLIGLLGLLFFVIGIFGLYKFIRKRRRIIRSMKFFKRNGGLLLKQQLTTKDGSVEMSKIFSSRELEKATDNFSIDRVLGQGGQGTVYKRMLVDGSIVAVKRSKVVDEDKMEEFINEIVLLSQINHRNIVKLLGCCLETEVPILVYEYIPNGDLFKRLHDEYDDYMMTWEVRLRIAVEIAGALSYMHSAASFPIFHRDIKTTNILLDEKYRAKISDFGTSRSVATDQTHLTTLVAGTFGYMDPEYFLSSQYTHKSDVYSFGVVLVELITGEKPMSRVRSEEGIGLATYFLEAMKENRAVDIIDIRIKDESKQVMAVAKLARRCLNRKGNKRPNMREVSIKLERIRSSPKDLDVHTENEEEEEEDQLMEINRIYDS

SEQ ID NO: 45443 - protein, 761 aa, Arabidopsis thaliana
MKKETQNLQCIPLVISVLSLFGVSSARKPPYLCNRVCGGISIPFPFGIGGKECYLNPWYEVVCNTTTSVPFLSRINRELVNIYLPDPTEYYSNGVVHIKGPVTSSGCSTGTSQPLTPQPLNVAGQGSPYFLTDKNLLMAVGCNVKAVMMDVKSQIIGCESSCDERNSSSQVVRNKICSGNKCCQTRIPEGQPQVIGVNIEIPENKNTTEGGCKVAFLTSNKYSSLNVTEPEEFHSDGYAVVELGWYFDTSDSRVLSPIGCMNVSDASQDGGYGSETICVCSYGYFSGFSYRSCYCNSMGYAGNPFLPGGCVDIDECKLEIGRKRCKDQSCVNKPGWFTCEPKKPGQIKPVFQGVLIGSALLLFAFGIFGLYKFIKKQRRSSRMRVFFRRNGGMLLKQQLARKEGNVEMSKIFSSNELEKATDNFNTNRVLGQGGQGTVYKGMLVDGRIVAVKRSKAMDEDKVEEFINEVVVLAQINHRNIVKLLGCCLETEVPVLVYEFVPNGDLCKRLRDECDDYIMTWEVRLHIAIEIAGALSYLHSAASFPIYHRDIKTTNILLDEKYQVKVSDFGTSRSVTIDQTHLTTQVAGTFGYVDPEYFQSSKFTDKSDVYSFGVVLVELITGKNPSSRVQSEENRGFAAHFVAAVKENRFLDIVDERIKDECNLDQVMAVAKLAKRCLNRKGKKRPNMREVSVELERIRSSSYKSEIHNDDDDDDDDDDEDDQAMELNIEETWDVGMTAPASMFNNGSPASDVEPLVPLRTW

SEQ ID NO: 45444 - protein, 484 aa, Neptuniibacter caesariensis
MIRRDPNSGIDMIIPVIMAGGAGTRLWPLSRKQKPKQFLNLLSPDYSMLQTTYQRISGLKWNKSILVCNEEHRFLAAEQIRKLEMASGTDIILEPEGKNTAPTVALAAHHAQSNVGSADGEPILLVLSADHEINDICGFEKAVSKAITLAKKGKLVTFGTIPSRPETGYGYIKSGAAEDEGFEVVAFEEKPDLKRATEFLNTGGYLWNTGMFMFKASTYLSELQKYAGDIHKACEQAYQKKAHDLDFVRVGASEFINCPSNSIDYAIMEHTKLSSVIPIDVGWSDVGSWKTLWDSSDKDSDNNVILGDVLTTDTQNSYIRAENRLVTTIGVNDLIVIESQDSVLVAPKSASERIKDIVTQLQTNNRHEHISHPLVHRPWGHYYSIFKQDRYQVKHITVKPGAKLSTQMHHHRSEHWIIVSGAAQVTKGEQSFLLAENESTYIPIGTIHALENPGLIPLELIEVQAGPYLGEDDIIRFDDRYGRS

SEQ ID NO: 45445 - protein, 122 aa, Brassica rapa
MGESAGSSSSWAAISSSNIGFQLLKKQGWKEGTGLGVAEQGILVPVQAELKNNKRGLGAPAEKPAKRKAVKPATDSGREEEEVSKQSKKLSKKMRKLMEHEKHLQEKEFERAFFREFWPDNV

SEQ ID NO: 45446 - protein, 382 aa, Archaeoglobus fulgidus
MPYFDYASTKPVDERVVEAMLPYMTEHFGNPSSVHSYGFKAREVIEEARGKISELINGGGGDIVFTSGATESNNLALIGYAMRNARKGKHVLVSSIEHMSVINPAKYLQKQGFEVEFIPVDKYGTVDLEFIEEKIREDTILVSVQHANNEIGTIQPIKEISEIINGRAALHVDATASLGQIEVDVEKIGADMLTISSNDIYGPKGVGALWVRQGVRLQPIILGGGQEKGLRSGSENVPAIVGFGKAAEITAKEWGEEAGRLRRLRDRIIDNVLKIEESYLNGHPEKRLPNNVNVRFSYIEGESIVLSLDMAGIQASTGSACSSKTLQPSHVLMACGLKHEEAHGTLLLTLGRYNTDEDVDRLLEVLPGVIERLRSMSPLYRR

SEQ ID NO: 45447 - protein, 404 aa, Azotobacter vinelandii
MKLPIYLDYSATTPVDPRVAQKMCECLTMEGNFGNPASRSHVFGWKAEEAVENARRQVAELVNADPREIVWTSGATESDNLAIKGVAHFNASKGKHIITSKIEHKAVLDTTRQLEREGFEVTYLEPGEDGLITPAMVAAALREDTILVSVMHVNNEIGTVNDIAAIGELTRSRGVLYHVDAAQSTGKVAIDLERMKVDLMSFSAHKTYGPKGIGALYVRRKPRVRLEAQMHGGGHERGMRSGTLATHQIVGMGEAFRIAREEMAAESRRIAGLSHRFHEQVSTLEEVYLNGSATARVPHNLNLSFNYVEGESLIMSLRDLAVSSGSACTSASLEPSYVLRALGRNDELAHSSIRFTFGRFTTEEEVDYAARKVCEAVGKLRELSPLWDMYKDGVDLSKIEWQAH

SEQ ID NO: 45448 - protein, 796 aa, Thermococcus kodakarensis KOD1
MSERREVKLKVASAYQRDVGRGIVRIDRKAMRELGVQSGDIVEIIGTKNTAAVVWPAYPEDEGLGIIRMDGTIRKNAGVGLGDEVTVRKADVKEAKKVIVAPTEPIRFGADFVEWLHSRLVGRPVVRGDYIKIGILGQELTFVVTATTPAGIVQITEFTDFQVSEKPVKEVSKATALGVTYEDIGGLKDVIQKVREMIELPLKHPELFEKLGIEPPKGVLLYGPPGTGKTLLAKAVANEANAHFIAINGPEIMSKYYGESEERLREVFKEAEENAPAIIFIDEIDSIAPKREETHGEVEKRVVSQLLTLMDGLKSRGKVIVIGATNRPDAIDPALRRPGRFDREIEVGVPDKQGRKEILQIHTRGMPIEPEFRRDKVIEILEELEKNDTYREAAERAIMKVKKAKDEEEIRRILRETDEKLYEEVRAKLIDALLDELAEVTHGFVGADLAALAREAAMAALRRLINEGKIDFEAEYIPKEVLDELKVTRRDFYEALKMVEPSALREVLLEVPNVRWDDIGGLEDVKQELREAVEWPLKYPEAFMGLGITPPKGILLYGPPGTGKTLLAKAVANESEANFIAIKGPEVLSKWVGESEKNIREIFRKARQAAPTVIFIDEIDAIAPRRGTDVNRVTDRLINQLLTEMDGIQENSGVVVIGATNRPDIIDPALLRPGRFDRLILVPAPDEKARLEIFKVHTRRVPLAGDVDLRELAKKTEGYTGADIAAVVREAAMLAMRRALQEGIIRPGMKADEIRGKVKVTMKDFEEALKKIGPSVSKETMEYYRKIQEQFKQARG

SEQ ID NO: 45449 - protein, 396 aa, Ruminococcus flavefaciens
MEKRFIYADNAATTAVSEEVLSAMLPYFRTAYGNASSIYKLGRDAQRDVELAREKVAKALGAEPREIYFTSCGSESDNWAIKGTAELMAKKGKKHIVTSVFEHHAVLHTCEYLEKHGYEVTYVPVNDKGLIDPEDVRKAVREDTALVTIMYANNEIGTIQPIEEIAAVCREKGVLFHTDAVQAVGHVDIDVHKQGIDMLSLSGHKIHAQKGIGAIYIRKGIVLPNLVHGGGQERGKRAGTENVPAIVGLGVAIEAAVRNTAEKAAIIIPRRNRIIDELLKIPYTRLNGDREKRLPGNINISFEGIEGESLLLMLDLNGICASSGSACTSGSLDPSHVLLSIGLKHAVAHGSLRLSIEEDVSDEDVEYIIETIPKVVQRLRSMSPVWERMMKGEKYD

SEQ ID NO: 45450 - protein, 441 aa, Neptuniibacter caesariensis
MTSVAVMGMGYVGLTLSVALAKKGFNVIGVEKNLDVLTQLKEGIPHFTEKGLAPLLRHYVKAGKIRLSQNLVGVGKVDTYIISVGTPLHKSSKRPNTDYIGQVLEEVGGHVQQGALIALRSTVAVGTSRKIAIPEIEKSSGLQVGDGFSFAFVPERTIEGNAIQELEKNPQVIGGFDEASIQKASQMFAKLTPTILSVSSLEAAEMVKLMDNSYRDLRFSYANQVAQICESMGLDANELIDCANTHYPRNSIPVPSPGVGGACLSKDPYILADAAKKAGADASLLLEGRRINEEIVADIVNRVAARLDVIKKPMDQVTIGIAGLAFKGQPETSDLRESTSIWLLEQFSANYPEALIKVYDPVISDTELETLGFEVSSSLEQLASGADVLMLMNNHASYTEIDPYMITSKMRQPCLFYDAWRMLEKNMFDELDNVEYLGVGV

SEQ ID NO: 45451 - protein, 198 aa, Bacillus licheniformis ATCC 14580
MNLIPTVIEQTNRGERAYDIYSRLLKDRIIMLGSAIDDNVANSIVSQLLFLEAEDPEKDISIYINSPGGSITAGMAIYDTMQFIKPQVSTICTGMAASMGAFLLAAGEKGKRYALPNSEVMIHQPLGGAQGQATEIEIAAKRILSLRDKLNKILAERTGQPLEVIERDTDRDNFKTAEEAKEYGLIDKVLTRNIDAQK

SEQ ID NO: 45452 - protein, 343 aa, Arabidopsis thaliana
MMEVEGSMNRAPDQSSFLRSRRSKALYQFKQQKLPACKPVLTPISVITVFMLMGFVFIPIGLITLRASRDAIEIIDRYDVECIPEEYRTNKLLYITDSSIPKNCTRYLKVQKYMKAPILIYYQLDNYYQNHRRYVKSRSDQQLLHGLEYSHTSSCEPEESSNGLPIVPCGLIAWSMFNDTFTFSRERTKLNVSRNNIAWKSDREHKFGKNVYPINFQNGTLIGGAKLDPKIPLSDQEDFIVWMRAAALLSFRKLYGRIEEDLEPGKVVEVNLMNNYNTYSFSGQKKLILSTSNWLGGRNDFLGITYLVVGSSSIVISIIFMLLHLKNPRPYGDNSWNKKSLSS

SEQ ID NO: 45453 - protein, 404 aa, Methanosarcina thermophila
MAIHNCEGENVSTENKAVYMDNSATTPVRKEVVEAMLPYMTENFGNPSSIYEIGKTSKHAINLARKKAADALGAEENEIYFTSGGTESDNWAIKGIAFANRDKGKHIITSSIEHHAVLHTCAWLEGQGFEVTYLPVDKYGMVSPDELRNAIRDDTILISIMFANNEIGTIQPIKEIGEIAKENQIYFHTDAVQAIGHVPIDVKKLNIDLLSLSGHEFEGPKGCGALYIRKGVKIDPLLHGGAQERKRRAGTENVPGIVGLGKATELATAEIEESNRTLLKLRDRLIEGLLKIPKTHLNGHPTQRLANNVNVTFEYIEGESLLLLLNAKGIYASTGSACNSSSLEPSHVLTACGVPHEIIHGSLRLSLGRMNTSEDVDRVLEVVPEIVQKLRNMSPLTPKEYRTL

SEQ ID NO: 45454 - protein, 141 aa, Triticum aestivum
MASAWCLLAPAAAPVAAPGALGVSASESRGVFAARAAVPERTRRRWDSLVVCVAPDEEKITRRSPLDFPIEWEKPKPGRRPDIFPKFSPMKTPLPHPLPADDPLDDDEEEEEEEAQPQEEPQEDDPDKEDPEEDDPDKPTE

SEQ ID NO: 45455 - protein, 207 aa, Corynebacterium efficiens YS-314
MSDVSAGAMGAPEGRPGAAVSDGVSPKPSNWNLPNFLTSLRIIVIPLFAWLTLEGQAENNAHAWWALVVFVLLMITDKLDGDIARARGLVTDFGKIADPIADKALMTTAFVCFNIIGILPWWATALIVIREFGITIWRFFQLRRGTVVPASKGGKMKTALQTLAVALYLAPLPGWMDIPSQVVMYAAVAVTVFTGIQYIVDSRKSSS

SEQ ID NO: 45456 - protein, 238 aa, Hevea brasiliensis
MAMATHLYASYSPITTKTISSNNNSDKVLSLPLPPRHAISIASPSLSLRTTIRFSISAAAGTTAVQVDGPTTSNKGPKSLPFRVGHGFDLHRLEPGYPLIIGGINIPHERGCEAHSDGDVLLHCVVDAILGALGLPDIGQIFPDSDPKWKGAPSSVFIKEAVRLMHEAGYDIGNLDATLILQRPKLSPHKEAIRDNLCQLLGADPSVINLKAKTHEKVDSLGENRSIAAHTVVLLMKK

SEQ ID NO: 45457 - protein, 541 aa, Exiguobacterium sibiricum 255-15
MITVQNVGLRFADRKLFEDVNIKFTPGNCYGLIGANGAGKSTFLKILAGDIEAQQGDVIITPGERLGVLRQNHYEYEEFQVIETVMMGHKRLYEVMKEKDAIYMKENFSDEDGMRAAELEGEFAEMNGWEAESEAAMLLQGLGIKENLHTKTMAELTGGEKVKVLLAQALFGKPDILLLDEPTNGLDLKAVKWLEEFLIGFENTVIVISHDRHFLNNVCTHMADLDYGKIQLYIGNYDFWYESSQLASRMAGDQNKKKEEKIKELQAFIARFSSNASKAKQATSRKKLLDKITLDDIRPSSRRYPFVGFTPEREIGNDLLIVDGISKTIDGVKVLDNVRFSLNKTDKAVFISQNDIAITTLFKILMGEMEADSGTFKWGVTTSQSYLPKDNSAFFEGSDKTILDWLRQYSPADESDTFLRGFLGRMLFSGEEVMKKASVLSGGEKVRCMLSKAMLSGSNVLVLDDPTNHLDLESITALNDGLIAYKGAMLFSSHDHQFVETIANRIIELTPNGIVDKETTYDEYLNNESVQQQLSTLYATN

SEQ ID NO: 45458 - protein, 240 aa, Ehrlichia ruminantium
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSESFPKNGKFIIAYEPVWAIGNNKIPSTDVIIEALEIIRSYDYVSDIIYGGAVNHTNVGDIVSINQLSGVLVGSASLDMESFFNIICSAINVRQS

SEQ ID NO: 45459 - protein, 720 aa, Hevea brasiliensis
MALSACSFPAHVNRNTISDLQKYSYVSSHFLSRKNPLAQSLHRLNQAKSKRRPERVCASLSEREEYHSQRPPTPLLDTINYPIHMKNLSIKELKQLADELRSDVIFNVSGTGGHLGSSLGVVELTVALHYVFNAPQDKILWDVGHQSYPHKILTGRRDKMHTIRQTNGLSGFTKRSESEYDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGSMHELAAKVDEYARGMISGSGSTLFEELGLYYIGPVDGHNIDDLIAILKEVKGTKTTGPVLIHVVTEKGRGYPYAEKAADKYHGVTKFDPATGKQFKGSAITQSYTTYFAEALIAEAEVDKDIVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGVGVQLPPGNKGIPLEVGKGRILIEGERVALLGYGTAVQSCLAAASLVEPHGLLITVADARFCKPLDHTLIRSLAKPHEVLITVEEGSIGGFGSHVAHFLALDGLLDGKLKWRPLVLPDRYIDHGSPSVQLIEAGLTPSHVAATVLNILGNKREALQIMSS

SEQ ID NO: 45460 - protein, 922 aa, Neurospora crassa
MDCHMLMIWVLSTLVDASTDSGEAINITTTTINDTTQAPTMLLPDNLLASLSPMLDMYLPPAVRDFLVSCHRAITSWLGFDPTILLSLGPIVWAAKRLWSEVKMLLVEDIICNWFTARVEVGDDDPIFIHIMRWVAVQPNSAKTRFLQADTIAGSADDHDEDDEAGAAAAAGAAAVKTAITTSATSVSTSTSTTNNTTDPSNTTAAAAAKNKKKQAPTILPNGEACLNFSTHKHQKPPRFLPAVNVPYTFTFAGTYFWLNRTRSNIAHQSEWRGLSMRREENLVITCVGFSAGPIKHFIQFTKEWNHNRQAATTVVRRPARPEMRIYGGRHVWTEVADRPIRPMDTVVLDEKQKLMVLQDMNEYLHRDTAQWYGERGIPLRRGYLFHGPPGTGKTSLSFALAGVFGLDIFVISLLDQNLTEDDLGMLFTNLPRRCVVLLEDIDTAGLVNRKDETDEESSSSSESSGSDAGGSSDSDDDYLMSEKKRALEVIFLEGKLARKKRKGKGKQVTAEQEALEKEVAEKLAALKEMLKEGNDEEKADETVTDEKNTTPEKEKQKPAAPEGEEKPTSSADDARETGEKITKQESSSTTDKKKKPMTAKEKKHKKKQKRKRMSKTFAATTLHNLDLVRRQYGRRRPSPYDRERGISLSGLLNAIDGVASHEGRVLIMTTNKPEKLDEALLRPGRVDIQIAFLNATQEQVRELFERMYEADVVNPATVTFTQVGNKVTASTTSAATTLPPVGHSPHTGVASPDGTGTGTGTTAEKDEEKQQQPPIDPKIVDLKLLDDNNLRKSSISSCSSDATVIGEEDNAAAPPLVPIITAAAAATAKDKGKQQEPAEEKTESPVPLHITPLTRQELQKIAREFSLRIPASQILSPAEIQGFLLRRKKDPRRALAEVDKWVEELVKAKESKSKILDAKAI

SEQ ID NO: 45461 - protein, 187 aa, Legionella pneumophila subsp. pneumophila str. Philadelphia 1
MSTLTSLPNILTLMRISIIPVFIMVFYFPFKWAHPTAAVLFAIASITDWLDGYLARKLEMMSHFGAFLDPVADKLLVSTSLLLLVGAKDIDYITIPAIVIVGREIVISALREWMAEVGRRASVAVGYIGKVKTSLQMIALVLLLAFNPLVSWWGSLGFVLLYVSAILTIWSMVIYLAIAWPELMKKS

SEQ ID NO: 45462 - protein, 223 aa, Brassica napus
MTKQHANWSPYDNNGGTCVAIAGSDYCVIAADTRMSTGYSILTRDYSKIHKLADKAVLSSSGFQADVKALQKVLKSRHLVYQHQHNKQMSCPAMAQLLSNTLYFKRFFPYYAFNVLGGLDENGKGCVFTYDAVGSYEKVGYSAQGSGSTLIMPFLDNQLKSPSPLLLPAQDAITPLSEPEAVDLVKTVFASATERDIYTGDKLEIMILKADGIRTEVMDLRKD

SEQ ID NO: 45463 - protein, 305 aa, Solanum peruvianum
TNSINDALSSSYLVPFESYRVPLVDLEEATNNFDDKFFIGGGGFGKVYKGVLRDGTKVALKSCKPESSQGIEEFETEIEILSFCRHPHLVSLIGFCDERNEMILIYKYMENGNLKRHLYGSDLPTMSMSWEQRLEICIGAARGLHYLHTRAVIHRDVKSTNILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 45464 - protein, 399 aa, Chlamydomonas reinhardtii
MRGVIVVALLSACAYYLPGTLNPTLPYPAQRFGFAHIDPATLPLDNSPLEGVYARNEVLRKAHKLFDGVIASAETVAVSPEGNLTLVDKHGFVYEAEPATKVPGAVFTGEWALDLPATYYLGPGRPLGFHHDAAGNLVIADTLKGLIRLDRTTGAVELLTARVSADSALAPDTPLAYVNDLDIDHDTGVIYFTDSQSIPVYPDRETGTFYDTFQSYLLGFIGGDVAGRLCRYDPATLRTDVLLTGLWFANGVALAADKSYVAVVETNRLRVHRYWLSGPKAGTSDLLIERLPGFPDGMSRAPDGNMWLAIVAPVTGLPKLLKSKVTRFLLAYLPAWARPRIPRWGAALKISPTGQPLQLLMDPDGSHIAFVSSVTEVAGRLYFGNVRMNYVSYLDLKDV

SEQ ID NO: 45465 - protein, 185 aa, Xanthobacter autotrophicus Py2
MAREREQRHEREDRDNTFVDKLVHINRVAKVVKGGRRFGFAALVVVGDQKGRVGFGHGKAREVPEAIRKATESAKRALIRVPLREGRTLHHDVHGHHGAGKVILRAAPAGTGIIAGGPMRAVFETLGMHDVVAKSFGSSNPYNMVRATFDALKNQDSPRSVAARRGIKVSQLQSRRRVEDAEATD

SEQ ID NO: 45466 - protein, 731 aa, Arabidopsis thaliana
MKTKTYRFVCLVASVLTLQLMNGSSAATPPPPPNSKNSSTSCNRTCGGISIPFPFGIGGKDCYLNGWYEVVCNATTSGSSGTTVPFLSRINREVVNISLPEGNNEQYGVVHIKGPVTSLGCSSNTSQVPQKSLPDLNVTGKGSPYFITDENRLVAVGCGTKALMTDIESEILGCESSCKDSKSSQEVTNLLCDGYKCCQARIPVERPQAVGVNIESSGGDGCKVAFLSSKRYSPSNVTIPEQFHAGGYVVVELGWYFATTDSRFRNPLGCINLTYSGSYLSGDSCLCEYGYFSEMSYRNCYCSLGFTGNPYLRGGCIDNDDCKGPNICEEGTCVNVPGGYRCDPKPKIIKPAKPLVLQGVLLGLMGLLFLVVGTLGLIIFIKKRRRIISSRKFFKRNGGLLLKQQLTTTNDGNVDMSRLFSSEELKKATDNFSVKRVLGKGSQGTVYKGMMVDGKIIAVKRSKVVDEDKLEKFINEIILLSQINHRNIVKLIGCCLETEVPILVYEYIPNGDMFKRLHDESDDYAMTWEVRLRIAIEIAGALTYMHSAASFPIYHRDIKTTNILLDEKYGAKVSDFGTSRSVTIDQTHLTTMVAGTFGYMDPEYFLSSQYTDKSDVYSFGVVLVELITGEKPLSRIRSEEGRGLATHFLEAMKENRVIDIIDIRIKEESKLDQLMAVAKLARKCLSRKGIKRPNMREASLELERIRSSPEDLEAHIENDDEEDQVMEISRE

SEQ ID NO: 45467 - protein, 225 aa, Vitis vinifera
MDFFNQFCNSYPFPSDSHSVSTPESSSASDWQTRRTIQSDEEVLLASDRPKKRAGRRKFKETRHPVYRGVRRRNGNKWVCELREPNKKSRIWLGTYPTAEMAARAHDVAALAFRGRKACLNFADSAWSLPVPVSKDSMEIRRAAAAAAEAFRPQEKESVEAAESSIKTSAQNLLLTREELIFDTAGLLITMAEEPLHSPPPCLGDGFMWEDVELDADMSLWSYSI

SEQ ID NO: 45468 - protein, 295 aa, Saccharomyces cerevisiae
MTIDLASIEKFLCELATEKVGPIIKSKSGTQKDYDLKTGSRSVDIVTAIDKQVEKLIWESVKTQYPTFKFIGEESYVKGETVITDDPTFIIDPIDGTTNFVHDFPFSCTSLGLTVNKEPVVGVIYNPHINLLVSASKGNGMRVNNKDYDYKSKLESMGSLILNKSVVALQPGSAREGKNFQTKMATYEKLLSCDYGFVHGFRNLGSSAMTMAYIAMGYLDSYWDGGCYSWDVCAGWCILKEVGGRVVGANPGEWSIDVDNRTYLAVRGTINNESDEQTKYITDFWNCVDGHLKYD

SEQ ID NO: 45469 - protein, 212 aa, Cicer arietinum
GDALGEEFKGYVFKITGGCDKQGFPMKQGVLTPGRVRLLLHRGTPCFRGYGRRNGERRRKSVRGCIVSPDLSVLNLVIVKKGENDLPGLTDVEKPRMRGPKRASKIRKLFNLSKEDDVRKYVNTYRRNFTTKAGKKVSKAPKIQRLVTPLTLQRKRARIADKKKRIAKAKSEAAEYQKLLASRLKEQRERRSESLAKKRSRLSSATKPTATA

SEQ ID NO: 45470 - protein, 74 aa, Arabidopsis thaliana
  misc_feature (34)..(34): Xaa can be any naturally occurring amino acid
  misc_feature (55)..(55): Xaa can be any naturally occurring amino acid
MATSMLSSATMVASPAQVITVDPFIGLKSPADFXSPVLVTFDIISIKSTSSRINXLHAWSQTVITKFVTRSYPP

SEQ ID NO: 45471 - protein, 457 aa, Bradyrhizobium sp. ORS278
MAAAEAHDSKRASRSGNTALPSVSLPVAIAIVIADMIGVGVFTSLGFQVKDLPSGFAILLLWAVGGLVSICGALSYAELGTMFPRSSGEYNFLTRAFHPAVGFMAGWVSSTVGFAAPVALAAMAFGEYGRAVLPSVPPMVLAVGAVWLVTVVQLGGIQQSSRFQLLSTMLKLGLILAFLIAGAIISDPQPVRFAPAAADVGYITSAAFATGLVFVMYAFSGWNAATYIIGELHAPDHSLPRALLVGTLIVIVLYVSLNAVFLRAAPTSELAGQLQVASIAGAHIFGETGGRFVAAMICVGLVPSIAAMMWIGPRVLMTMGEDIPALALFARRSRQGAPVYAVLFQLAVATLMLFTESFEAVLDVVQFSLLSCSFLTVLGLLWLRITAPDLSRPYRAWGYPVTPLIFLSVTGFMMYYLVTARPWQAGFGAAAMLSGLLIYWFAQARSRTAAAAMSGPD

SEQ ID NO: 45472 - protein, 539 aa, Bacillus licheniformis ATCC 14580
MLRFSGRFEGYSLKRFQKDIVAGMVVGVVAIPLGMAFAIASGVKPEHGLYTVIVAGILISLLGGSKYQIGGPTGAFVPILFAIVLQYGFENLLIAGFMAGVILVILGLLKLGKIIKFIPRPVIIGFTAGIAVIIFTGEIAKFLGLRNVEKHESFYMNMREVVINLNTLSFYSILTAVVSLFFVLFTPKVLPKVPGALAGLLVSTVMATMLFPEQVVTIGSAYGEIPRSLPSFQFPELSLEKIIYLMPPALAIAMLGGIESLLSAMVADNMKGTRHDSNKELVGQGIANIAAPLFGGIPATGAIARTATNIKTGAASPISGIVHGVFVLLVLLLFAPYASLIPLASMSPILMVVAWNMSERKEFINILKIRNSDSAVLVVTFLLTVWQDLVFGVAAGILLAIITFIARMSKSFRIKKDVSESIVQSAAAAEEKHFQRSVSIYSVEGPLFFGSSNSLEDSILDKGHPPKLLILLMNKVDYMDSSAEGSLMTIVNRVHQQNGKVMIVGLQQQPRELLHKTGLFHKIGKKHFVDRPEQIFDVT

SEQ ID NO: 45473 - protein, 193 aa, Shigella boydii
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 45474 - protein, 132 aa, Triticum aestivum
  misc_feature (124)..(124): Xaa can be any naturally occurring amino acid
MATIIAGIPTTSITRAGLVLKRPVGASSSTVLGLPAMAKAGKVRCSMEEKPSSSSNIGMGASLLAAAVAATMSSPAMALVDERLSTEGTGLPFGLSNNLLGWILFGVFGLIWALYFVYASTLEXDEESGLSL

SEQ ID NO: 45475 - protein, 172 aa, Ehrlichia ruminantium
MNIFNYMQIMPNISVDAFVAPTAVIIGDVCVNDKCSIWYNSVLRGDVGQIVIGVGTNIQDGTIIHVDRKYGNTNIGKKVTIGHGCILHACEIQDYVLVGMGSIIMDNVVVEKNAMVAAGSLVVRGKVVKTGELWAGRPAQFLRMLSSDEIKEISKSADNYIELASDYITGKL

SEQ ID NO: 45476 - protein, 402 aa, Ehrlichia ruminantium
MSEVQVRAENLGGESILEAPIRVSVKIGDSIKQGDVLFIIETDKTSLEIVSPVDGTVSKVFIADEEIIERDQLLCTINVGELSHIVQSQTQDPKTDNGDIINDDIQTFIQKKDAPSAVKIMAENSIDKNQINGSGIGGRITKSDVLDHINVVSKDHSVLSEQCSITSHEKREERVKMSKIRQVIAARLKESQNTAAILTTFNEVDMKNVMDLRVQYRETFEKKYGVKLGFMSFFIKAVVLALKELPVINAEISGNEIIYKHYYDIGIAVGTDKGLVVPVMRDADKMSCAELELTLASLGKKAREGKLEVSDMAGATFTITNGGVYGSLLSTPIINPPQSGILGMHSIQKRPVVVNDNSIEIRPMMYIALSYDHRIVDGQGAVTFLVRVKQYIEDPSRMFLEI

SEQ ID NO: 45477 - protein, 305 aa, Bacillus anthracis str. Ames
MKLCENITELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKEIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGTGKKVLCVAPDTGERYLSMGLFE

SEQ ID NO: 45478 - protein, 316 aa, Corynebacterium efficiens YS-314
MTKKAILDLDTGIDDALALAYALGSPELEVIGVTCTYGNVLLDTGAANNLALLELFGAPDVPVYLGEPHALMRDGFEVLDISAFIHGANGIGEVALEKARAEAREGGVDFLIDSVREHGDDLVIIATGPLTNIAAAAAKDAAFADNAHIVIMGGALTVPGNVSPWAEANINQDPDAANNVFRAAADVTMIGLDVTLQTLLTSRHTAQWRELGTPAAIALADMTDYYIKAYETTAPHLGGCGLHDPLAVGVAVDPSLVTLLPINLKVDVEGETRGRTIGDEVRLNDPVRTARAAVAVDVDRFLSEFMTRVGRVAANN

SEQ ID NO: 45479 - protein, 300 aa, Chlamydomonas reinhardtii
MSLEVQSKYDRGYQDEGQGLVELGTAHDAVPKTTAQPKYGDDDDLLPVVLERYLEKAGVMQKLRPYLDPSGQVKNEFARCLMAEFFGTLLFQMFGGSAPAKDTTAPAANGFALVAVIYAFANISGAHINPAVTFALICTGHMKWWKGLLYMIAQILGAIFGALIYAALIPALHLGAGAGSPGCFSPTAGVKNGDVFGWEVMMTFLLVMTVYAAAVAKPGHGNTAPLAIGLSLYAAAISGGPYTGASLNPARTIGPAVVFTCNVGVSFLYIFAEFFGAACAAGLSIFLYGRAPDSVRRPAI

SEQ ID NO: 45480 - protein, 303 aa, Solanum peruvianum
TNSINDALSSSYLVPFESYRVPLVDLEEATNNFDHKFLIGEGGFGKVYKGVLRDGTKVALKSCKPESSQGIEEFETEIETLSFCRHPHLVSLIGFCDERNEMILIYKYMENGNLKRHLYGSDLPSMSWEQRLEICIGAARGLHFLHTRAVIHRDVKSTNILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 45481 - protein, 187 aa, Vibrio fischeri ES114
MARTVELTKEEAAAIGYLNFLTLKPTMYIANVSEDGFEDNPFLDMVREYAEKENNVVVPVCAAIESELSELDDEDREEFLADMGIEEPGLNRVIRSGYELLTLQTYFTAGVKEVRAWTIPVGATAPQAAGKIHTDFEKGFIRAEVIGYDNFIEFNGESGAKEAGKWRLEGKEYIVKDGDVVHFRFNV

SEQ ID NO: 45482 - protein, 211 aa, Chlamydomonas reinhardtii
MAMDADDAGPLPDKPKFAPLAPGDKGAGGEAKVEFRRVPVPQHRMTPLKTAWMELYKPITENLKLDMRMNLKTKKVELKSTPQTTASDALQKAADFVHAYLLGFEIRDAVALLRLDDLYVECFEIKDVKTLRGEHLSRCIGRLAGKDGKTKFTIENATRTRIVLADTRIHILGSFQNIRVARDALCALILGSPASKVYSKLRSSCSRLNDS

SEQ ID NO: 45483 - protein, 173 aa, Vibrio fischeri ES114
MGFKCGIVGLPNVGKSTLFNALTKAGIEAANFPFCTIEPNTGVVPVPDLRLDALAKIVKPERILPTTMEFVDIAGLVAGASKGEGLGNKFLANIRETDAIGHVVRCFENENIIHVAGKISPIEDIEIINLELALADLDSCERAMQRNAKKAKGGDKDAKFEISVLEKLLPIIN

SEQ ID NO: 45484 - protein, 157 aa, Chlamydomonas reinhardtii
MFDKLKQAVGLQEQEEKGLVGQIDEAMTLSWKNRLIGFGCCFAFGVLLTLISIPMLWTMQITKFAVMYSVGSVVSVMSTLFLMGPVKQFQRMMEEKRILATIVYIASIAGTLAIAFTTHNPALCLIMLVIQLLALVWYCVTWIPGGQAALKSMIFRS

SEQ ID NO: 45485 - protein, 355 aa, Legionella pneumophila subsp. pneumophila str. Philadelphia 1
MMLYICSSWKKNKKQLELKTRLFLTKMNKKTIAMLGAGSWGTAVAIHLAKIGHKTLLWSHNPQHVALMAEQHSNPAYLPGIPFPENLIPSDNLIECVQSADYVIIAVPSHAFAEIINKIPKPTQGLAWLTKGVDPASHELLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNKVEMPICEQINALLHGIVHAQEAVNNLMSRPAKEE

SEQ ID NO: 45486 - protein, 549 aa, Saccharomyces cerevisiae
MTSQEYEPIQWSDESQTNNDSVNDAYADVNTTHESRRRTTLQPNSTSQSMIGTLRKYARFIGPGLMVSVSYMDPGNYSTAVAAGSAHRYKLLFSVLVSNFMAAFWQYLCARLGAVTGLDLAQNCKKHLPFGLNITLYILAEMAIIATDLAEVVGTAISLNILFHIPLALGVILTVVDVLIVLLAYKPNGSMKGIRIFEAFVSLLVVLTVVCFTVELFYAKLGPAKEIFSGFLPSKAVFEGDGLYLSLAILGATVMPHSLYLGSGVVQPRLREYDIKNGHYLPDANDMDNNHDNYRPSYEAISETLHFTITELLISLFTVALFVNCAILIVSGATLYGSTQNAEEADLFSIYNLLCSTLSKGAGTVFVLALLFSGQSAGIVCTLSGQMVSEGFLNWTVSPALRRSATRAVAITPCLILVLVAGRSGLSGALNASQVVLSLLLPFVSAPLLYFTSSKKIMRVQLNRTKELSRTTDKKPVADRTEDDETIELEEMGIGSSSQERSLVSPAPEYKDMSNGMIVTVLAIIVWLIISGLNFYMLLGFTTGKEVHL

SEQ ID NO: 45487 - protein, 427 aa, Burkholderia thailandensis E264
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILGDRGMSTAVGDEGGFAPNFGSNDECLSTILQAIEKAGYRAGEDVLLALDCAASEFYHDGKYQLAGEGLQLSSAEFSDYLATLADKFPIVSIEDGMHESDWDGWKLLTDRLGKKVQLVGDDLFVTNTRILKEGIEKGIANSILIKINQIGTLTETFAAIEMAKRARYTAVISHRSGETEDSTIADIAVGLNAGQIKTGSLSRSDRISKYNQLLRIEEDLGDIASYPGKSAFYNLR

SEQ ID NO: 45488 - protein, 271 aa, Oryza sativa Japonica Group
MAAATSHSAIVHTQSHRWRPNQAAIWFWFCLCIEVFGGGAGESSLILIRHGESLWNEKNLFTGCVDVPLTPKGVEEAIEAGKRICSIPIDVIFTSSLIRAQMTAMLAMMQHRRKKVYSEETRKQSIPVITAWQLNERMYGELQGLNKQETADRFGNEQVHKWRRSYDIPPPNGESLEMCAERAVAYFKEHVVPQLTAGKHVMIAAHGNSLRSIIMQLDKLTSQEVISLELSTGIPMLYIFKEGKFIRRGSPVGPSEASVCAYTRVRVFSNL

SEQ ID NO: 45489 - protein, 453 aa, Burkholderia thailandensis E264
MEFDYDLFVIGAGSGGVRLSRVAASYGARVGIAEEERIGGTCVLRGCIPKKLLVYASHYGHDVEDAAGFGWTFDIGLFSWPALIEAKDREIARLSGIYGDLLNKSGVEIHAGRATLVDAHTVDVAGRRITARHIGVATGSRPVLPPIPGIEHAITSREALDLPELPRRIAIVGGGYIAVEFAGIFNGLGADVDLFYRGAQILRGFDDDVRRALHGEMTKHGIAIHTHAGIDAIERGADGALTLRLAQGAYGPYDAVLYATGRVANGDGLGLEAVGVARDARGAIEVDAYSTTTVPSIHAIGDVTARPQLTPVATRDGMLLAANLFGGKRIAADHRYIPSAVFSQPEIATVGLTEADARAELGALDIYKTSFRALRHTLSGRDEKTFMKLVVARDSQRVVGAHMVGRDAAEIIQGIAIAIRAGATKAQFDETVGIHPTAAEEFVTLRQKEPDDA

SEQ ID NO: 45490 - protein, 266 aa, Prosthecochloris aestuarii DSM 271
MQQLSIGFVGTGRIARALISGLVNDPANRICGYDKDPDAIAAVVKQFGIEGTSSAAEVARDARIIILAVKPYQIGEVVEELRPHLTTGHLLISVAAGITSEFIRQHSIDAMRVIRVMPNTPAFTGQGMTALSKGIMATQEDIALATTMFSAIGRVAVLDERLMDAATAVSGSGPAYMFSLIASIAEGGRQCGLSMQDAILLSAQTMLGAATMVLNGEKTPEELIREVTTPGGTTEAGLKQMDAHHVRQAMIETVKAAAARSNELKQ

SEQ ID NO: 45491 - protein, 474 aa, Physcomitrella patens subsp. patens
MVPYLNQKDSNGNVLRVGYTVDDHDQEKDPLHPSLPLLQHADLEDKVVLLRVDHNVVKKGKILDQYRIDVTLATMYNIIERGGRLVIMSHVGRPYDKKTNTLTVKQDEAVDAIVGYLQRKLRIKFAIPKFHIFEKEGIHDIDTSINWLIQDLRARKIGGIYLPNTRWFAGEEDKGEKMERLAVQLAALADVYVNDAFGSWQPHTSTYHVTKYLPSFAGLCMQDELSNVRAVLEPKRPFVAIVAGAKYDTKIGPLTAIYRRVDHLILGGLIYNTFLCAKYGVKIKGVEDSDIVLAKDLVEQDRNEGKILELPYVVESDTLEGRIEGKFRTLHIKDFKPGEDYQFIVDVDPASFEPGTEVHKGLESAKTIFVNAVMGLMPSFWHGTSKMDETIDQNRTAQKFFGGGDTLQEFKSLHPGLYHAALDSPKYYMFTGGGTVLKVLEEADPFGLPTVKALIASGEAYGYQKWRAGCTSKI

SEQ ID NO: 45492 - protein, 299 aa, Idiomarina baltica OS145
MSTKRVKKVVIPVAGLGTRMLPATKAIPKEMLPLVDRPLIQYIVEECSAAGLTDVILVTHSSKNSIENHFDTSFELETTLERRVKRQLLEEVQAICPKGTTIMHVRQGEAKGLGHAVLCARPLVGDEPFAVVLPDVLVDSASCDLRQDNMAEMVRNFKETGAAQVMVEKVPHEQVSSYGIADINGVDLAEGEQAPIKQLVEKPEVSKAPSDLAVVGRYVFPETLWPLLAKTPIGAGNEIQLTDAMAMLLEQSPVNAYYMKGKSHDCGNKLGYAQAFIEHAMRHPALADDMKKYIKQLQA

SEQ ID NO: 45493 - protein, 320 aa, Arabidopsis thaliana
MVGLHINMEAQIHILEQEAYSAVLRAFQAQADEFSWDKATVMTNLRKELRISDDENRQLLNNVHNDDLIKRIRDSRPRGGNQVVRHQSLDVHPSPTFSASRKKQKTFQSYPSIGSTRSKSFNNRVVSANEPAEALIGRKVWTKWPEDNSFYEAVVTQYNANEGRHALVYDINTVNETWEWVDLNEIPTKDIRWDGEEDGVTLNVGHGGGTTRGNRRTLSHGGRGRGPRTQPRREHLATENGGGRKFFGEIELFNTDSLVKEVERVFDSNLPDPHELDKAKKLLKEHEQALIAAIARLTDASDYESDGEEPYSHELPMLLG

SEQ ID NO: 45494 - protein, 184 aa, Shigella boydii
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKG

SEQ ID NO: 45495 - protein, 181 aa, Brassica rapa
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVELELEHGFVYREHGSTPGYYDGRYWTMWKLPLFGCTDSAQVLKEVQECKTEYPNAFIRIIGFDNNRQVQCISFIAYKPPSFTGA

SEQ ID NO: 45496 - protein, 631 aa, Exiguobacterium sp.
MKKYRVNVQGMTCSGCEQHVAVALENMGAKAIEVDFRRGEAVFELPDDVKVEDAKNAIADANYHPGEAEEFQSEQKTNLLKKYRLNVEGMTCTGCEEHIAVALENAGAKGIEVDFRRGEALFELPYDVDIDIAKTAITDAQYQPGEAEEIQVQSEKRTDVSLNDEGNYDYDYIIIGSGGAAFSSAIEAVALNAKVAMIERGTVGGTCVNVGCVPSKTLLRAGEINHLAKNNPFVGLHTSASNVDLAPLVKQKNDLVTEMRNEKYVNLIDDYGFELIKGEAKFVNENTVEVNGNQITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHVEINGKKRIIEAEQLLIATGRKPNTESLNLHAAGVEVGSRGEIVIDDYLKTTNSRIYSAGDVTLGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMAPYLTMAEGLKLAVLTFDKDVSKLSCCAG

SEQ ID NO: 45497 - protein, 168 aa, Methanosarcina acetivorans
MLDMTERQVESVLIEIPKGSRNKYEYDKEKKVIKFDRMLFSSMVYPCDYGFFPDTLALDGDPLDALVLTWEPTFPGCVIDVHPVALLDMKDDKGRDEKILCVPETDPLWNYIETLEQVPPHLLKEIVHFFETYKNLEGKHVIVIGWEGLDAAVDMLREAKSRYLEKNK

SEQ ID NO: 45498 - protein, 188 aa, Shigella boydii
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKGWLPL

SEQ ID NO: 45499 - protein, 176 aa, Manihot esculenta
MASSMLSTATVASINRVSPAQATMVAPFTGLKSTPVFPTTRKTNSDITSITSNGGKVQCMKVWPTLGMKKFETLSYLPPLTREQLAKPSCIGPCLEFELEHGLVYREHARVPGYYDGRYWTMWKLPMFGCTDAAQVLKELDELIKHHPDGYARIIGFDNVRQVQCISFLAYKPPGA

SEQ ID NO: 45500 - protein, 473 aa, Oceanobacillus iheyensis HTE831
MSPITKYFNGMSYRSVFLYSIFIILFVAFSFTRSLEYEAKVTLIIFIIAMVLWVATKLPAGYVALGSLLSIILLKGASTSLLYESFSLEIVWLMIGAFMIGEAVKRSGLADRMMNSILHRSTSYNGLLFYVMVALFPLAIFIPSTSGRAALTLPVVKELGRRIKDEKQKQTLALFVPIIILMSTSATVIGAGSHLIGIELLNQTTGDSISYFNWLIWGLPFALFISLVTYFVIKLYMVRQGSNPVSTEIVSDSVEHEKKAMTKKESQTLIIIGILVLLWLTEAVHGYEIGFITILGAIVLMTPKYGLISWRQGIKAVSWNLIIFVSAATALGINLVETGVVGWVEEHIFQFISTYSGFSHWGILCVILLISITSHLYVTSHTTRAIVFLPGFLMLSTSLDLNATAVLFLSLIGMNYCVTFPVSSKALLVYFEQEEMNFEARDLIKLSMLLMPVYFISMLIFYYTYWSWTGLSL

SEQ ID NO: 45501 - protein, 184 aa, Manihot esculenta
MATSMLSTATVASINRASPAQASMVAPFTGLKSTSAFPATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 45502 - protein, 332 aa, Vibrio fischeri ES114
MQNIKFSQFGRNPEVSTVPDMKLFAGNATPELAQRIADRLYISLGDATVDRFSDGEVAVQINENVRGSDVFIIQSTCAPTNDNIMELVVMIDALRRASAGRITAVIPYFGYARQDRRVRSARVPITAKVIADMLSNVGVDRVLTIDLHAEQIQGFFDVPVDNIFGTPVLLDDMRTRGLENPVVVSPDLGGVVRARATAKALGDVDIAIVDKRRPRANVSEVMNLIGDVDGRDCVIVDDMIDTGGTLCKAAEALKERGAKRVFAYATHAVFSGSAPQNIANSVLDQVIVTDSITLSKEMAATGKVTELSLSRMLAEAIRRISNEESISAMFDH

SEQ ID NO: 45503 - protein, 193 aa, Shigella boydii
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKGWLPLFDFAY

SEQ ID NO: 45504 - protein, 418 aa, Vibrio fischeri ES114
MSLLVIGINHTSASVDLREKVAFSPEKLTKALDELKNSDAIQSGVILSTCNRTEIYCEVKHGISSGYVINWLAEFHHVALETLMPSIYIHEEQAAVKHLMRVSCGLDSLVLGEPQILGQVKKAFADAREHNAVEGTIEKLFQQDFSVAKRVRTETNIGGNAVSVAYAACTLARQIFESLSDSTVLLVGAGETIELVAKHLDDSGCKRLIVANRTRERAMGLAEQFNAEVISLPEIPEHLPKADIIISSTASPLPIIGKGMVESALKLRKHQPMLFVDIAVPRDIEGEVAELNDAYLYSVDDLQSIIDHNIEQRKIEAIQAEAIVSEESAEFMTWIRSRQAVNSIRQYRENSEAMRIELLQKSMQALASGQNPEKVLAELSNKLTNKLIHAPTLAMQQAAKNGETEKLTVIRTTIGLDN

SEQ ID NO: 45505 - protein, 229 aa, Erythrobacter sp. SD-21
MFERLIAYLDSIKARDPAPRTRWEVLLYPGVWALAYHRLAHWLFEADLFFLARLVNHWSRMVTGIDIHPGATIGRKFFIDHGFTVIGETAQIGDNVTIYQNVTLGGTNPTNGKGGKRHPTISDDVIIGSGAQVIGPITVGKRARIGANALVLDEVPEGATMVALKARSHLIAAEEWKKDFVPYGTPCDDPCAPSRDCIEKLENELKALRSEIETLRGESQPRQRSGTDD

SEQ ID NO: 45506 - protein, 598 aa, Oryza sativa
LHLAISAQIVHASSNTKPRKNLRLRHRHRRRRRHGRHRRRGPHPPPPRGPEEALRGAPTPARHPPPPQPPPRPAADFPNPNGILVAPPSAAAVAAASSHIDVDVATEADLRENGFRSTRRTKLVCTVGPATCGADELEALAVGGMNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 45507 - protein, 403 aa, Zea mays
MADYVYGPGRTHLFVPGPVNIPDPVIRAMNRQNEDYRSPAVPALTKVLLEDVKKIFKTTTGTPFMIPTTGTGAWESALTNTLSPGDRVVSFLIGQFSLLWIDQQRRPGFDVDAVESEWGQGADLAALERRLREDAPRHAIKAVAIVHNETATGVTNDLAAVRALLDKHAHPALLLVDGVSSICALDFRMDEWGVDVALTGSQKALSMPTGMGIVCASPRALEASKTARSVRVFFDWKDYLRFYDMGTYWPYTPSIQLLYGFRTALDFFLEEGLDNVVRRHNRLGTATRLAVEAWGLSNCCQKEEWFRDTVTAAVVPPNIDSAEVVRHAWKRYNLSFGFGLNKVAGKVFRMGHFGNLNELQFLGCLSGVEMVLKDGGYPVKLGRGVAAAGGSLSNSTPLIPFRF

SEQ ID NO: 45508 - protein, 631 aa, Chlamydomonas reinhardtii
MDRSMLGTTMPQGMPGAAQRRLRGTSAGVRGRGASLVRRTIAGDRPQVATPPAPAVPTLCVPEDFVLAPGELSPVDRNGKNLPEDVFRCFGCTLPACKGAGGCASNLWRNQQDGYLRAILTARVYDVAVIQSPLEEARKLSEAVGNTILLKREDLQPVFSFKLRGAYNKMAKLPAEARARGVITSSAGNHAQGVALAASRMGCTAIICMPVNTPEIKVANVRKLGGQVVLVGESYQEAQAAAVARAVKEGLTFIPPYDDPYTIAGQGTIGDEIMRQISDPEKLDAIFVPVGGGGLIAGIAAYTKALKPDIKIFGVEPTGANAMAISLARGERVALSRVDAFADGVAVKQVGQETFRLCRELVDGIVLVDNSAVSAAIKDVFNETRSILEPAGALAVAGAKAWLKRNSMKGATVVAVTSGANMNFERLRLVAELANVGGRTEAMLTTTIPERPGAFKEFISIALSSDADLSVTEFKYRYSAGSTAQVLWGVGIRNPEQLTALTDRLNAAGMVSHDISGLEVAQVHLRHLAGGRARSYTGRIEDEKIYQVTFPERSGALRRFLDIISPAWNVTLFHYRNSGNRESSVLLGVQVPKFDEARFATAVASLRGDGEGFAFNELQGAVREVFDQFIQ

SEQ ID NO: 45509 - protein, 228 aa, Neisseria meningitidis FAM18
MTVLQERYREVSDRIGKLVLQAGRKPHSVSLIAVGKTFPSDGIREVYAAGQRDFGENYIQEWYGKTEELADLTDIVWHVIGDVQSNKTKFVAERAHWVHTVCRLKTAVRLSGQRPSSMPPLQVCIEVNIAGEAAKHGVAPEEAVALAVEVAKLPNLVVRGLMCVAKANSSETELKTQFQTMQKLLADLNTAGVKADVLSMGMSDDMPAAIECGATHVRIGSAIFGKRG

SEQ ID NO: 45510 - protein, 214 aa, Sulfolobus tokodaii str. 7
MAEEVPVINPEEWKPRTKVGQLVKEGKITSMKEIFEKNYPITEPEIVDVLLPKLKYEVMDIKIVQKQTDAGEISKYKVLIVMGNMDGYVSYGTGKAKQLRVAIQKAIKNAKMNIIPVRRGCGSWECTCGEAHSLPFKVYGKAGSVEVLLMPAPKGTGLVVGPALKTLLTYAGIKDAWSLTRGSTYTTENFIKAGYNALYNTYKFVTPVDWMRRK

SEQ ID NO: 45511 - protein, 350 aa, Chlamydomonas reinhardtii
MALALLTRQALRAGSLCNRVAASRPAKPLVVGRPPVTQRFLAVVGAAPKGKAPPPPPPEEADLEDELGEGDEDYYDPMEELNTAQRRRVLAMKEVQGRYDGLQREYQAELAQLQSKYNTKYAPLYDERRELFSGKKAVTDKFDLEDDGEPDGPIPDFWLNALANHNKIGPFITERDSEVLKYLEDIRSEVLVGEERGFKLTFHFKADNPHFTNSVLEKVYVLEPEDDVVPKAFTGTVISWKEGRDVTVEEQKRRVKAPKGDKSKPAFVVEKVPCDSLFTIFDPPKVPTEADAASMSEEDLEEVEDALSNDFEIGFAIKDQVIPRAVEWFTGEIAPLSPEDYDDEYEEGEY

SEQ ID NO: 45512 - protein, 263 aa, Neisseria meningitidis FAM18
MNVYFLGGGNMAAAVAGGLVKQGGYRIHIANRGAEKRERLQKELGVETSETLPELHSDDVLILAVKPQDMEAACKNIRTNGALVLSVAAGLPVDTLSRYLGGTRRIVRVMPNTPGKIGLGVSGMYAEAEVSETDRRIADRIMKSVGLTVWLEDEAQMHSITGISGSGPAYVFYLLDALQNAAIRQGFDMAEARALSLATFKGAVALAEQTGEDFEKLQKNVTSKGGTTHEAVEAFRRHRVAEAISEGVCACVRRSQEMERQYQ

SEQ ID NO: 45513 - protein, 453 aa, Saccharomyces cerevisiae
MAKRRQKKRTHAQLTPEQEQGIPKSMVIRVGQTSLANHSLNQLVKDFRQIMQPHTAIKLKERKSNKLKDFVVMCGPLGVTHLFMFTQSEKTGNVSLKIARTPQGPTVTFQVLDYSLGRDIKKFLKRPKSLNNDDVLNPPLLVLNGFSTSKRSGEDDQDVNVEKVIVSMFQNIFPPLNPARTSLNSIKRVFMINKDRETGEISMRHYFIDIREVEISRNLKRLYKAKNNLSKTVPNLHRKEDISSLILDHDLGAYTSESEIEDDAIVRVVDNQDVKAKHSQSLKSQRTPVEKKDNKEREKETEEEDVEMEEPKPSENLQPTPRKKAIKLTELGPRLTLKLVKIEEGICSGKVLHHEFVQKSSEEIKALEKRHAAKMRLKEQRKKEQEENIAKKKAVKDAKKQRKLERRKARAAEGGEGQGKDDAMSDDESSSSDSEHYGSVPEDLDSDLFSEVE

SEQ ID NO: 45514 - protein, 611 aa, Oryza sativa
MAKQEQSRDTETNNVAAALQWLRHGELTTPYNGIGMSFGGFDPILSDVAAESAWDPRGPHMSDIHVHRGSAAGRVLAVALALAGRVPAPVRAARPRRPSPPRSPPYAPAYTRSTCTPWNLVLITGTCAPGTGWRLELGDSRRLRQRGGKRAEEVAVDVGWADDEHIDVGAAAVDAEVVGAEGEHQGGGLVGHAVGEHRAAVSSALSYRPSSRRRLSSRAVLSRSAGVGRLSRLAPPCHSVDQQPERSRIARRARPRQWRRTALLSAALVPRQPPATPALLPAASKETEWSSTESSAASGLDFEDTALTLRLPCSLAAAVPDPTASAPPPKPTRPTTPPPSPPPATTIGFPTAAAAATADRAMPTPASPRLRHGTSKKQYLYEELMSGHQPKTSSVNHPSCHSSRLKMQGITKALRFHGKQLKLTVLQHMNKGIFSWATLISRIQTESPTVIIPHIGLENIRVREILNAKGEAKAGAVYWCCTSHFVHEAIKHMTAHNVGALVVLKSGDEKQLAGIVTERDFARKILLPGRPSEETRVGDIMTEEDKLITVSSNTNILQAMELMTERHIRHVPVFDEKVVGMITIGDVVKTIVDQQHQEVKQLKKYIRGDYY

SEQ ID NO: 45515 - protein, 128 aa, Glycine max
  misc_feature (26)..(26): Xaa can be any naturally occurring amino acid
GRHKMLGKLVRYNLKKISFNFSHGSXSYHQETLDNLRTALNNTGILCAVMLDTKGPEIRTGFLKQGKPIEIQRGQEITITTDYSIKGDENMISMSYNKLAHHLSPESNILCADGTISFTVLECDMENG

SEQ ID NO: 45516 - protein, 184 aa, Manihot esculenta
MATSMLSTATVASINRASPAQASMVAPFTGLKSTSAFTATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 45517 - protein, 468 aa, Pseudomonas syringae pv. phaseolicola 1448A
MGLNDQWMQRDLKVLWHPCTQMKDHENLPLIPIKRGEGVWLEDFEGKRYLDAVSSWWVNVFGHANPRINQRIKDQVDQLEHVILAGFSHQPVIELSERLVKLTPEGLNRCFYADNGSSCIEVALKMSFHYWLNRGQPDKKRFVTLTNSYHGETMAAMSVGDVPLFTETYKALLLDTIKVPSPDCYHRPEGMSWEEHSRNMFAAMEQTLAEHHASVAAVIVEPLIQGAGGMRMYHPVYLKLLRDACDRYGVHLIHDEIAVGFGRTGTMFACEQAGIRPDFLCLSKALTGGYLPLAACLTTDDVYDAFYDDYPTLRAFLHSHSYTGNPLACAAALATLDIFEQDNVIENNKALAQRMATATAHLVDHPHVAEVRQTGMAIAIEMVQDKATKTAYPWQERRGMKVFQHALERGALLRPLGSVVYFLPPYVITPEQIDFLAEVATEGIDIATRSSVSVAVRENFHPDFRDPG

SEQ ID NO: 45518 - protein, 183 aa, Oryza sativa Indica Group
MDAKGVNDRDALIDLESGNNIVVGEHNNGADANFAVAQERTAPNGSWNGAMGTNGCLKDDVNHQHMCCCLSSPDAAAKNGDDRKSDGEEKLGLLDTSGGEKTKKKRSKKPPRPPRPPTPTPLDVSDQKLLNELSELAILKRARIERMKALKKMKNAKHGSSSGNLFPLIITIIFCLVILWQGD

SEQ ID NO: 45519 - protein, 276 aa, Oryza sativa Indica Group
MDAKGVNDRDALIDLESGNNIVVGEHNNGADANFAVAQERTAPNGAWNGAMGTNGCLKDDVNHQHMCCCPSSPDAAAKNGDDRKSDGEEKLGLLDTSGGEKTKKKRSKKPPRPPRPPTPTPLDVSDQKLLNELSELAILKRARIERMKALKKMKNAKHGSSSGNLFPLIITIIFCLVILWQGFFSRTGSAVSFHGSPESSVRAHSSLISIRFYKNNNSNSRSREAISAAPKRDLSVDGFQICTVYSTRVWSDVNSHMALLADRPATLLSWTGLDSA

SEQ ID NO: 45520 - protein, 193 aa, Shigella boydii
DERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKGWLPLFDFAYQ

SEQ ID NO: 45521 - protein, 420 aa, Bacillus anthracis str. Ames
MVQKVKERVKIEDILMAHTCMKDIVIKTPLQRDTVLSEKYDCDVYVKREDLQLIRSFKIRGAYNLIRSLSKEQLQNGVVCASAGNHAQGVAYTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIFTAIGGGGLASGVGTYVKGVSPATQVIGVEPMGAASMKEAFLQNDNVALEKIDSFVDGAAVKKVGKLTFETCKDVIDDIVLVPEGKVCTTILELYKKNAIVAEPAGALSIAALDLYRDEIKGKTVVCTLSGGNNDIDRMQEMKERSLIYEGLKHYFIIEFPQRSGALREFLDKGLGPEDDITRFEYIKKHNKENGPALVGVELKHKEDYEQLIIRFKENNIQFMELNKNPVLFDLLI

SEQ ID NO: 45522 - protein, 191 aa, Escherichia albertii
DERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKGWLPLFDFA

SEQ ID NO: 45523 - protein, 168 aa, Oryza sativa
SSTIPDIHERTLVMVKPDGVQRGLVGKIISRFEEKGFKLIAMKFMKADKETVKKHRSDKPKHMIEPIFSFTVDYLTMGPVVPMVWEGHDIIRSVRRMLGKTSPLDSNPGTIRGDFGADIGRNVIHASDTNVSAEYEISLWFDENELVTWSRISDLWIYKDYLQRLDSN

SEQ ID NO: 45524 - protein, 140 aa, Erythrobacter sp. SD-21
MAVTRTFSIIKPDATRRNLTGAVTKMLEDAGLRVVASKRIHMTREQAEGFYAVHKERPFFGELVDFMISGPVVVQVLEGEDAVKRNRDVMGATNPADADEGTIRKTYAESIEANSVHGSDSDENAKIEIDFFFDENEIVG

SEQ ID NO: 45525 - protein, 492 aa, Corynebacterium efficiens YS-314
MSTPTNPEQPTDHPSAPFTLEARFAEEFPEMTTPWRGEDQPDPELAVLNEDLARLLGIDPDWLRSPAGVEFLLGLNPEPTTEMVAQGYAGHQFGQFVPSLGDGRALLLGEIRGTDGVLRDIHLKGSGRTRYSRGADGRAALGPALREYLVSEAMHALGVPTTRALAVVTTGRKIQRDRVLPGAVVVRVATSHIRVGSFQYANITGGIDLSRRLADHAITRHYPRLVERFPESGPERYAWFFRQVMDAQAQTVARWMRLGFVHGVLNTDNTLVSGETIDYGPCAFMDRYREDAVFSSIDTHGRYKFSNQPLILGWNLARLAETLIPLFGDTPDAGVDRAQEMINTFTDRYNDALHAELAAGLGLDADAPDTAGLIESYLELMRTHSPDVTTLNRTLSEWSVESTPPAGFEEWIPRWLAAQPDLINMQKTNPVYVPRNHLVEDALAEAVEGRWEAFTTLLGLVTDPFTRQAGMEVYERPGPDGFEDTYMTFCGT

SEQ ID NO: 45526 - protein, 759 aa, Pseudomonas putida
MLNTLRKIVQEVNSAKDLKSALGIIVLRVKEAMGSQVCSVYLLDPETNRFVLMATEGLNKRSIGKVSMAPNEGLVGLVGTREEPLNLENAADHPRYRYFAETGEEKFASFLGAPIIHHRRVVGVLVIQQKERRQFDEGEEAFLVTMSAQLAGVIAHAEATGSIRGLGRQGKGIQEARFVGVPGSPGAAVGRAVVMLPPADLEVVPDKTVDDIDAELKLFQNALEGVRDDMRKLSAKLATQLRPEERALFDVYLMMLEDAALGGEVTEVIKTGQWAQGALRQVVGEHVNRFELMDDDYLRERASDVKDLGRRLLAYLQEARAQSLVYADNTILVSEELTPAMLGEVPEGKLVGLVSVLGSGNSHVAILARAMGIPTVMGLVDLPYSKVDGIEMIVDGYKGEVFTNPSEVLRKQYSDVVEEERQLAQGLDALRELPCVTPDGHRMPLWVNTGLLADVARAQQRGAEGVGLYRTEVPFMINQRFPSEKEQLAIYREQLAAFHPLPVTMRTLDIGGDKSLSYFPIKEENPFLGWRGIRVTLDHPEIFLVQTRAMLKASEGLNNLRILLPMISGIHELEEALHLIHRAWGEVRDEGTDVPMPPVGVMVEIPAAVYQTMELARQVDFLSVGSNDLTQYLLAVDRNNPRVADLYDYLHPAVLQALNTVVRDAHGEGKPVSICGEMAGDPAAAILLMAMGFDSLSMNATNLPKVKWMLRQINLGKAKELLAEALSHDNPQVIHSSLQLALKNLGLARMIGPGANKTL

SEQ ID NO: 45527 - protein, 350 aa, Vitis vinifera
MALYDRTILVTGGAGFIGTHTVVQLLSEGFTVWIIDNLDNSVLEAIERVRDLVGAELSRKLHFNLGDLRNKADLEKLFSQTKFDAVIHFAGLKAVGESVVNPRRYFDNNLIGTINLYEIMAKYNCKKMVFSSSATVYGQPDKIPCVEDFNLMAMNPYGRTKLFLEEIARDIQKAEPDWKIILLRYFNPVGAHESGKLGEDPKGIPNNLMPYIQQVAVGRLPELNVYGHDYPTRDGSAIRDYIHVMDLADGHIAALRKLFTSEDIGCTAYNLGTGQGTSVLEMVAAFEKASGKKIPIKLCPRRAGDATAVYASTEKAAKELGWKAKYGIAEMCRDQWKWASNNPWGYHSKP

SEQ ID NO: 45528 - protein, 433 aa, Zea mays
  misc_feature (15)..(15): Xaa can be any naturally occurring amino acid
  misc_feature (48)..(48): Xaa can be any naturally occurring amino acid
MGKKVAVVVGGSVAXGLACAHAVAGAGWEVVVLEKAAAPAAGSGTGAXGLGLDAQSMEIISRWIPGWGIDAVTLPLAVDLNIATDSATKAARTLARDEDFKFRAAHWGDLHRRLHEELPPAVTVLWGHQFLSFEAPDDTRGVVATARVLRTGGTVEATGDLLIAADGSTSSVRRSFLPDLKLRYSGYCAWRGVFDFSGKESSDTMTSIRRAYPELGNCLYFDLAYKTHAVLYELPRSRLNWLWYINGPEPELAGNSVTMEATDAMVGRMRNEAERVWCPELARLVRETAAPFVNVIYDADPLRRLSWTGGRVVLVGDAAHPTTPHGLRSTNMSVMDACTLGQCLANWNSEPTPARALAEYEAVRLPVVAEQVLHARQLGRLKQGLPVDGEAEDGFDVTTAKAEVLQLRQRTMPFFDGAPAAVGGDFPLVGSTR

SEQ ID NO: 45529 - protein, 399 aa, Rickettsia akari str. Hartford
MSIISTRLNSIKPSPTLAVVKKTLELKKSGIDIIALGAGEPDFDTPDNIKEAAIKAIQDGFTKYTNVEGMPLLKQAIKDKFKRENSIDYELDEIIVSTGGKQVIYNLFMASLDKGHEVIIPAPYWVSYPDIVALSTGTPVFVNCGIEHNFKLSAEALERSITDKTKWLIINSPSNPTGASYNFEELENIAKVLRKYPHVNVMSDDIYEHIIFDDFKFYTLAQIAPDLKERIFTVNGVSKAYSMTGWRIGYGVGSKTLIKAMTIIQSQSTSNPCSISQMAAIEALNGPQDYIKPNALNFQKKRDFALSILKRVKYFECYKPEGAFYLFVKCDKILGHKTRSGKIISNSNDFAEYLLEEAKVAVVPGIAFGLEGYFRISYSTSMEEIEEACMRIERACNAL

SEQ ID NO: 45530 - protein, 321 aa, Arabidopsis thaliana
MGEPKDSLALFLCHESESSLNEDDDETIERSDKQEPHFTTTIDDEDYVADLVLKENLRFETLPSKTTSSSDRLIAIDWILTTRTRFGFQHQTAYIAISYFDLFLHKRFIGKDETWAMRLLSVACLSLAAKMEERIVPGLSQYPQDHDFVFKPDVIRKTELLILSTLDWKMNLITPFHYFNYFLAKISQDNHSVSKDLVLLRSSDSLLALTKEISFTEYRQFVVAAVTTLLASSSTSSDIRLTREEIANKFGSISWWTSNENENVYLCYQRTLEIEERKHMTPPPEIAVSREPPASGSGAKRRLSFDDSDQSSPPAKRMRRL

SEQ ID NO: 45531 - protein, 202 aa, Zea mays
  misc_feature (185)..(185): Xaa can be any naturally occurring amino acid
  misc_feature (195)..(195): Xaa can be any naturally occurring amino acid
MISQLFKPSTVRSAGLLGRVAKYRVQARYLATVQSNTERVMPAPSARRATAVSNEPATFTIKNGPIFEGKSFGAKTNISGEAVFTTSLVGYPESMTDPSYRGQILVFTQPLIGNYGVPSSARDEHGLLRYFESPYIQASGIVVQDYALKHSHWTAVESLGAWCAREGVPAISGVDTREVVTYLPXAGSSLARISXGEEYDAD

SEQ ID NO: 45532 - protein, 672 aa, Neisseria meningitidis FAM18
MNKSLSGSVEEYRELTLRGMILGALITVIFTASNVYLGLKVGLTFASSIPAAVISMAVLKFFKGSNILENNMVQTQASAAGTLSTIIFVLPGLLMAGYWSGFPFWQTTLLCIAGGILGVIFTIPLRYAMVVKSDLPYPEGVAAAEILKVGGHEEGDNRQGGSGIKELAAGGALAGLMSFCAGGLRVIADSASYWFKSGTAIFQLPMGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPAAERAEQDLSPKAMIFWVLAMMFVLGVSFYHFIGDSHITGGMAWLLVVVCTLLASVIGFLVAAACGYMAGLVGSSSSPISGVGIVSVVVISLVLLLVGESGGLLADEANRKFLLALTLFCGSAVICVASISNDNLQDLKTGYLLKATPWRQQVALIIGCIVGALVISPVLELLYEAYGFTGAMPREGMDAAQALAAPQATLMTTIASGIFAHNLEWVYIFTGIAIGAVLIAADLVLKKSSGGKLALPVLAVGMGIYLPPSVNMPIVAGAVLAAVLKHIIGKKAENREGRLKNAERIGTLFSAGLIVGESLIGVIMAFIIAFSVTNGGSDAPLALNLQNWDAAASWLGLAFFVTGMIIFARRVLKAGR

SEQ ID NO: 45533 - protein, 168 aa, Triticum aestivum
  misc_feature (69)..(69): Xaa can be any naturally occurring amino acid
  misc_feature (80)..(80): Xaa can be any naturally occurring amino acid
  misc_feature (82)..(82): Xaa can be any naturally occurring amino acid
  misc_feature (88)..(88): Xaa can be any naturally occurring amino acid
  misc_feature (109)..(109): Xaa can be any naturally occurring amino acid
  misc_feature (113)..(113): Xaa can be any naturally occurring amino acid
  misc_feature (118)..(118): Xaa can be any naturally occurring amino acid
  misc_feature (122)..(122): Xaa can be any naturally occurring amino acid
  misc_feature (127)..(127): Xaa can be any naturally occurring amino acid
  misc_feature (130)..(130): Xaa can be any naturally occurring amino acid
  misc_feature (138)..(138): Xaa can be any naturally occurring amino acid
  misc_feature (148)..(148): Xaa can be any naturally occurring amino acid
DIGVIAKIESIDALKNLEEIIRASDGVMVARGDLGAQIPLEQVPSIQQRIVRMCRQLNKPVIVASQLLXESMIEYPTPTXAXVADVSXASRQRADLSCFPGDSAMGKYXRSLXVLKIXLRIXKWWRXEKXQEHWDFKXPVSFSDKISXEYQSTKGNNLGSTRFVTQRW

SEQ ID NO: 45534 - protein, 406 aa, Bacillus cereus ATCC 10987
MNIHEIRKQFPILDQKVNGKQLVYFDSAATSQKPIQVIETLERYYKEYNSNVHRGVHTLGTKATDAYEGAREKVRKFINAKSMEEIIFTRGTTTALNTVAASYGLENVKEGDEIVISYMEHHSNIIPWQQVAKKTGATLKYLPLQPDGTISIEDARQTITPNTKIVSIMYVSNVLGTINPVKEIGAIAHENGAIMVVDGAQSTPHMKVDVQDLNCDFYALSAHKMCGPTGIGVLYGKKELLNNMEPIEFGGEMIDFVDLQESTWKELPWKFEAGTPIIGNAIGLGAAIDFLEEIGLDNIEKHEHELAQYALERLSEVDGVTIYGPKHRAGLVTFNIEDVHPHDVATVLDVEGIAVRAGHHCAQPLMKWLKASSTARASFYLYNTKEEIDTFVESLIKTKEYFTNVI

SEQ ID NO: 45535 - protein, 339 aa, Neisseria meningitidis FAM18
MKKILVTGGTGFIGSHTVVSLLKSGHQVVILDNLCNSSINILPRLKTITGQEIPFYQGDIRDREILRRIFAENRIDSVIHFAGLKAVGESVAEPMKYYDNNVSGSLVLAEEMARAGVFKIVFSSSATVYGDPGKVPYTEDMQPGDTTSPYGTSKSMVERILTDIQKADPRWSVILLRYFNPIGAHESGLIGEQPNGIPNNLLPYICQVAAGKLPQLAVFGGDYPTPDGTGMRDYIHVMDLAEGHVAAMQAKSNVAGTHLLNLGSGRASSVLEIIRAFEAASGLTIPYEVKPRRAGDLACFYADPSYAKAQIGWQTQRDLTQMMEDSWRWVSNNPNGYDD

SEQ ID NO: 45536 - protein, 176 aa, Synechococcus sp. CC9311
MKHTLSVLVEDESGALSRIAGLFARRGFNIDSLAVGPAETNGQSRLTMVVEGDEHTLQQMSKQLDKLVNVLQVLDLSQLPAVERELMLMKVSAPAEQRSAILELVQVFRAKVVDVADDALTLEVVGDPGKLVALERLMAPYGILEIARTGKVALERASGVNTELLKAAISGGRVPA

SEQ ID NO: 45537 - protein, 247 aa, Triticum aestivum
  misc_feature (235)..(235): Xaa can be any naturally occurring amino acid
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLXPAFVDIINATKQ

SEQ ID NO: 45538 - protein, 231 aa, Brassica napus
  misc_feature (65)..(65): Xaa can be any naturally occurring amino acid
PRVRKNLNLMEWDKLWTINKKIIDPVCPRHTAVVEERRVLLTLTDGPDEPFVRMIPKHKKFEGAXEKATTFTKGIWIEGADASAISVNEEVTLMDWGNAIVKEVTKDEEGRVTALSGVLNLKGSVKTTKLKLTWLPETNELVKLTLTDFDYLITKKKLEEDDEVATFVNPYTKKETSALGDSNMRNLQRGDVIQLERKGYYRCDVPFIKSSKPIVLFSIPDGRQHQPLAAN

SEQ ID NO: 45539 - protein, 251 aa, Coprinopsis cinerea
MTRSFFVGGNWKLNPTSLSAAKAPVEALNKADLDPSTEVVVAPPALYLLPIQEIAGKAVKVAAQNAYFKESGAFTGEISPKQISDAGIPYVILGHSERRTLFHETSEVVALKTRAALDNGLKVILCIGETLKEREEGRTAAVCEEQLSAVVKQLKEEDWSNIVIAYEPVWAIGTGKVATTSQAQETHVDVRKYLATAVSPKVASETRVIYGGSVNAANSKDLASQQDIDGFLVGGASLKPEFVDIINARKA

SEQ ID NO: 45540 - protein, 519 aa, Trametes versicolor
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWADGPAFVNQCPIAPGHSFLYDFHVPDQAGTFWYHSHLSTQYCDGLRGPFVVYDPKDPHASRYDVDTESTVITLTDWYHTAARLGPRFPLGADATLINGLGRSASTPTAALAVINVQHGKRYRFRLVSISCDPNYTLSIDGHNLTVIEVDGINSQPLLVDSIQIFSALDYSFVLNANQTVGNYWVRANPNFGTVGFAGGINSAILRYQGAPVAEPTTTQTPSVIPLIETNLHPLARMPVPGSPTPGGVDKALNLAFNFNGTNFFINNASFTPPTVPVLLQILSGAQTAQELLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLEAAFAIVFAEDVADVKAANPVPKAWSDLCPIYDGLSEANQ

SEQ ID NO: 45541 - protein, 520 aa, Trametes versicolor
MGRVSSLCALTAVIHSFGRVSAAIGPVTDLTISNADVSPDGFTRAAVLANGVFPGPLITGNKGDNFQINVVDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPVGSDSTLINRLGRFAGGDSTDLAVITVDQGKRYRMRLLSLSCYPNYVFSIDGHNMTIIEADAVNHEPLTVDSIQIYSGQRYSFVLTADQDIDNYFIRALPSAGTTSFDGGINSAILRYSGASEVDPTTTETTSVLPLDEANLVPLDSPAAPGDPNIGGVDYALNLDFNFGGTNFFINDVSFVSPTVPVLLQILSGTTSAADLLPSGSLFALPSSSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNATTPSTAWEDPCPTYNALDSSDL

SEQ ID NO: 45542 - protein, 339 aa, Trichoderma atroviride
MAIPNRKVVITAYGPPSTALQFVTEDLPPPPKDHVQVKILYAGFAGADVNMRLGVYPMQSAPPFTPGYCFAGRVSVNGPGSGKFEPGTLVTALTKYDSDAEYINIPEKYLLAIPDGVDPKVAAALPVDWSTAYGMVHRAAKVSEGQRVFIHGISGAVGQAVMYLSLLQGATVYGTASERNHAALKEAGAHPYLYTNKDWIAAMKDLGGVHAVFDALGFESFDESYSILTPKERSVVVAYGNNLSNLTGAKRRSPWIPMAKLLFKNLYFWSNKGAIFYFITRDQKTFEPELQLLLNMTRDGIITPPIKAVWEFDDIKEAHEAWCKGSGMGSPVIRIARDA

SEQ ID NO: 45543 - protein, 220 aa, Chloroflexus aurantiacus
MYKTVGEATTLVRDLLAGLGELSDREAIVCPPFTALAAVALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGAL

SEQ ID NO: 45544 - protein, 421 aa, Triticum aestivum
  misc_feature (124)..(124): Xaa can be any naturally occurring amino acid
MSVAVAAASSYLPSRYALGHANSHRPLRPLRFISSPPQPCASPASLLRRRRAAAPTTFCSAPSLGRVGWPRREGSAWLLSFSAEADASPSDAEGAVDPSEAVSALLPLVVVATAVAALGNPATXSWVSKELYAPALGGIMLSIGIKLSFDDFALAFKRPVPLSIGYMAQYMLKPLLGVLIARVFRMPSAFFAGFMLTCCVSGAQLSSYASFLGKGDVALSILLTTYSTISSVIVTPILTGLLIGSVVPVNGIAMAKSILQVVLLPVTLGLLLNTYAKPVVNVIQPVMPFVAMVCTSLCIGSPLAINRTMLLSSQGFMLLLPIVTFHIAAFVVGYWVSKLPQLRQEEPVCRTISVCTGMQSSTLAGLLATQFLGISQAVPAACSVVVMAIFGLTLASYWGSGMRIRDIPSRFFPQASADARS

SEQ ID NO: 45545 - protein, 527 aa, Trametes versicolor
MGKFHSFVNVVALSLSLCGRVFGAIGPVADLTISNADVTPDGITRAAVLAGGVFPSPLITGNKGDEFQINVIDNLTNETMLKSTTIHWHGIFQAGTNWADGAAFVNQCPIATATSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHESLDVDSIQIFAGQRYSFILNANQSIDNYWIRAIPNTGTTDTTGGVNSAILRYDTAEEIEPTTNATTSVIPLTETDLVPLDNPAAPGDPQVSGVDLAMSLDFSFNGSNFFINNETFVPPTVPVLLQILSGAQDAASLLPNGSVYTLPSNSTIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTTWSDLCPTYGALDSSDL

SEQ ID NO: 45546 - protein, 461 aa, Corynebacterium efficiens YS-314
MTETKHYDLIIIGTGSGNSIPGPEFEDKSIAIVEKGTFGGTCLNVGCIPTKMFVYTADIAREISDSSKYGIDATYNSVDWPSIVDRVFTRRIDLIAEGGEAYRRGPETPNIDVYDMHARFIGEKTIATGQAGEEKVISGDQIVIATGSRPFIPPVIKESGARYHTNEDIMRLPTLPSSLVIVGGGFIALEFAHVFSSLGTKVTLINRSEVLLRDADADISARIAKITRERVDVRMSTSVTGVTDNADGSVTVSLDSEDPITADVLLVATGRTPNGDQMDLDTAGIEMDGRRIKVDEYGRTTAPGVWALGDVSSPFKLKHVANAEMRAVRHNLLHPDALQTMPHDHVPSAVFTNPQIAQVGMTEAEARAAGHNLTIKVQNYGDVAYGWAMEDTTGFVKLIADRDSGRLLGAHLIGPQASTLIQQLITVMAFDLDVREVATRQYWIHPALPEVIENALLGLEF

SEQ ID NO: 45547 - protein, 405 aa, Salinibacter ruber DSM 13855
MTAFEMEDLAARGALLVGILIVLSRLTKAALERLNLPDLLGYLFIGMALRLVEGTGLLRFVDGPQVLSFLAQLGIVALLFRIGLECTPKNLLRRLSGATRIWIANITLSLGAVLGVALFLLDWALLPSLFAAVALTATGIGVSVRIWRHTDRLGSAKGALMLDVAELDDLSGVVLLALLTALVPQLQAGLSADLVGPMALTLGLVLGKMALLALGGLLFAQYLEHPLTHWLHDIQPRPDLMISVLGIGLVGAGLAALLGFSAAIGAFFAGLIFSRDPLSVKIDASFDSLSDLFIPFFFLHVGFALDLSLLFGNLGAVLLLFAAAVVGKGLGSFMPVMNRLRPSSALTFAVALVPRSEITLLVMQRGLDLGVVSPDAFAVVVAVVILTMGTVPLALRLLLPPVTTT

SEQ ID NO: 45548 - protein, 309 aa, Legionella pneumophila subsp. pneumophila str. Philadelphia 1
MVLIPTLNSTQMNKQVIDKYTQRHELYLEQLLNEIIIPAPQIRSALHYALFSGGKRIRPILVYLAGDLIDVDQGVLDIIAAALELTHCYSLIHDDLPAMDNDDLRRGKPSCHKAFDEATAILVGDGMQALAIEVLLMRLSPLLPAAQVVAITQVLVNASGISGMVSGQSLDLSELAKSSVTEEQLREIHLLKTGKLILACFEMVLAAQHEVSEQIKSALRTYGKHIGLVFQMQDDYLDLYAPTQILGKGRSSDQANQKTTFATLFNKQQLEEEIAVHYQIAMDSLRLFGSKAAALIELTKQLQNRSNLS

SEQ ID NO: 45549 - protein, 465 aa, Salinibacter ruber DSM 13855
MAIPIEMPKLSDTMEEGVLSAWLVDEGEEVSAGDVLAQVETDKATMDLEAFDEGVLLKQVIGEGDAVPIGELIAVIGEAGEDISDLVDDAGGDGAAEPEADPDAEVDSDADAEDASAEPEVEPEPAPEPSGDGQLSERMPEPVPAGTDAEGRRIKASPLARRIAQEHDVELAQVDGSGPEGRIVRRDVETHVEKQEAAPESTPEPEPTTEPEPAPQPEPSVPEAPSYAMPDEEAAYESEGITQMRETIARRLAESKYSAPHYYLTVDIDVERAIEVREDLNDLAEEQGRAKISFNDFITKACALSLHDHPYVNAAYRPDEGEIHKHNRVHIGIAVAIDEGLITPVIRDADRKGLSELARETRALAERARDRDLEPEEFEGATFTTSNLGMFGIEEFTAIINPPNSAILAIGEIRDTPVVEDGEVVPGKRMKVTLSCDHRVVDGAKGAHFLDTVKSYLEEPMNLLL

SEQ ID NO: 45550 - protein, 430 aa, Robiginitalea biformata HTCC2501
MILEMKVPSPGESITEVEIAQWLVSDGDYVEKDQAIAEVDSDKATLELPAEESGVITLKAEEGDAVAVGEVVCLIDTDAEKPDASGGKDQEGSAGTDSVGKGDEGSGGNAEKELDKQKEQAGQAGGSKAPQPRQAKETYASGVASPAAKKILDEKGIDPASVKGSGKDGRITKDDAVKAVPSMGSPGGGSRGESRSKLSMLRRKVAERLVSAKNETAMLTTFNEVDMSAVFDIRAEHKEAFKEKHGVGLGFMSFFTKAVIRALQQFPAVNSMIDGKEMITYDYCDISIAVSGPKGLMVPVIRNAENLSFRGIEEEVKRLALRARDGQITVDEMTGGTFTISNGGVFGSMLSTPIINPPQSGILGMHNIVERAIVRDGAIAIAPVMYVALSYDHRIIDGKESVGFLVAIKEAIENPVEHLMDGDLKKALEL

SEQ ID NO: 45551 - protein, 454 aa, Schizosaccharomyces pombe 972h-
MPEAFERYSSNPTYEPPWRKVRFIGIAGPSGSGKTSVAQLIVKALNLPHVVILSLDSFYKSLNAEQKKRAFNNDYDFDSPEAIDWDLLFVKLLELKQGRKVDIPIYSFNEHNRLPETNTLFGASIIILEGIFALYDEKIRSLLDVSVFLDTDSDVCLSRRLNRDINYRGRDIVGVLEQYNKFVKPSYENFVRRQLSYTDLIVPRGRDNKLAIDMVINFIRRTLSIQSETHVKNIDSLQQIVPTIPHLPLNLVQLKITPEISAIRTILINKNTHPDDLQFFLSRIGTMLMNLAGDSLAYEKKTITLHNGNQWEGLQMAKELCGVSVLRSGGTLETALCRQFPTVCLGKILVQINKVTQEPTLHYHKLPRGIATMNVVLMASHLTTHADVLMATQILVDFGVPEENIIIVVYVCYSESIKALAYIFPKVTIVTAFLESVAEPVVGRLDIEKVYYGC

SEQ ID NO: 45552 - protein, 339 aa, Robiginitalea biformata HTCC2501
MKVLVTGGLGFIGSHTVVELQQAGHQVVIIDNCSNASEDVLDGIFEITGQRPEFERMDLREKAAVNDFFARHTDLVGVIHFAASKAVGESVEKPLLYYENNIGTLVYLLQQLVARGGSSFIFSSSCTVYGQADQMPITEDAPVKPAESPYGNTKQMGEEIIRDTCRVHPELRAISLRYFNPIGAHPSAAIGELPLGVPANLVPFITQTAAGLREELSVFGDDYPTPDGTCIRDYIHVVDLARAHVVALERLFGQQNQSNYEVFNIGTGTGSSVMEVIRSFERVSGEKLNFRVVGRRSGDVVEAYADTTRANNELGWKAESSLDDAMASAWTWEKKVRKL

SEQ ID NO: 45553 - protein, 460 aa, Legionella pneumophila subsp. pneumophila str. Philadelphia 1
MIARNRNTRNLVFFSTNFTMNRLQFVNSLKQINQDSMVFVACGLNHKTAPIHVREKVALQPAMQDSLLSSLLDLPEVNEAAILSTCNRTEIYCDTNTPEVLGNWLAHEHQLSEELLSQFLYIHQGKEGIKHTLRVASGLDSMMIGEPQILGQMKQAYQHACRLGTVKTQLRPVFEYIFRASKRIRTRSGIGANPVSIAYAAVQLIGQLFKNYHSLSVFLIGSGETASLVAKYLHQHGVHRFLIASRTLENAQKLAETFGGKTLSIGDIPQYLPLADVVISATACPLPFINKSLVEHALEQRNHAPMFLLDLAVPRDIEGNVNELEQVHLYNVDDLQSMIEKGMDERRNAALQAEQLIESELDNYIRWHRSLRAKDVICDYRNQMHTLAQQELQRALKKISAGQNQQDVLNEFSMRLVNKLTHNPTIGLRQIAWDNREDLLDLARYLFDTTANQSLYEEIS

SEQ ID NO: 45554 - protein, 437 aa, Robiginitalea biformata HTCC2501
MDSKIFKISLIAALAGFLFGFDTVVISGAEKKLQLLWETSDAYHGTVVIGMALFGTVIGAIFGGFPTNRFGRKRTLIWIGVLYSVSAIGSALSNDPVTFGIFRFLGGIGIGASTVAAPTYISEIAPADQRGRLVGMYQFNIVFGILVAYFSNYLLNGIGDNDWRWMVGVEAFPALIYTAFAFGIPKSPRWLVTQHREEEAAGILEKLGLKLSVGDIVRDLEANVQAGAETIFMKKYRFPLLLAFLIAFFNQFSGINAFLYYAPRIFELAGLEESTALLSSIGIGVTNLVFTLLGIYLIDRLGRRTLMYYGSFGYIVSLALVAAAFFFNWTGMAVPIFLFVFIASHAIGQGAVIWVFISEVFPNHLRGSGQSFGCSVHWVLAWLIPSSVPFLMSWIGPAPVFGFFAFMMVLQLLFVHFMMPETKGISLEELSKRLLRK

SEQ ID NO: 45555 - protein, 452 aa, Oryza sativa
  misc_feature (31)..(31): Xaa can be any naturally occurring amino acid
MEAAAAMEAGRKLAARHPHGRSRTAHNMSSXSSLRKKSDAALVRKVPVAPLRPLLANLQEVFLATKLAVLFPAVPLAIAAQCFRFDQVWVFALSLLGLIPLAERVSFLTEQIALYTGPTVGGLLNATCGNATELIIALFALLKGKIEVVKCSLLGSVLSNLLLVLGTSLFCGGVVNLGARQPYDRNQSDVSTALLFLAVLCHSAPLLLRYAVAAGEHSVSATSAAASLDLSRACSFVMLASYVAYLFFQLKTHRQLFEPQEVDGGDAGDDDEEPALGFASALFWLALMTAVISVLSEYVVGTIEPTSQSWGLSVSFISIILLPIVGNAAEHAGAIIFALKNKLDITLGVALGSATQISMFVVPLSVLVAWIMGVQMDLDFKLLETGSLFMAVLVTAFTLQDGTSHYLKGILLLLCYIVIGACFFVARQPAGHANSNGALLDVPTGSMSVQAA

SEQ ID NO: 45556 - protein, 136 aa, Brassica napus
MGSVMSLSCSKRKATSRDEEPSNSSRKRRKLSSLNDEEEYNCRLIPNLPDELSIQILARLPRICYSSVRLVSRRWRSAVSTSEVYALRKELGITEEWLYVLTKGQDDKLLWYALDPVSTRWQRLPPMPVIVCEEES

SEQ ID NO: 45557 - protein, 396 aa, Saccharomyces cerevisiae
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSSFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 45558 - protein, 444 aa, Arabidopsis thaliana
MATITVVKARQIFDSRGNPTVEVDIHTSNGIKVTAAVPSGASTGIYEALELRDGGSDYLGKGVSKAVGNVNNVIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETKDTFIADLAVGLSTGQIKTGAPCRSERLAKYNQLLRIEEELGSEAIYAGVNFRKPVEPY

SEQ ID NO: 45559 - protein, 337 aa, Sulfolobus tokodaii str. 7
MGFTVALIQGDGIGPEIVSKSKRILAKINELYSLPIEYIEVEAGDRALARYGEALPKDSLKIIDKADIILKGPVGESAADVVVKLRQIYDMYANIRPAKSIPGIDTKYGNVDILIVRENTEDLYKGFEHIVSDGVAVGMKIITRFASERIAKVGLNFALRRRKKVTCVHKANVMRITDGLFAEACRSVLKGKVEYSEMYVDAAAANLVRNPQMFDVIVTENVYGDILSDEASQIAGSLGIAPSANIGDKKALFEPVHGAAFDIAGKNIGNPTAFLLSVSMMYERMYELSNDDRYIKASRALENAIYLVYKERKALTPDVGGNATTDDLINEIYNKLG

SEQ ID NO: 45560 - protein, 499 aa, Shewanella sp. ANA-3
MTTQVKHYIDGEFTTGTGTSQIVVTNPANNEPIALINSATADEVHAAIASAKAAFKTWKEVPVSERARVMLRYQHLLKEHHDELATILAKETGKTFEDAKGDVWRGIEVAEHACNIASLLMGETVENVARSIDTYSYTQPLGVCAGITPFNFPAMIPLWMFPLAIACGNTFILKPSEQDPMTPQRLVELFVEAGAPKGVLQLVHGDKTAVDILLADPAVKAISFVGSVAVGQYIYKTGTDNLKRVQAFAGAKNHCVIMPDANKQQVINNLVGASVGAAGQRCMAISVAVFVGAAKEWIPELKEALAKVRPGLWDDKEAGYGPLISPAAKARVLKLIAQGKEEGAECLLDGSDFSVAGYESGNWVGPTMFTKVTTDMSIYKEEIFGPVLCCMESDSLEEAIELVNASPYGNGTSIFTASGAAARKYQHEIEVGQVGINVPIPVPLPFFSFTGWKGSFYGDQHAYGKQAVRFYTETKTITSRWFESDIAVAAGPNMSINLR

SEQ ID NO: 45561 - protein, 351 aa, Arabidopsis thaliana
MSPEMEFVKVLGKGTYGSVELFSHKQNDGSLLYNAVKIMDSENYGSIDQEFRILSELRGCPCIVQLCGNSLVQGIDCNGKKVYMMSMEYAAAGTLTNFIKRNRTKLSDSVIKDFTRMILQGLVSIHNHGYVHCDLKPDNILLFPLYDKDTWNCSYELKISDFGISTRAGDKSGCWRVDEPWVGTSIYMSPESVSDGTTVEKTLDLWSLGCIVLKMYTGKRPWLGFEKDVKSLLLNQKAPEIPETLPCDARLFLEKCFSRKPEERGSASELLLHPFLTGDEKKGSSVAGGERTGMVLRLRKPPPISKDIPTKPRKLKVISQKPQQLKKVSNKPLKVKIVPPRPPRSDFVPVL

SEQ ID NO: 45562 - protein, 427 aa, Peptococcus niger
LNQGTIIKVVGPVVDVEFPSGLLPNINNALHISSDEQPEDKKTGHDFKVVLEVAEHLGGNIVRAIAMSSTDGLMRGMVVTDQESPITVPVGDATLGRLMNVVGDPIDEAGEVPSETRWPIHRSAPTYVQQNPSKEILETGIKVVDLLCPYVKGGKIGLFGGAGVGKTVLIQELIRNIAYEHGGYSVFAGVGERTREGKDLLVEMRESGVIDKTSLVFGQMNEPPGARMRIALTGLTVAEYFRDEQNQDVLLFIDNIFRFTQAGSEVSALLGRMPSAVGYQPTLATEMGTMQERITSTDKGSITSVQAVYVPADDLTDPAPATTFAHLDATTVLERSISEKGIYPAVDPLASTSRILDPRIVGEEHYEIARDVQEVLQEYRELQDIISILGMDELSDEEKLTVARARRIERFLSQSFFVAEQFTGNPG

SEQ ID NO: 45563 - protein, 225 aa, Oryza sativa Indica Group
MAPSAMVLIVLLVLVVLPSSTLCSRAGPSSKHGHGGGHAKRVPPPASVPPPPPPPPAPAALVRATCNSTSYYDLCVAELSADPSSATADVRGLSSIAVSAAAANASGAAQAASALANATDAGTTAGVAGDGGGAVVQRLLATCAAKYGDARDALAAAKGSIAQQDYDMASVHVSAAAEYPQVCRTLFGRQSPGDYPPELAATEVALRQLCSVALDIIALLSSSSN

SEQ ID NO: 45564 - protein, 303 aa, Triticum aestivum
  misc_feature (264)..(264): Xaa can be any naturally occurring amino acid
  misc_feature (273)..(273): Xaa can be any naturally occurring amino acid
MLRSTHPLSPSSGGSGGSSPAPASSSGEAMVGGAPSGAKLLQILNVRVVGTGERVVVLSHGFGTDQSAWSRVLPYLIREHRVVLYDLVCAGSVNPDHFDFRRYNNLDAYVDDLLAILDALRIPRCAFVGHSVSAMIGILASIRRPDLFAKLVLIGASPRFLNDSDYHGGFELEEIQQVFQAMSANYEAWAKGYAPLAVGADVPAAVQEFSRTLFNMRPDISLHVCQSVFKTDLRGVLGMVQAPCVVVQTTRDVSVPANVAAYLXAHLGGRTTXSSPCRREGHLPHLSAPSLLAQVLRRALARF

SEQ ID NO: 45565 - protein, 260 aa, Brassica oleracea
QLMTWKTAVANIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFATEALLNEHGKSISGQRFVIQGFGNVGSWAAKLISEQGGKIVAVSDITGAIKNKDGIDIESLLNYTKEHRGVKGFDGAHPIDANSILVEDCDILIPAALGGVINRENANEIKAKFIIEAANHPTDPDADEILSKKGVVILPDIYANSGGVTVS

SEQ ID NO: 45566 - protein, 568 aa, Glycine max
MASSALISDTQPWKDLKAHVDDVKKAHLRDLLSDDKRCQSMLVEFDDILLDYARQQATPETIQKLFELAEAASLKEKINRMYSGEHINSTENRSVLHVAFRASRDAVIESDGKNVVPEVWKVLDKIQDFSERVRNGSWVGATGKALKDAVAVGIGGSFLGPLFVHTALQTDPEAVESARGRQLRFLANVDPIDVARNITGLNPETTLVVVVSKTFTTAETMLNARTLREWISSALGPSAVAKHMVAVSTNLTLVEKFGIDPKNAFAFWDWVGGRYSVCSAVGILPLSLQYGFSVIEKFLRGASSIDQHFYSQPFESNIPVLLGLLSIWNVTFLGYPARAILPYSQALEKFAPHIQQVSMESNGKGVSIDGVPLPFEAGEIDFGEPGTNGQHSFYQLIHQGRVIPCDFIGVVKSQQPVFLKGEVVSNHDELMSNYFAQSDALAYGKTAEQLQKENVSPHLIPHKTFSGNRPSLSLLLPSLNAYNIGQLLAIYEHRIAVEGFIWGINSFDQWGVELGKSLATQVRKQLNASRTKGEPVQGFNFSTTTMLTRYLQASSDVPADLPTVLPKI

SEQ ID NO: 45567 - protein, 249 aa, Xanthobacter flavus
MTAERRPLIAGNWKMNGLRAAKSELRTVAAGLAGLSAETMICPPFTLIGAFAADVAGTQLMIGGQDCHPAESGAHTGDISAEMLRDAGAVAVILGHSERRIDHQEGDAIVKAKVKAAWRAGLLPVVCVGETLVERDAGEAAAVVTRQVRQSVPEGATAVSLVIAYEPIWAIGTGRTPTTDDVAEVHGAIRHILAERFGAEANGIRILYGGSVKPDNAAALLATANVDGALVGGASLKAADFLAIARAVG

SEQ ID NO: 45568 - protein, 87 aa, Brassica napus
NVKFAFVWPFQIVFETWERSGKRVRDFNLYTGVLGTAYLLFKSCQVTRNKNDLKLCLEIVEACNTASKDSDRVTFICGRAGVCALGA

SEQ ID NO: 45569 - protein, 713 aa, Thermus thermophilus HB8
MEGTPNVPQAHRYELTLAGRPLVLETGKYAKQASGSVLVRYADTVVLATAQASETPVEADFLPLTVEFEERHYAVGKIPGSFMRREGRPGEKAILSARMTDRPIRPLFPKGFRHEVQIIVTVLSADQKNPPDILGPIAASAALMLSDIPWEGPIAAVRVGLIGGSFVLNPTLQELEESQLDLVVAGSKEAILMVEAEAGEVDEETLVQALEFAHKEMQPILELQEAMARELAKPKMAWTPPESLPEEEKEALYRLALERGLSQVLQTASKGERSRALAEFAERLIAEALPKGEDGTPDEGKKPLYESAFDEVVRRELRRLVLEEGKRADGRGPKDLRPIWIEVDVLPRAHGSAVFTRGETQVLGTVTLGTGRDEQILDDLGIDETEKFLVHYNFPPFSTGEVRRLRGVSRREVGHGNLAKRALKAVMPKEEDFPYTIRVVGDVLESNGSSSMATVCAGCLALMDAGVPIRAPVAGVAMGLVWEENRAVILTDILGLEDALGDMDFKVAGTRKGVTALQMDNKVGGLPREVLKEALLQAREARLKILDLMEAVLPAPRPELKPFAPRILSLKVPVEKIGLVIGPGGKNVRALEELGVEVDIEEDGTVRIYSSDLQAALEAKKRIEDLTREAKVGEIYEGTVTRITPFGAFISLFPGTEGLLHISQIAPGRVARVEDHLKVGDVIKVKVHRIDERGKIDLIRPELEGKIPPRRRR

SEQ ID NO: 45570 - protein, 167 aa, Mycobacterium avium
MSPQTHTLSVLVEAKPGVLARVAALFSRRGFNIESLAVGATEQKDMSRMTIVVSAEETPLEQITKQLNKLINVIKIVELEDGNSVSRELALIKVRADAGTRSQVIEAVNLFRAKVIDVSPEALTIEATGDRGKIEALLRVLEPSVSVRSSNREWCRCPGPRGIGTAK

SEQ ID NO: 45571 - protein, 2188 aa, Oryza sativa Japonica Group
MSAAQGLALKLRAAPAAGGVRGEKRRRAASATAAAAARPRHGAMSLEGGFLGGALPAEDRVAPRASASRQAEAGAGAGAARPPPRSMSKIPESSIGLYDPSMERDSCGVGFIAELSGEYSRKTVDDAIEMLDRMAHRGACGCEKNTGDGAGILVALPHNFFREVTKDAGFELPPPGEYAVGMFFMPTDDKRREKSKLLFREKAELLGHTVLGWRRVPTDNSGLGQSAVDTEPVIEQVFVTKSASSKADFERQMYVLRRFSVMSIREVLGVKNGGTKDFYMCSLSSRTIVYKGQLKPSQLKGYFFADLGDESFTSYMALIHSRFSTNTFPSWDRAQPMRVLGHNGEINTLRGNKNWMKAREGLLKCEGLGLTRDEMLKLLPIVDATSSDSGAIDNVLELLIQSGRSAPEAVMMMIPEAWQNDVNMDPERKALYEFFSALMEPWDGPALISFTDGRYLGATLDRNGLRPGRFYVTYSGRVIMASEVGVVDVPPQDVSRKGRLNPGMMLLVDFENHCVVNDDELKKEYSKVRPYGEWLKRQRIQLTDIIESVNEAERIAPSISGALPITKENKADMGICGILTPLKAFGYTREALEMLMLPMAKDGQEALGSMGNDTPLAVMSNREKLTFEYFKQMFAQVTNPPIDPIREKIVTSMECMIGPEGDLSETTERQCHRLTLKSPLLNTNEMEAIKKMNYRGWRSKVLDITYPKKNGRMGLKQTLDKICAQAREAIHEGYTILVLSDRGFSSERVAVSSLLAVGAVHQHLVSHLERTRIGLLVESAEPREVHHFSTLIGFGADAICPYLAIEAIWRLQIDGRIPPNDGKPYTQEQLIEKYFYASNYGMMKVLAKMGISTLASYKGAQIFEALGLASEVVSKCFEGTPSRVEGATFEMLAQDALRLHEIAFPSRTLPPGSADANALPNPGDYHWRKNGEVHLNDPFSIAKLQEAARINSREAYKEYSRRIYELNKACTLRGMLKFREIPNQISLDEVEPAKEIVKRFCTGAMSYGSISLEAHTSLAEAMNTLGGKSNTGEGGEQPCRMVPLPDGSKNPRISAIKQVASGRFGVSIYYLTNAVEVQIKMAQGAKPGEGGELPGHKVIGDIAVTRNSTAGVGLISPPPHHDIYSIEDLAQLIHDLKNANPGARISVKLVSEAGVGIVASGVVKGHADHVLISGHDGGTGASRWTGIKNAGLPWELGLAETHQTLVANGLRGRAVLQTDGQMKTGRDVAVACLLGAEEFGFSTAPLITLGCIMMRKCHTNTCPAGIATQDPVLRAKFAGKPEHVINYFFMLAEEVREIMAQLGFRTVNEMVGRSDMLEIDPKVLEGNEKLENIDLSRLLKPAAEISPGAVQYCVEKQDHGLDMALDNKLIASSTAALRKGVRVFIETPVRNINRAVGTMLSHEVTKRYHIHGLPSDTIHIKLNGSAGQSFGAFLCPGITLELEGDSNDYVGKGLSGGKIVVYPPRNSRFNPQDNIVIGNVALYGATKGEAYFNGMAAERFCVRNSGAQAVVEGIGDHGCEYMTGGTAVILGKTGRNFAAGMSGGIAYVYDVDGKFSSRCNYELVDLYAVVEEDDITTLRMMIQQHRLHTQSDLARDILLNFDTLLPKFIKVYPRDYKRVLDKLKEEKAAKEAEQKAREVVDKKPVEVIQAPNGISVKTEKVMNEEPSSRPSRVSNAVKYRGFIKYEREGTSYRDPNERVKDWNEVAIELVPGPLLKTQSARCMDCGTPFCHQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKDLPIPGRELAGIHFAMEFLHANTKSLLDSNLEDGNYISAQGRKVVVIGGGDTGTDCIGTSIRHGCTNLVNLELLPEPPRKRAPDNPWPQWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 45572 - protein, 350 aa, Schizosaccharomyces pombe 972h-
MTIPDKQLAAVFHTHGGPENVKFEEVPVAEPGQDEVLVNIKYTGVCHTDLHALQGDWPLPAKMPLIGGHEGAGVVVKVGAGVTRLKIGDRVGVKWMNSSCGNCEYCMKAEETICPHIQLSGYTVDGTFQHYCIANATHATIIPESVPLEVAAPIMCAGITCYRALKESKVGPGEWICIPGAGGGLGHLAVQYAKAMAMRVVAIDTGDDKAELVKSFGAEVFLDFKKEADMIEAVKAATNGGAHGTLVLSTSPKSYEQAAGFARPGSTMVTVSMPAGAKLGADIFWLTVKMLKICGSHVGNRIDSIEALEYVSRGLVKPYYKVQPFSTLPDVYRLMHENKIAGRIVLDLSK

SEQ ID NO: 45573 - protein, 380 aa, Schizosaccharomyces pombe 972h-
MQQSPTAGKIINCKAAVAWQPAAPLSIENVQVFPPRVHEVRIKIVNSGVCHTDAYTLSGKDPEGLFPVILGHEGAGIVESVGPQVTTVQVGDPVIALYTPECKTCKFCKSGKTNLCGRIRTTQGKGLMPDGTSRFSCNGNTLLHFMGCSTFSEYTVVADISVVAIERLAPLDSVCLLGCGITTGYGAATITADIKEGDSVAVFGLGSVGLAVIQGAVKKRAGRIFGIDVNPEKKNWAMSFGATDFINPNDLQSPIQDVLIHETDGGLDWTFDCTGNVHVMRSALEACHKGWGQSIVIGVAAAGQEISTRPFQLVTGRVWRGCAFGGVKGRSQLPDLVKEYLDHKLEIDKYITHRRPLKEINEAFTDMHNGNCIKTVLSIP

SEQ ID NO: 45574 - protein, 579 aa, Pseudomonas fluorescens Pf-5
MPRPSSFHSPSRRTFVKALAAGGVLAGFGLWRNPVWAVSSPGQPEVLAGSDFDLCIQQLPVNFSGRPRKAMAINGSLPGPLLRWREGDRVTVRVRNRLDQPSSIHWHGIILPADMDGVPGLSFEGIEPGGLYRYSFPVKQHGTYWYHSHSGLQEQLGVYGPLVIDAREPEPFSYERDYVVLLSDWSDEEPGQILRTLKKQSDYYNQHKRTLGDFIEDVGRDGWAATLAERSMWAQMNMTPTDLADVSGATYTFLLNGQAPGQPWCGLFRPGERLRLRVINASAMSYFDLRIPGVQMTVVAADGQHVVPVTVDELRIAVAETFDVLVQPGAGAHALFAQAMDRSGYALGTLASAPGLVAEAPAMDPRPLLGMTDMAMGAMDHGAMPGMDHGAMDHGAMNATISHPTSETNNPLVDMQAVNPMPRLDDPGIGLRDNGRRVLRYADLKSTFADPDGREPSRTLTLHLTGHMEKFAWSFDGIPFAEAEPLRLRYGERLRIELVNDSMMAHPIHLHGLWSDLEDEHGRFQVRKHTIDMPPGTRRSYRVTADALGRWAYHCHLLYHMESGMFREVRVEEERHHEA

SEQ ID NO: 45575 - protein, 396 aa, Schizosaccharomyces pombe 972h-
MTVSEGIARIQAFRKQVPLVEKNENITFFNLSFQPPMNSIVANTINEYVDWGLYNPNPKPLWQQKAEETRELVAKYLNASSSDSIAFTRDTTEGLNLFQRSMHFQPGDNVVLLDGEHPNHGFGWISLQEAGLEVRLIPSKDIYYADASTFEPYVDEKTKAIGISSVMFHSGQLNNVKDICNKFRPENIHVLVDMTQQVGLSSIDVQELNVSACAFACHKGLSCPTGLGVLYVAPDVLPQLKNVPPIVGAGAIENLDANLLVNLNPIYFSTARRFEHLNKSLITTLCLNNYLSFLMDIGFENIEQYLRELGKSLVDELSKLGVTIIGSKDPKKRSTHSYVAKILNPEWDAFLKNEGVYASQYRDGIRLSLGLYNNAADISRLANTIKKGVLNKIPFN

SEQ ID NO: 45576 - protein, 202 aa, Zea mays
  misc_feature (21)..(21): Xaa can be any naturally occurring amino acid
  misc_feature (92)..(92): Xaa can be any naturally occurring amino acid
PYEGVGGVPQGGGGLHQRRRXSTSPTLTAWNLQQARADQHHRSAREMELYNKNGDEIVSFEAFNALRQESHGEGNMLGFEWWKEDHFNASDXNADGFLDKTEFNDFLNPSDSDNPKIINLLCKQEIRFISEHELEPVLDKLYLSERYYSRQQAIHAISEADKDHDGRLTLEEMVENPYAFYGSVYLSSSDNDDEDYFHDEFR

SEQ ID NO: 45577 - protein, 489 aa, Burkholderia xenovorans LB400
MGKATGFLEFERRHEAYEAPLTRVKHYKEFVAALSDEEAKIQGARCMDCGIPFCNNGCPVNNIIPDFNDLVFHQDWKNAIEVLHSTNNFPEFTGRICPAPCEAACTLGINNDPVGIKSIEHAIIDKAWTEGWVAPLPPKHKTGKKVAVVGSGPAGLAVAQQLARAGHDVTVFEKNDRIGGLLRYGIPDFKLEKWLIDRRMRQMEAEGVTFRANVFIGKADSLPAHIGNTAKETITPDQLKEEFDAVVIAGGSETPRDLPVPGRELEGIHYAMEFLPQQNKVNAGDKVANQLLAKGKHVVVIGGGDTGSDCVGTSNRHGAKSVTQFELLPQPPEEENKPLVWPYWPIKLRTSSSHDEGCSRDWAVATKRLEGKNGKVEKLIAARVEWKDGKMQEVPGSEFEMKADLVLLAMGFTQPVSPVLEAFGVDKDARGNVRSSTEGDKAYYTSVDKVFTAGDMRRGQSLVVWAIREGRQCARSVDAFLMGHSELPR

SEQ ID NO: 45578 - protein, 335 aa, Yersinia pseudotuberculosis IP 32953
MPTDDSNNGIIDYVSTGHLPDPETVVKLVQEAHKRFSTDTAGVVSNVYPALERIPADLFGICMVGTNGKIHSAGDVDYEFTIMSVSKPFVFALVCQAIGAKTAREKLGVNSTGMAFNSVTAIERASDGRTNPMVNSGAIATTSLVPGATSDEQWKFIYDGLCRFAGRELTLNEEVYQSACETNFRNRGIANVLQGYGRLGCDPIIATDLYTRQCSLNVSARDLAVMGATLADGGVNPLTRERVVDNDICHYALAVMVTAGLYETSGDWLYDIGLPGKSGIGGGIVTVSPGKGGLGTFAPLLDSAGNSIKGQLAARFLSRSLGMDMFVSEPYTEKN

SEQ ID NO: 45579 - protein, 548 aa, Prosthecochloris aestuarii DSM 271
MSLQQSPAWRALASHKQTLDCVLMRDLFADDPERFSRFSIRSGDLLLDYSKNRVTSETMALLADLAREAGVEACRDEMFAGSKINFTEKRAVLHTALRQPWGFQLLLEGGQEVGKDIAAVLGQMKGFTEQILSGKWKGYSGKAITDVVNIGIGGSDLGPYMVTEALRPFAHGAVKVHFVSNIDGTHISETLKRVDEETTLFIIASKTFTTQETLTNAHTARSWFLERAVDESFIARHFAAVSTNKEAVQAFGIDTGNMFGFWDWVGGRYSLWSSIGLSIALYLGFDRFLELLAGAHSMDEHFRSAPLDANIPVVLALLGIWYNNFFDFPSHAVIPYDQYLHRLPAYLQQLDMESNGKRVDRDGNVVDYATGPVIWGEPGTNSQHAFFQLMHQGTSCVPADFILPLKTQNPAGEHHDILAANCFAQTEALMKGKTAAEARAELGSAGMSEEEIDALVPHKVFPGNRPTNTLIFNEINPFNLGALIAMYEHKVFVQGVIWRINSFDQWGVELGKQLAKAILPELGSADDVATHDASTNALINLYRRSRNG

SEQ ID NO: 45580 - protein, 560 aa, Chlamydomonas reinhardtii
MATPPQNTADPEKTQLQKLQNAEVTLLTMEKEEVVVYHNPLWRCLHFMGAFMLPGLGMFCEAYFVFAVGNLSAVWKAEYPDCWATHTTCPKKLSDSITYTQVCGIIFGQLVLGFFADRIGRKWGSVSTAATMVVGGILIVASAGPTDRALWAMFTAVQFIFGIGVGGEYPVASTSANERAESSVALSKRRGETVVLVFSMQGWGNLVNTAVIIAIMAGFNQYHPPYSSYALEVTWRLSYAIGLIPLISILLYRVFHLRESAVWQKKREALRAMGGAKASGVQWRKFSLLMRYYWHRNFGTAMSWFVWDFAFYGNKLFQSTFIKIINPHASVIQILEWTLLNSAVALVGYYFAAFTIDKPWMGRMRMQIMGFSWMFVLFLICAVHYDALSTPKWIHAFQFLYYFSSFWGQFGPNATTWLLPAELAPTEVRSMCHGFSAAVGKAGALVAGVVFGLVDNRTKFWISAFCGLAGVILTLITIPDVTTLDLREGDRRWLAILDGHHDMYHGEAVNPKNLSLIERLMGYGKLYKPHAGEQYAVDKSSDDSTPEGVKGMDGIEQPAK

SEQ ID NO: 45581 - protein, 275 aa, Sulfolobus tokodaii str. 7
MSITPSNQNITSLLKKESILNALERGIRLDGRKNSDYRPISVTLNYAKKAEGSALVKLGDTMVLAGVKLEEEEPFPDTPNQGNLVVNVELLPLAYETFEPGPPDENAIELARVVDRSLRDSKAVDLSKLVIIPGKKVWTAWVDVYVLDYGGNVLDACTLAAVAALYNTKLPKVEIEGDNVKIIKEEKTDVTPIAYPVVTVTVAKIGKYLVVDPSLDEESIADVKISFSYVQDGRIVGMQKSNFGSLSLQEVDVAESLARSASQKLFEELKKQINM

SEQ ID NO: 45582 - protein, 490 aa, Neisseria meningitidis FAM18
MNQTSRDLTRISHNTKIVATLGPGSNNVELLEDMIRVGGLNVVRFNFSHGTPEFHQENARIVREAAKRAGQEIAIIADLQGPKIRVGKIAGGGIELNKGETLLLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 45583 - protein, 247 aa, Sulfolobus tokodaii str. 7
MRQKMIQLQKPRLILDNGLRLDGRKPDEMRPIKIELGVLKNADGSAIFEMGNTKVIAAVYGPKEMHPRHLALPDRAVLRVRYHMTPFSTDERKNPAPSRREIELSKVIREALESTILVELFPRTVIDVFMEVLQADAGTRLVSLMAASMALADAGIPMRDLIAGVAVGKADGVLVLDLNEPEDMWGEADMPVAMMPSLKQVALLQLNGNMTPQEFRQALEMAQKGIETIYNLEKEAIRSKYAELKEE

SEQ ID NO: 45584 - protein, 413 aa, Staphylococcus aureus subsp. aureus MW2
MAEHSFDVNEVIKDFPILDQKVNGKRLAYLDSTATSQTPVQVLNVLEDYYKRYNSNVHRGVHTLGSLATDGYENARETVRRFINAKYFEEIIFTRGTTASINLVAHSYGDANVEEGDEIVVTEMEHHANIVPWQQLAKRKNATLKFIPMTADGELNIEDIKQTINDKTKIVAIAHISNVLGTINDVKTIAEIAHQHGAIISVDGAQAAPHMKLDMQEMNADFYSFSGHKMLGPTGIGVLFGKRELLQKMEPIEFGGDMIDFVSKYDATWADLPTKFEAGTPLIAQAIGLAEAIRYLERIGFDAIHKYEQELTIYAYEQMSAIEGIEIYGPPKDRRAGVITFNLQDVHPHDVATAVDTEGVAVRAGHHCAQPLMKWLNVSSTARASFYIYNTKEDVDQLINALKQTKEFFSYEF

SEQ ID NO: 45585 - protein, 302 aa, Shewanella sp. ANA-3
MKQHQIRKAVIPVAGLGTRMLPATKAIPKEMLPVVDKPLIQYVVSEAIDAGIKEIVLVTHASKNSIENHFDTSFELEAQLERRVKRQLLEAVQSICPKDVTVISVRQSQAKGLGHAILCAKSVVGDAPFAVLLPDVIIDDASCNLKTDNLAAMVSLFDETQVGQIMVEGVPHHLVNQYGIADVNGHDLQPGESEPLVELVEKPPVDEAPSNLAVVGRYVLPAAIWPLLAKTPAGAGDEIQLTDAIAMLMKQETVNAYYMQGKSHDCGNKQGYMRANVEYALRHSEIGEDFAQYLKTVVKGIK

SEQ ID NO: 45586 - protein, 182 aa, Streptomyces coelicolor A3(2)
MQQERTVKVSKYLSKHLRHQPERIGLTPDEGGWVEIDALVAAAAAHGFPFTRQELDHVVATNDKRRFAVEGTRIRASQGHSIAVDLRLPVATPPPYLYHGTVARHLEAIRAEGLRPMNRHDVHLSPDRETATRVGARRGRPVVLPVDAATMHRDGHVFHVSANGVWLTQHVPSRYLRFPAPH

SEQ ID NO: 45587 - protein, 337 aa, Shewanella sp. ANA-3
MTILVTGGAGYIGTHTVVELLNAGSEVIVLDNLSNSSIEALNRVERITGKAVTFYQGDILNKALLQKVFSDHNIDAVIHFAGLKAVGESVAKPLKYYENNVTGTLILCQVMAEFKVKNLVFSSSATVYGDPASLPITEDFPTGATNPYGQSKLMVEHILADLHHSDPSWNIARLRYFNPVGAHASGLIGEDPNDIPNNLMPFIAQVAVGKREALSVFGNDYPTHDGTGVRDYIHVVDLALGHLKAIEKLTTKPGLVTYNLGTGQGYSVLDMVKAFEKACGKSIAYQIAPRRPGDIAACYANPDHAKTDLGWQATHSLEDMANSSWHWQSTNPNGYKG

SEQ ID NO: 45588 - protein, 146 aa, Glycine max
MAAGSSSNWVMESGDVPHVLAVDDNLIDRKLVEKLLRNSSCKVTTAENGPRALELLGLTSGGQNTMNGRSKVNMVITDYCMPGMTGYELLKKIKESSVTKEVPVVIMSSENIPTRINKCLEEGAQMFILKPLKQSDVKKLTCQLMN

SEQ ID NO: 45589 - protein, 397 aa, Salinibacter ruber DSM 13855
MDRAASPSLAARADDLQQSDIRSVTRRVEEVDGINLGQGVCDLPTPEPIKARAHQAIRDDASIYSHYAGIEPLRRAILEKEQAHNEVPATSPEDVVVGVGSTGVFVSAAFTLLEDGDEVVLFEPFYGYHRNILELTGATIRYVPLGGPDATFDRSAMEAVLTDDTKAVVVNTPANPSGKVWTREELSTLAGLLHAHDLVAITDEIYEYMLYDGAEHVSLASLPGAYERTITLSGFSKAYNVTGWRLGYGVAPAPIAEKIGLMNDLLYICAPRPLQHAALAAFEDLDDDYVAQLQADYAERRELLCETLEAIGFDVPWPDGAYYVLAHFGDLAGTQAGFADDAAACDTLIEDAHIGSVTGRSFYHDPADGQHELRLCFAKELPVLRRACEQLRAAFGG

SEQ ID NO: 45590 - protein, 305 aa, Oryza sativa
  misc_feature (272)..(272): Xaa can be any naturally occurring amino acid
MEDGLRRQEPEALALLFFLSSDETTMNQWRDPRRRRMERHRDKGGAGPLLSQGGRCKDAAREEQGAGPLPLKGREAHGRCHRRRDYVMPLPLEGREAHGYRRRREVGREHAKLMPSEKEEGGKMGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLXRQRHWYIQSTCATTGEGLYEGLDWLSSNIASKA

SEQ ID NO: 45591 - protein, 525 aa, Thermus thermophilus HB8
MPWTMADNARLILDELLAELEERRRRVLQGGGEERVKKQHQQGKLTARERIDLLLDPGSFVELMPFAEHLETGLMEGIEAPADGVVTGYGTIGGRLVFVFSQDFTVLGGSLGKMHGRKIASLMDLAAKVGAPIVGLNDSAGARIQEGVDSLSGYGEVFYRNAIYSGVVPQISAILGPCAGGAVYSPAMTDFILMSRGTSYMFITGPEVIKSVTKEEVTFEELGGADVHMEKSGVAHLEGKDDKEVLDLVKKLLSYLPQNSREKPPVLEPQDDPFRPTPELLEIVHPDARRPYNMHQVIRTLLDDGEFLEIQPRYARNIIVGLGRLGGYPVGVIANNPRFMAGALDINASDKAARFIRTMDAFNIPLLTLVDVTGFLPGVAQEHGGIIRHGAKMLFAYAEATVPKITLIARKAYGGAYLAMNSKDMGADVVLAWPTAAVAVMGAEGAANIIYRKEIQSSQNPEETRRRKIEEYRRAFDNPWVAAARGYIDDVIDPTHTRRVLYQHLRMLWEKQEERPRKKHDNIPL

SEQ ID NO: 45592 - protein, 510 aa, uncultured sulfate-reducing bacterium
MTSDGETELKTHSQGSLPKAPEEVYLATVTRRINWRRIAFILLGLFLFVTVAVSPPWPDAVDPSGESFALDREGKLALGLFLLAAVWWVFEVVPIGITSIAIGVVQALFLIRPARVAFTDFMDPSVWFIIGSIVIGMVFTKTGLTKRMAYKMLVLVGERTSMIYLGVFVLTALLAHIMAHTAVAATIYPLLMAIYTLYEEDNRQTKFGAGLFMGMAYTAGAGSIITLLGAARGAVALGFYKDVVGREISFFELTYYMFPIGWLMVFVLWGFFMIFCKPEQKRIVGLRERASNLYAKLGPMSKQEIIALTIVLATVVLMSLRSFIPALAGVNKSAIILASTVVFFLFRILEIEDLEDIPWNIILLFGGAMSIGFCLWQTGAAKWLAVQWLVLFEDAPWFVFVMGITFFVLLMTNFIMNVAAIAISLPVALVLAGYLGVAPEVVLFASLVAAGMPFLLLVGAAPNAIAYGSGQFTSGQFFLYGIPASIILMIVIGIFVRFVWPLMDMPILLD

SEQ ID NO: 45593 - protein, 833 aa, Escherichia coli K12
MALIVEFICELPNGVHARPASHVETLCNTFSSQIEWHNLRTDRKGNAKSALALIGTDTLAGDNCQLLISGADEQEAHQRLSQWLRDEFPHCDAPLAEVKSDELEPLPVSLTNLNPQIIRARTVCSGSAGGILTPISSLDLNALGNLPAAKGVDAEQSALENGLTLVLKNIEFRLLDSDGATSAILEAHRSLAGDTSLREHLLAGVSAGLSCAEAIVASANHFCEEFSRSSSSYLQERALDVRDVCFQLLQQIYGEQRFPAPGKLTQPAICMADELTPSQFLELDKNHLKGLLLKSGGTTSHTVILARSFNIPTLVGVDIDALTPWQQQTIYIDGNAGAIVVEPGEAVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRKLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPVRWGDDEAQFIIMLTLNKHAAGDQHMRIFSRLARRIMHEEFRNALVNAASADAIASLLQHELEL

SEQ ID NO: 45594 - protein, 103 aa, Brassica napus
MDYRPSDSSGTDDDLPPSHQSRYQRSGRPAGNGRPSVLNSAPLSRMHNDMETQIHLIEQEAYSSILRAFKAQSDAITWEKESLITELRKELRVSDEEHRELLS

SEQ ID NO: 45595 - protein, 212 aa, Legionella pneumophila subsp. pneumophila str. Philadelphia 1
MFIVLIKTIDFIYLAVSPKFNNENGVNLMRRKLMITVGNKFPEFQLKATVANDVSNAFQMISNETYRGKWLVVFFWPKDFTFVCPTEIAEFGRLNSEFADRDAQILGGSTDSEFVHLAWRNQHPDLNNLPFPMLADVKRELTANLGILDDEEGVAQRATFIVDPQGITRFVMVTDLNVGRNPAEVLRVLDALQTDELCPCNWKKGEETIHIK

SEQ ID NO: 45596 - protein, 441 aa, Schizosaccharomyces pombe 972h-
MFQRRSLLSVRSSGSQIAFRRFVSLTHKDPTPDTTSCNIIKKEGANIISVYARYPVVAAKGEGSYLFDKEGRKYIDFTSGVAVTSLGHAHPEVARLAADQCSKLVHSSNLFYNEPAIELSNVINNSLAKNSGIAGPTKIFFANCGTEANETALKFARKAAFEKYGEGKSQIVYFNNSFHGRSLGSLSITANPKYKRGFQPLLPDVVQAVYNDPASIEQFVNDKTAAVIVEPVQGEGGICPAKPEFLIALRKACDKVGASLIYDEIQCGLGRSGDLWAHSIVKDVASPDIITVAKPLANGLPIGATIVSSKIAAEIHPGEHGSTFGGNPVACRVGTFCVNELGSSKILQNVRKQHKALTSRFDDFVAKYPNLIRGYAGRGLLLGLQFTEPPAKFIELARQQGLLLLPGGNNNTRVLPSLNVKDEVIAKGLDIMESTLKALSK

SEQ ID NO: 45597 - protein, 251 aa, Anabaena variabilis ATCC 29413
MMLKDKVALVTGGTSGIGRATAIAYAKQQAKVVVVGRRIDEGEETVRLIQEAGGEAFFVQSDVTKEADVKAMVDKAVGVFGRLDIAFNNAGMVGENPSLIEQTEAEYDRIMNVNVKGVWLSMKYEIAQMLKQGSGAIVNTSSGAGVVALPGVPLYTASKHAVVGLTKAAALQYAKAGIRINAVAPGSIETDMFEAATGGQDEVKAYITGLHPIGRIGTPLEVANAVLFLSSDIASFITGEMLMVDGGFVAQ

SEQ ID NO: 45598 - protein, 103 aa, Nostoc sp. PCC 7120
MSIYVGNLSYDVTEESLNAVFAEYGSVKRVQLPVDRETGRVRGFGFVEMGSDAEETAAIEALDGAEWMGRDLKVNKAKPREDRGGSRGSFGGNRSNNNFRNRY

SEQ ID NO: 45599 - protein, 320 aa, Aspergillus oryzae
MENYQKIEKIGEGTYGVVYKARELTHPNRIVALKKIRLEAEDEGVPSTAIREISLLKEMSDPNIVRLLNIVHADGHKLYLVFEFLDLDLKKYMEALPVSEGGRGKALPDGSGLSKSMGLGEAMVKKFMAQLIEGIRYCHSHRILHRDLKPQNLLIDRDGNLKLADFGLARAFGVPLRTYTHEVVTLWYRSPEILLGGRQYSTGVDMWSCGAIFAEMCTRKPLFPGDSEIDEIFKIFRLLGTPDEVAWPGVTSFPDYKPTFPKWKREETRALVPGLEENGLDLLDALLEYDPARRISAKQACMHPYFQYGSSHYSGRTRRH

SEQ ID NO: 45600 - protein, 264 aa, Nostoc sp. PCC 7120
MSSTLYRRQLLKLLGMSVLGTSFSSCVTSPARAKTVNWGYIGKVGPEHWGELSPDFALCQIGRKQTPIDLQIADVKDVHSSSQDLLVTNYQPTALHLINNGKTVQVNYQPGSYLKYAHQKFELLQFHFHHFSEHRVDGKLYDMELHLVHRSKSGDLAVMGIFLQAGAFNPTLQIIWDATPQNQGTDKRIEDINIDASQFLPAQHRFFTYSGSLTTPPCSENVLWCVMATPIEASPAQIAKFSQMFPQNARPVQPLNDRLVIEAI

SEQ ID NO: 45601 - protein, 471 aa, Chlamydomonas reinhardtii
MSAGMAYGALPKFPNFKVHKLLGKGSYGKVYKVERESDKQLYALKEADLGSMSQAERADAVNEVRLLVSITHHNVIRYNEAFLLGNKLCTVMEYAPFGDLRYYISKGAKLRTPFPEEAVWRIFLQLCKGLQALHSQNIIHRDIKPANIFLCANDLLKIGDLGIAKALTSMNFARTQIGTPCYMAPEVWSGRPYSYSSDMWSLGAVLYEMMTFRTPMEGRTMADLRNRIMGGRYTPIPAGRYSAELTNICHSLLATDPAKRPSPTSILGSSAAAKWMHILPAAGPPVARRWTSDGAPPKSGGASLMDTIVVPRDLKQLHKRLPPPSYDSDIVRPSVPPPSSSGAGGPPGVQRSSSWSQGAGIQVPAAPSSGGAQGIAPKLPSLPGSKAPSRENSRAPSPDVRALQDNRKGPSGSGAPLPPLFPRVPSGGLNPAAAAAAAAVAAYGQRWTPNAPPLAFAVPRVQVPSRRVSYS

SEQ ID NO: 45602 - protein, 459 aa, Mycobacterium avium subsp. paratuberculosis K-10
METYDLAIIGTGSGNSLLDARFAGKRTAICEHGTFGGTCLNVGCIPTKMFVYAADVATTIREAARYGVDTHLDGVRWPDIVSRVFGRIDPIALSGEEYRRSSVNIDLYRSHTRFGPVQFDGRYLLRTDAGEQFTAEQVVIAAGSRPVIPPAILESGVTYHTSDTIMRIPALPEHLVIVGSGFVAAEFAHIFSALGVHVTVVIRSGRMLRQYDDMICERFTRLAAAKWELRTQRNVVGGSNRGSGVTLRLDDGSTLDADVLLVATGRISNADLLDAGQAGVDVENGRVVVDEYQRTSARGVFALGDVSSPYQLKHVANHEARVVRHNLLCDWDDTESMAVTDHRYVPSAVFTDPQLATVGLTENQAIARGFDISVAIQNYGDVAYGWAMEDTTGVVKLIAERTSGRLLGAHIMGPQASSIIQPLIQAMSFGLTAAQMARGQYWIHPALPEVVENALLGLY

SEQ ID NO: 45603 - protein, 334 aa, Nostoc sp. PCC 7120
MSDQANQGDLEIRPSPLLKVINDLHSKYKSLKEGIVANYIPELAKVNPDLFSISIVTVDGQVYQVGDYQQLFTIQSISKVFAYGLALEDHGRDYVLTRVGVEPTGEAFNAIILDEQSKRPYNPMVNAGAIATTSLIKGAGATERLNRVLEMFRRYIGHDVFVDISVFTSERSTGHRNRAMAHLMLNFGMIDRNIEEALDLYFQQCAVMVNCHDLAVMAATLANRGVNPITGEQAVNSRYIKDILSVMYTCGMYNFAGEWAYKVGIPAKSGVCGGIMAVVPNLMGIAVFSPPLDIRGNSVRGVKVCEELSQQLGLHLFECMKVGNGEWGVGNCEC

SEQ ID NO: 45604 - protein, 400 aa, Sulfolobus tokodaii str. 7
MITIGLIGKTNVGKSTFFSAATLIDVPIANRPFVTIEPNVGIAYVKKKCVHVEFGVKCNPKNSICIGDYRFIPVKLVDVAGLIPGAHEGRGLGNKFLDDLRKADVLIHVIDASGSTNEEGIPVAPGSRDPEEDISFIEKEIEEWFYSIISKDWQKFARTVDLSNKDPIDELLSKLSGLSINKYHIIETLRETKLENLKLMQWSEEDLRNFARKLREISKPIVIAANKADIPESRKFIEKLKRKYNYVIPTSAEAELALRKASKAGIIEYIPGEKDFKILKELNPKQKEALDYIKKNVLEIYGSTGVQEALNTAVFGALSMIVVYPVEDEKKLTDHNGNILPDAILIKKGSSPKDLASVIHSELAKGFLFAINVKKKVRVGEEYQLQDGDVIKIVSSTARP

SEQ ID NO: 45605 - protein, 327 aa, Saccharomyces cerevisiae
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 45606 - protein, 258 aa, Mycobacterium avium subsp. paratuberculosis K-10
MMDLTQRLAGRVAVITGAGGGIGLAAARRMHAEGATIVVADIDADAGAAAADELSGLFVPTDVADEDAVNALFDTAARRYGRIDIAFNNAGISPPDDDVIENTEPPAWQRVQDVNLKSVYLCCRAALRHMVSARRGSIINTASFVAVMGSATSQISYTAAKGGVLALSRELGVQFARQGIRVNALCPGPVNTPLLQELFAKDPQRAARRLVHVPVGRFAEPGEIAAAAAFLASDDASFITASTFLVDGGISAAYVTPL

SEQ ID NO: 45607 - protein, 366 aa, Oryza sativa Indica Group
MAFFPPTPPSYALVDDPAAGVTTMTGQPHRENVEVLRLRTRRGNTVAAVYVRHPDAATTLLYSHGNAADLGHLYQLFLHLSFNLRVNVLGYDYSGYGQSSGKPSEHNTYADIEAAYKCLIENFGAKEEEIILYGQSVGSGPTVDLASRLHRLRAVVLHSPILSGLRVMYPVKRTYWFDIYKNIDKIPQVTCPVLIIHGTADEVVDWSHGKQLWELCKEKYEPLWLKGGKHCDLELFPEYLRHLKKFVNTVEKSPSPRNAWRESLDRIEPSRKSVDCFEPSRRSVDFFEPSRKSTDRREKSRPTRDRMRGVEHRYSNVEKTDKLKFSFDHMEKSRRSIDIFERPKKNIEQLDCGRKSVDRLDRIWAS

SEQ ID NO: 45608 - protein, 476 aa, Pseudomonas fluorescens Pf-5
MKPALFIDGHWVDGDGAPMPVHDPSLGQIMAQVPAASAHQVNLAVQAARRALPGWRSLSGARRAEYLQGFARHLQQRREGLIALQMRNNGKPRHEAELDLDDAIATFDYYAGLAAQLDARQDQPVPLQAPGFSAHCRFEALGVVGLIVPWNFPLVTSAWKLAPALAAGCTLVLKPSEVTPLIEQVYGEIADALGLPAGVLNLVAGAGETGAALSQHPGLDKLSFTGSTATGQRVMASSAAFCRPLTLELGGKSPILVFADADLDQAVHWIIGGFCWNAGQMCSATSRLLVHESIADALLQRLRSALLALRVGNPLEQEVDMGPLSCQAQWRTVCTYLEQARNEGLECLVGGHALPGPGWFVAPTVYTDVPTSSRLWQEEIFGPVLCMRRFSDEAQALALANDSAFGLVATVISADLQRAERVAAALDVGHVWINSLQAVFVETSWGGTKGSGIGRELGPWGLAAYQSIKHLTRCLG

SEQ ID NO: 45609 - protein, 455 aa, Mycobacterium avium subsp. paratuberculosis K-10
MSTARLINPATEEVLRSVEHADAAAVDDAVDRARAAQRRWARLAPADRAAGLRAFAAAVDAHRDELAALEVANSGHPIASAEWEAGQVRDVLTFYAGSPERLSGKQIPVAGGLDVTFHEPLGVVGVITPWNFPMPIASWGIAPALAAGNAVLVKPAEPTPVTTIRLAELAVQAGLDRDLLQVLPGPGTVVGERFVTHPDVRKIVFTGSTEVGKKVLAGAAAQVKRVTLELGGKSANIVFADCDLQRAAATAPAGVFDNAGQDCCARSRILVQRTVFDRFMELLEPAVTGIVVGDPASRDTQMGPLVSAAHRAKVASYVPDGAPVAFRGTAPTGPGFWFPPTVLTPSRTDRCVTEEIFGPVVTVLAFDDEQDAVALANDTSYGLSGSIWTNDLSRALRVSRAVEAGNLSVNSHSSVRYHTPFGGFKQSGLGRELGPDAPAQFTETKNVFIAIDEEP

SEQ ID NO: 45610 - protein, 327 aa, Chlamydomonas reinhardtii
MAAASTTNPDPLASEGTFHKIKDLGSGSFGHVALYSRLGHDEPVAVKCLPVRVVDYNMVKREVRSHCSLNHPHVILFKRLGLTPDKRYLFMVMEYADCGDLFKYVQQHGRLPEADARWFFQQIILGLDYCHRRGVVNRDLKLENLLLRSAAEVPPPPGQLEQPRNLHIKVADFGLCKASVNSLPKSRVLRASADRPYDAKLSDIWSVGVILYVLLFKAYPFGVISDRDNKAQRDAILRRIANAEWQLPAHPVIGEACRDLLSRILVSDPAKRITMEGIMSHSWFREDLPEGALEFNEGLHNRVRLAMTHQPSTLRSTGGTRFTLTLP

SEQ ID NO: 45611 - protein, 461 aa, Mycobacterium avium subsp. paratuberculosis K-10
MTGSDTAMLSLAALDRLVAAGAPETRVDTVIVAFPDMQGRLVGKRMDARLFVDEAAATGVECCGYLLAVDVDMNTVGGYAISGWDTGYGDLVMRPDLSTLRRIPWLPGTALVIADVVGADGSPVAVSPRAVLRRQLDRLAGRGLFADAATELEFMVFDEPYRQAWASGYRGLTPASDYNIDYAISASSRMEPLLRDIRRGMAGAGLRFESVKGECNRGQQEIGFRYDEALRTCDNHVIYKNGAKEIADQHGKSLTFMAKYDEREGNSCRVHLSLRDAQGGAAFADPSRPHGMSTMFCSFLAGLLATMADFTLFYAPNINSYKRFADESFAPTALAWGLDNRTCALRVVGHGAHTRVECRVPGGDVNPYLAVAAIVAGGLYGIEQGLALPEPCAGNAYRARGVGRLPGTLAEAAALFEHSALARQVFGDDVVAHYLNNARVELAAFHAAATDWERMRGFERL

SEQ ID NO: 45612 - protein, 310 aa, Streptomyces coelicolor A3(2)
MPASYAYLGPEGTFTEVALRTLPETATRELVPYVSVQSALDAVRTGEAEAAFVPIENSVEGGITTTLDELVAGQPLMIYREVLLSITFALLVRPGTKLSDIKTVTAHPAAQPQVRNWIKAHLPDVAWESAASNADGARLVQEGRYDAAFAGEFAAERYGLEVLEADIHDAENAQTRFVLVGRPARPAAPTGADKTSVVLWQRDDHPGGLRDLLGEFATRGINLMLLQSRPTGAGIGNYCFCIDAEGHISDRRVADALMGLKRTCLQVRYLGSYPRAEVTPADVDALRPGTSDEAFVAAADWVARCQDGRF

SEQ ID NO: 45613 - protein, 501 aa, Oryza sativa Indica Group
MVSAAAAASSLRCFPPSLGNRGPGAATARGGLVRLSSRRARSTAGVAAPSREAESAASLGDLTRVDFPILDQEFDGSKLVYFDNGATSQKPSCVMKTLDEYYRFYNSNVHRGIHVLSAKATDAYESARTKVANFVNAANSREIVFTRNATEAINLVAYSWGMSNLKQGDEIVLTIAEHHSAIVPWQFVSQKTGATLKYVGLTKEGVPDIEQLKGLLSNKTKIVVVHHVSNVLVSKFLDRCDRGTWYASCERFLQGGDENVPCSWNMEDVPGLRNASFDPVFCDFGSMLPIEDIVTWSNRIGAKVLVDACQSVPHMPVDVQRLGADFLVASSHKMCGPTGVGFLHGKFDLLSSMEPFLGGGEMIADVFQDKSTYAEPPSRFEAGTPAIGEAIGLGTAIDYLSQIGMQKIHEYENELATYLYESLIAVPNVRIYGPAPCQTVHRAPLCSFNVENVHPTDIAEILDLQRELGHQMAAKTADHGAVISKWPFSAPCTYLCSSKLD

SEQ ID NO: 45614 - protein, 472 aa, Zea mays
MPKPPPPTSDPSLPTTTTTSTPKSSSRPAPAGLLDPLAASGRSLLASARRSPVTTLAGAFFLLALVMYGEDARTIAELSIDDYLYPDADLYNVSGLPPLALPPPTCDLSSGRWVFDNASVPAYREKDCTFLTKQVTCLANGRPDDMWQYWRWQPSDCSLPTFDARRFMEAMRGKRLMFVGDSLNRNQWESLVCLVQPILSKGRKKIVKRGSLNTFYAKEYRATLEFYWAPFLVESNSDNPNFHSIKERIISPERIEAHARNWKDVDYLIFNTYIWWMNTADIKVRRPNSRYWSENDEVPRIEAYGRVFKTWSDWLNNNIDPARTSVFFMTISPIHISPQNWGNPGGIRCVKETLPYQNYSQPLDLYHDMRLYDLVIKVASSMEKVPVSVINITKMSDYRKDAHASVYTIRQGKLLTPKQKADPEKFADCIHWCLPGVPDVWNQILYTRILSKSPWRSNFSPPPSQSTPLPPQ

SEQ ID NO: 45615 - protein, 329 aa, Glycine max
MATNIGIMDAAYFVGRSEILSWINSTLQLNLSKVEEACSGAVHCQLLDAAHPGIVPMHKVNFDAKSEYEMIQNYKVLQDVFNKLKITKHIEVSKLVKGRPLDNLEFMQWMKRYCDSVDSGLQYNYNPLERREVCKGGRETSKKSANSQASTKGSTAQRPHSSHNARRNEVSNANPTNQAAKVARAAPSAGNPAPVYEEKITELKLSIDSLEKERDFYFAKLRDIEILCQTPEIEHSPIVAAIQKILYATDDNGMAVVEAQAMISVGRKEIEGLSPIAEVSEEKSSSETHKRKNIANIDFDVAGLATLSPRQRLSDVSDVHCSESPLMTC

SEQ ID NO: 45616 - protein, 457 aa, Thermus thermophilus HB8
MTYDLLIVGSGSAGVAAALEASALGAKAAVVEAGVLGGTCVNVGCVPSKYLLRAADAFHRAGHPAFPGLRTEALGVDWKALLAGKEGLIAALRKEKYQEVLEAAGVPVLRGRARFLDGERMEVEGREVLAGRYLLATGARPFLPPIPGLQESAPWTYLEALSAPALPESLLVVGGGPIGLELAQAFARLGSRVTVLEALPEVLPQEDRELARLLRGYLEEEGLRVHTGVRVEAVAREGAFRVRTDRGVFEAERLLVATGRRPDLEGLGLERAGVERDERGFLRLDPSLRTTNPRVYAAGDAAGLPQFVYVAAQSGRVAARNALGVKAPLDLAALPRVTFTDPALAAVGLTEEEARRRYGAGVRAATLPLSQVPKALTARDTRGAFKIVVDEEGTVLGLHVLAHEAGDVIQEGILAVKYGFGYRDLIDTFHPYLTLAEGIRLVAQALDADPKKLSCCA

SEQ ID NO: 45617 - protein, 443 aa, Synechococcus sp. CC9311
MLTPLPKHHFPGEGREGNSTVQLLREELLLDGNSKQNLATFCQTYQAQSAMELMTLGVDKNLIDKDEYPQTAELEGRCVSMMADLWNAPGAAVGCSTIGSSEAAMLGGMAAKWRWRKRREAAGLPTDKPNMVCGSVQICWKKFARYWDIEMRELEMLTGELCVSPERVLEAVDENTIFVVPTLGVTYHGLYEDIESISKALDDLQARTGLDVPIHVDAASGGFLAPFCAPDLPLWDFRLERVKSINASGHKFGLAPLGVGWVLWRSQEDLPDELVFHVTYLGGDMPTFQINFSRPAGQVIAQYHEFVRLGREGYRMLHMASHANAQYFAEKLREMDLFRIIHDGTPDKGIPTVVWTLDDNPKYGFNLYDFADRLRMRGWQVPAYPFTGELESTAFQRILVKRDFTRDMADLLLEDIRQAIQHFQKHPITSNLAATEGASYNHL

SEQ ID NO: 45618 - protein, 648 aa, Shewanella sp. ANA-3
MEHGFLIQVLLMLLIAIVAIALLRRIGLPAILAYLLTGVVSGPSGFHWFTQQQMQSVAELGVVLLMFTLGLEFSVPRLWAMRRTVFGLGSAQVIVTTVLTMLVALACGLNGIESLVIGAAIALSSTAIVLKLLNEQGWLRRRHGELSVSVLLFQDLAVVPLLILLPLLGQNDEPLMLATITLALLKGILAFFLLMALGKWALPRLFDEVARSRSNELFVLSTLVVALVTGAFTQWLGLSMALGAFMAGMLLGESQYRRQLEADIRPFRDLLMGLFFISIGMMLDFALVMQFWWQILLILLAVVVGKALIVHGLLRLVGEPFRIAISTALSLAQVGEFSFVVLALAVSYGLLSNQLSTMLVMVAVLSMSIAPWLVRHSVDIAKWLLGIRQSGHVDEVVPIITEDHDLVVILGYGRVGQTIARFLKTEAVPYLVLDLDPTRVSEARRAGEPIYFGDVCKRAILKQVGIKHAKMIVITFCETRSLEEALPLCKQLAPDAKILVRTRDDSELDMLQKAGANQVIPETLEGSLMLVSQVLHQCGVPLARILKRLESERRNHYQFLHGFFSGTETDFTLESLHAVLLHRGADAVGKQVADIDWELLRVELRAIRRSGAEVEHPAQDWVFRAGDILLIVGKPRRLEKAEAKLLHG

SEQ ID NO: 45619 - protein, 244 aa, Oceanobacillus iheyensis HTE831
MGRLENKVAIITGGARGMGASHVRLFAKEGAKVVFTDLNEEGGLALANELGENVKFVKQDVTNADDWETVISETEEAFGPVNVLVNNAGISLSIPLMEMTEEQYRKIIDINQVSVFLGMKAVVPSMQKAGSGSIVNISSMNGIVAGAVGYTDSKFAVRGATKAAAVQLGGLGIRVNSVHPGVIETPMVTKGDAVEQIKEFAKQIPSKRMAQPEEVSNMVLFLASDEASYSTGSEFVIDGGLTAM

SEQ ID NO: 45620 - protein, 383 aa, uncultured archaeon GZfos35B7
MTVIADRVSQIEGSGIRKFFDIAQRMEGVISLGVGEPDFVTPWTIREACIFSLEKGYTSYTSNWGLLELREAISDKIYEESGVFYDPEGGILITTGVSEAFDLALRAIINPGDEVILHEPCYVSYKPCTVFAGGTPVCVATGVEDKFELRAEEVAEKITDKTKAIILSYPNNPTGAALSKKDLEEIADVATEHDLIVISDEIYDKLTYEGEHTCFSSLNGMEERTILLNGFSKAYAMTGWRIGYAAGNKAIIEAMMKIHQYIMLCAPITAQMAAIEALRCDDETDRMVSEYNRRRRLMVAGLRELGLSCFEPKGAFYTFPSIEDTGLTSEEFAERLLKEEKVVVIPGSVFGDCGEGYIRCSYAVSQYELKEALERMGRFLDTL

SEQ ID NO: 45621 - protein, 330 aa, Synechococcus sp. CC9311
MADLSALAPRVMCLGEALVDRLGPLGGDPVTAAPESCDDRLGGAPANVACALARLGTPVGLVGRLGEDSIGSAFRDLFQQRGVAVQALQRDVSHPSRVVLVRRHANGERVFQGFAGDHALGFADQMLNLGELEAVWPMVSKQARWLLVGTIPLATPTSADSLQWLLAQAQAASLALAVDVNWRPTFWDPEADPAAGPTADALAVIKPLLEQASLIKLAREEALWFFGSDDPAAVAKDLPQQPDVVVTDGANPIRWFIEHEAGSMPVFQPSQVIDTTGAGDAFTAGLLHCWDRPVNERLYFASACGALVCSGAGAIDPQPQEQDVLTFLNR

SEQ ID NO: 45622 - protein, 151 aa, Triticum aestivum
  misc_feature (23)..(23): Xaa can be any naturally occurring amino acid
  misc_feature (28)..(28): Xaa can be any naturally occurring amino acid
  misc_feature (43)..(43): Xaa can be any naturally occurring amino acid
SKLDIQSYQLQVFLLPNSARGKXPGLLXVADEIAEAEQAEFFXFLGTNDLTQMTFGYSRDDVGKFIPIYLAQGILQHDPFEVLDQRGVGELVKFATERGRQTRPNLKVGICGEHGGEPSSVAFFAKVGLDYVSCSPFRDPIARLAAAQVLV

SEQ ID NO: 45623 - protein, 149 aa, Glycine max
GILQVVARFNEIVTKPLLEGALGTFNNYSVQDEDIDVVWVPGSFEIGVVAERLGKSGKYDAIVCIGAVVRGDTTHYDAVANSAASGVLSASLNSGGILLMLIVISRYKQIMLEYSAAVCFLENKICMQHCYDNLFIESRIKPLEMLELF

SEQ ID NO: 45624 - protein, 206 aa, Zea mays
  misc_feature (138)..(138): Xaa can be any naturally occurring amino acid
MSVQEYLGKHLLSRKSEEALNTAVRAKAPNPALFIVGHMRREAPTVITRVRARQILDGRSAPAVEVELHTNKAVHRASTASVGALEGAAADAAGASERRKFLARGVAYAVRVINDKVSEALVGMDPQQQTQIDQAIMXLDRARHKAEFGANTMLGVSIAACKAGAAEKEVPLYKHIADLVGKSATTLRVPAITVINGGRAHEDTRI

SEQ ID NO: 45625 - protein, 143 aa, Zea mays
  misc_feature (11)..(11): Xaa can be any naturally occurring amino acid
ADNVMFEGILXKPSMVTPGAEHKNKASPETVAEYTLTMLKRRVPPAVPGIMFLSGGQSEAEATLNLNAMNQSPNPWHVSFSYARALQNSVLRTWQGKPEKIEDSQKALLVRAKANSLAQLGKYSAEGENEDAKKGMFVKGYTY

SEQ ID NO: 45626 - protein, 408 aa, Chlamydomonas reinhardtii
MASAPSAPPNNPLSGQSGYQFVKALGTGAFGSVLLYRRQLTEGGPIEEVAVKVISREECSDFNLVSREVHSHRILVHPHVIRFKRLGLTPDKRFLYMVMEYADRGDLLDYLRRRGRFREHEARWFFQQLVFGLDYCHQRGVVNRDLKPENLLLKRTPDARQELTQGDLEHPFNLHLKIADFGLSKEGMHSQPKSRVGTVTYMAPEVLRAGPSRRYDGNKADIWSAGIVLYVMLFARAPFDDPLATTDKARRDATMQQILRGEWNVPASVPVAPECLDLLRGILSPDPNTRFTLAQIMSHPWFSVGLPPAALTMNTVLVRQQTAQPPPYEQSVEDVNTVLEEATQRPGHGQGGGLGGSEITDSGFMTMIADEMEEENRRHNAPYMVDPYPGQGQPGAGRPGQPAAPQQR

SEQ ID NO: 45627 - protein, 285 aa, Mycobacterium avium subsp. paratuberculosis K-10
MPARTALSPGALSPTLPVPARIPRPEYVGKPTAREGSEPWVQTPEVIEKMRVAGRIAAGALVEAGKAVAPGVTTDELDRIAHEYMIDHGAYPSTLGYKGYPKSCCTSLNEVICHGIPDSTVIEDGDIVNIDVTAYIDGVHGDTNATFLAGDVAEERRLLVERTREATMRAINAVKPGRALSVIGRVIESYANRFGYNVVRDFTGHGIGTTFHNGLVVLHYDQPSVSTIMQPGMTFTIEPMINLGGLDYEIWDDGWTVVTKDRKWTAQFEHTLLVTDTGVEILTLP

SEQ ID NO: 45628 - protein, 426 aa, Picrophilus torridus DSM 9790
MDYDVIILGAGAGGYKAAVHLLKNKKRVLMIEKEKFGGECLNYGCIPSKALIEMSESIYYLKNMPGISMEYKIDMKAWQDWKNSMVARITGNAERQCKSLGADILYGFGTLKDKNTVNVNGKDYTAENIIIDTGSSPARIPGIDNVYYNREILGIDHIPESIAIIGGGYIGVEIGTAMAKLGSDVYIIEAKERILPEVSSELSNAVDKKLRSIGVKIMTSSKVISVSKDKYYTVKTENDEIKSEMVLMSVGRIPNTKNIGLENLKIEMDGRFIKTDEHRRTNVKNIYAIGDVTTGPMLAHKAFYDAYIASENILGNDVIIDYKAMPYVIYTDPEISFTGSVSNNSKKIMTSAVPRALTMNEGDGFFRIYYNDDGTVTGAAIAAPRSSEIITEISLAVESYLNINDLLLTIHPHPTIAEGIHDDFEN

SEQ ID NO: 45629 - protein, 217 aa, Burkholderia xenovorans LB400
MSFLLHQSRFFTTVNHLQDLPATSQPEICFAGRSNAGKSTAINILCNQKRLAFASKTPGRTQHINYFSVGNADEPTAHLVDLPGYGYAEVPGAAKAHWEALLSAYLQSRSQLRGMILMMDSRRPLTDLDRRMIEWFVPTGKPIHTLLTKCDKLTRQESVNALRATQKGLAEYRAAGYRGELTAQLFSALKRIGIDEAHALIESWLIPEAKGETDTPQ

SEQ ID NO: 45630 - protein, 386 aa, Picrophilus torridus DSM 9790
MYTLKVPPIGEGVSEGEIVKWNVKEGDTIEKDQEIVEIMTDKITIKIPSPVSGKVLKLIEPEGKTVKVGDSIATIDSQEGNEEINNENNAQESKEIKIENKNEGSNVKNVELVKATPAVRAYARQKGIDLSNVRPSRPDGRIRKEDIDSYISMKNKTVQENVEIQNDEVYKPSGIRKIIFDKMTKSKQIIPHFTITDFISTENIEKAIDYYSKKGYVSFTSFFAKACTIAFKEFPKMNALYNDDGTYTIKKRYNIGIAVDSPYGLTVVVVKDVDKKSIFEISMEIRELAEKARSNKLEMDDVRDSTFSVTNIGAIGGIYSTPIINYPEVAILAVNTRTNAFIDGSMRSGVYVTLACDHRLIDGAEAARFIKKIKEIIEQPMLYIGD

SEQ ID NO: 45631 - protein, 538 aa, Oryza sativa Indica Group
MTSGPTPPSPPDASAASSGGLHLAGGGMSGFLAVVGKVGTFLLWLLFLVLQTATKIVGSLLAAGPPPADAQEAAAAAAARRRSPPASPHSGGGATDPYQPPQLWDPPPPSSPYSAGHAADEYSSSSSYRRRGASAPPAEDVVVSSSYSRPAAAVASAPQARTVSSAPPLRAVETRSPAPSRAAAAVGGKRPKLERKYSKIVDQYRSLDEVIEALAQAGLESSNLIIGIDFTKSNEWTGKRSFNGMSLHHIGDSPNPYEQAITIIGQTLSAFDEDNLIPCYGFGDVLFPLSNRAASTHDQDVFAFYPDERPCNGFQEALARYREIVPHLRLSGPTSFSPIIEMATTIVEQSGGQYHVLVIIADGQVTRSVDTEFGQLSTQEQMTVDAIVQASEFPLSIILVGVGDGPWDMMKEFDDNIPARSFDNFQFVNFTSIMSKKISQSKKETEFALSALMEIPLQYKATLELGILGRRFAKSPERVPLPPPFASYNTISRAAPSRANSFRSMPSHPRDEAPVDSAITASVTSPPSVDARAAEPQV

SEQ ID NO: 45632 - protein, 583 aa, Aspergillus oryzae
MSRRATPGQAAQNQQTIKGLLKLEHNKICADCKRNKHPRWASWNLGIFVCIRCSGIHRGMGTHISRVKSVDLDSWTDEQLQSVMRWGNARANKYWEAKLAPGHVPSEAKIENFIRTKYESKRWIMDGPMPDPSTLDDGDDDVPLAVVQEKAKIERSASQRVAASSQPPAAHRQQASIDLFADDDIAPPARPSTTDPTPRAAPKQPQSAPKPTRPGDSLLGLDFFGSAQPAANSHPSSTASTPGGSTGISRPDLKQSILSLYSKPQPAPAQHGRTSSFGDFGDLASPAPPSASPSSNLGGLTDAFSGLSFPSTTSPPPQKPAEKSSPFANLTSFATKKSSPAAPKVSSPTASAGSGGGSLFDSLASPTIPAAKPQSRTTSISSNGFDSGFTSFASPPPSKPNPPPSSSLSNDLFGLSSPAPVAPSKVSSPPAPTAISPQNELKAAFNLNPPVPAPVSAAPKPSMSATTASIASALPASIDPWGGGNAWSTPDPAPAAEPSGPSMMKVPDTLTANDIGAGWGATASTSGGSKQAPTVAADEDFGGWTSAAPISSTTAATTTNMSVPSKPAGGFSGADDLFSNVWE

SEQ ID NO: 45633 - protein, 355 aa, Ralstonia metallidurans CH34
MKIAVLPGDGIGPEIVAEAVKVLNALDEKFEMETAPVGGAGYEAEGHPLPDNTLKLAKEADAILFGAVGDWKYDSLDRPLRPEQAILGLRKHLQLFANFRPAICYPELTGASSLKPELVAGLDILIVRELNGDIYFGQPRGVREAPDGLFKGAREGFDTMRYSEPEVRRIAHVAFQAAAKRGKKLCSVDKANVLETFQFWKDIVIDVSKEYPDVELSHMYVDNAAMQLVKAPKSFDVIVTGNMFGDILSDEAAMLTGSIGMLPSASLDANNKGLYEPSHGSAPDIAGKGVANPLATILSAAMMLRYSLNRAEQADRIENAVKKVLAQGYRTADIVTPGCKQVGTREMGEAVLAAL

SEQ ID NO: 45634 - protein, 252 aa, Idiomarina baltica OS145
MSSVLANNISGKVVVITGGSSGLGETTARHLASLGASVVLGARRIDKLEAIAADIRTAGGEVAVQATDVTSQDEVKALVNLAQERFGKVDVVINNAGLMAIAPLAETRVDEWDRMIDINVKGLLYGVAAALPIFQAQGTGHFINISSVAGVKVFSPGGTVYSGTKFAVRAIAEGLRHEVGGEIRSTIISPGAIESELKHGSSDTQGAAFVKDFYQQNEIPSESVARAIAYAIEQPADVDINEIVLRPTVQEF

SEQ ID NO: 45635 - protein, 335 aa, Idiomarina baltica OS145
MSPRKLIRTVRFHELGGPEVLTIDSLASPSLQATDVRIAVKVVGLNRADAMFRRGSYIEKADFPSRIGYEASGIVIEVGEEVNHLRLGDEVCIVPQMGLSQNGCYAEEIVVPSEYVAPKPAGLTFAEGAAAWMQYLTVYGAVVEIANVQKGDAVLITAASSSVGLAAIQIVNSLGGIPIATTQTRAKKAAVLTAGAAHVIATQEEPLLDSLRSILGANNLKVAFDAVGGPQIAEIAEAMSPEGTIIVHGALSPEITPFPLKLALRKSLTVRGYVFTEVIKDIERFRRAKQFIHSGLSEGTLKPVIDRSFKFEEIVAAHHYLESNQQIGKIVVVLD

SEQ ID NO: 45636 - protein, 103 aa, Glycine max
  misc_feature (86)..(86): Xaa can be any naturally occurring amino acid
  misc_feature (89)..(89): Xaa can be any naturally occurring amino acid
  misc_feature (99)..(99): Xaa can be any naturally occurring amino acid
ANFMLMITAELENLTNLQPQDGCDDPNSSYLFKLKCPRCGELSQNDTCAALNDTVPLPVGKSTAPLIQPRQLSWRDGSGTMMERKXKPXTQEITESRKXAPPT

SEQ ID NO: 45637 - protein, 235 aa, Arabidopsis thaliana
MASLPVQFTRNQISSPFFSVNLRREPRSLVTVHCSGENRENGEGVKKSLFPLKELGSIACAALCACTLTIASPVIAANQRLPPLSTEPDRCEKAFVGNTIGQANGVYDKPLDLRFCDYTNDQTNLKGKTLSAALMVGAKFDGADMTEVVMSKAYAVEASFKGVNFTNAVIDRVNFGKSNLKGAVFRNTVLSGSTFEEANLEDVVFEDTIIGYIDLQKICRNESINEEGRLVLGCR

SEQ ID NO: 45638 - protein, 531 aa, Coccidioides immitis RS
MNCPSRTEHDPDRPDWNQNPPVLSPDLTARQDLNGRINATQFRELSSHFSSLGFAAGADEGPEKGLDVPPGSKHRPPFADAKLPRDYYEEFCAASRQMPYRVKTLKSWFHHGLLWWLPAISMAVFSVYYMGVVLSTFRPRQKLATARVVKRAESCQTGSSKPNYSVGLHVAALAIILFVSFGACAFPMLAVRFPRLRIPHSFLFFVRHFGTGVLIATAFVHLLPTAFVSLGNPCLSQFWTVDYPAMPGAIALAAVFLVTTVEMVFSPARHICGDTRGVTQMICHQDSTPTGHQGYGATASPVEALEGGKSSDSDPHLRGDYGVRSPISRQSTAEGPEMVTGTNAVNREGAEKDVPDVHAPIVLTPEQRTRKAFLQCVLLEVGILFHSVFIGMALSVSVGNEFVILLVAISFHQCFEGLALGARISALSWNPDAKQPWLMALAYGCTTPIGQAIGLATHSLYDPDSEVGLIMVGTMNAISSGLLVYASLVELLAEDFLTDESWRILRGKRRILACLLVFLGAFGMSLVGAWA

SEQ ID NO: 45639 - protein, 327 aa, Arabidopsis thaliana
MAPVLQSSQPWVEKYRPKQVKDVAHQEEVCPHMLFYGPPGTGKTTTALAIAHQLFGPELYKSRVLELNASDDRGINVVRTKIKDFAAVAVGSNHRQSGYPCPSFKIIILDEADSMTEDAQNALRRTMETYSKVTRFFFICNYISRIIEPLASRCAKFRFKPLSEEVMSNRILHICNEEGLSLDGEALSTLSSISQGDLRRAITYLQSATRLFGSTITSTDLLNVSGVVPLEVVNKLFTACKSGDFDIANKEVDNIVAEGYPASQIINQLFDIVAEADSDITDMQKAKICKCLAETDKRLVDGADEYLQLLDVASSTICALSEMAQDF

SEQ ID NO: 45640 - protein, 494 aa, Oryza sativa Japonica Group
MSWVAATVALLLTTAVILTALQKRKISSPAAAAPPVVRGAGLVRFARAMARDGPLEAIREQQAKLGSVFTAIAPFGLFKVTFLIGPEVSSHFYLAPESEMGQGSIYRFTVPLFGPEVGYAVDPDTRAEQMRLFWDVLKPRSIEARVGAMAEEVQNYFSRWGEQGTVDLKKELEQVLMLIASRCLLGREVRESMVDEVYELFRDLDNGLHLISTMLPYLPTPAHRRRDRARQRLGEIFTEVIRSRRNSGTADNGDDVLQRLIDGRYKDERDLTDVEVVGLLVALVFAGKHSSSSVSTWTGINLLSHPNHLVAVIAEQDRLMASRARTDDDHDRVNYDTVQEMTTLHRCIKEALRLHPPAVAMFRQARKHFTVQTKEGKEYTIPGGHTVMSTILVNHHMPNVYKDPHVFDPSRFARGRGEDKAAGPFSFLAFGAGRHSCAGESFAYTQIKVIWSHLLRNFELKMVSPFPETSWRMVTPEPKGTVMISYRRRNLTCK

SEQ ID NO: 45641 - protein, 265 aa, Arabidopsis thaliana
MASVASSTTLISSPSSRVFPAKSSLSSPSVSFLRTLSSPSASASLRSGFARRSSLSSTSRRSFAVKAQADDLPLVGNKAPDFKAEAVFDQEFIKVKLSDYNGKKYVILFFYPLDFTFVCPTEITAFSDRHSEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYTGNPDEVCPAGWKSGEKSMKPDPKLSKEYFSAI

SEQ ID NO: 45642 - protein, 562 aa, uncultured sulfate-reducing bacterium
MAKVTKKKKKKLGGLRGSGGGSSSLDSGLRPKLVEALPPCMNGCPNHNAIREMLMTISKAEEFEKPSDQAFEEAFYIFLETTPFPSTCGRVCPHPCESACNRKEKEGAVSINNVERFIGDFGLEKGLKPTKLSGETRSEKIAVVGSGPGGLTAAYQLARRGYPVTVFEAFPHAGGMLRYGIPDYRLPTGVLDAEINRILELGVELRLNTAVGTEVSLDDLRKEYKAIFVALGAHQGIELRIEGEDAPNVFTGTDFLHRVNSGEKVDVGDKVLVIGGGDTAIDAARVSRRLGAEVAIVYRRTRKEMPAIDEEIEGADLEDVKIDYLAAPMEIYTENGKAVGMKCQRMELGEPDSSGRRRPVPVEGDTFDMDFTCLIAAVSQAPDFEGFGELIEGKDWIKIDEKCKTKLDGVYSGGDNVNLGLAIDAIGHGNAAAVAIDELIAGAQDAPAGSPQVGVVLAEKMQLAYYKESQRVARTEMPVEERLKDMAAEIASTYTADEAVTEAQRCMSCGKCFDCSTCWSFCQDNAIVKPLTRGEPYKIKLDFCTGCKKCSEVCPCGYIEMH

SEQ ID NO: 45643 - protein, 373 aa, Corynebacterium efficiens YS-314
MALPEMSLPDMALPDTELRRTARQLALSGWGMEQQERLHRSHVLVIGGGGLGCPAMQSLASAGIGHITVIDDDTVDITNIHRQILFGASDVGRPKVEVVAERLRELQPDITVTALRERLTVDNAVELVGGVDLVLDGSDSFATKYLVADAAEITGTPLVWGTVLRFRGDVCLFADGVGLRDLFPVQPTGDSIPDCATAGVLGATTATIGALMATEAIKFLAGLPTQPGRMLSYDALTTTTRSFTVGADPARDRVTGLQPSYSDAVCAVGPSPEELLDQVRAGAAVLLDIREPHEYLLNDSLADLDPVRLPLSEITGVDTVWHALGEARRDARRDTRRVVVHCASGVRSATFVEQYGDLGYDLVNLPGGINALG

SEQ ID NO: 45644 - protein, 484 aa, Salinibacter ruber DSM 13855
MPDSLSPPPAPASADEIERVFAAQQAHAPAVRAASVDRRRDKLRRLCDGLRAHRTDFQDAIHADFRKAPAEVDLTEMKPLLDEAQFAISHLDDWMAPDRRSHPAFFAGTRSEIHYEPKGVALILAPWNYPLTLTLGPLIGALAAGNCVTLKPSEKTPHTNIVLKKLIGDLYEEREVALLTGAKEVAQGLLEQPYDHVYFTGSPRVGRLVMKDAADHLASVTLELGGKSPAIVDETADLDLAAERIAWSKFTNAGQTCIAPDYVLVDAPVHDALVARLIDTIEHFYGATAAMRRGSDDYARLIDDGHWDRVVGLLEEAVADGATVAFGGQTNAETRYVSPTILTDVPLDTAVMQAEIFGPLLPIIPISSLNQAVGIVNDRPNPLSMYLFSERDAMVDTVLGRTTAGSTCINEGFFHYANPDLPFGGAGHSGIGRGHGEAGFRAFSNERSVLRRRYGASLVQAVLPPFTDRKESFLAALLRYFSGP

SEQ ID NO: 45645 - protein, 304 aa, Oryza sativa
MASQQQLIKLAVCEYISKYGLQKLVEDAVNQCYKKQAQNPTAFFSNYFAQKTNSQAVAKVVGREILDSRGNPTGGGDVYCGEQLAGRASAPSGASTGSNEAKELRDNDKSRYLGKGTLKAVQNVNGPLNDALKGKSVDNLRECDDAMKTKDGTELKEVLGGNAITAASFAIATAGARIAQEELFLYLARQYAPKQEEEEQKFRLPTPLVNILNGGKHAGGKLKIQEFMIVPRSDVTFREQLRIVTEVYHHLGSIVTKTKGKSAKNVGDERGYPPNMSTSDEALGAIEDAIKGTGLKLARNLNSF

SEQ ID NO: 45646 - protein, 315 aa, Bacteroides fragilis YCH46
MGKIAKKLTDLVGNTPLLELSNYNASNGLKARVVAKLEYFNPAGSVKDRISLAMVEDAEAKGTLKSGATIIEPTSGNTGVGLAFVAAAKGYKLILTMPDTMSMERRNLLKALGAELVLTPGANGMKGAIAKAEELRAATPGSVILQQFENPANPAVHVRTTGQEIWRDTDGKVDIFVAGVGTGGTVSGVGAALKEHNPAVRIVAVEPVDSPVLSGGVPGPHKIQGIGAGFIPKTYHAAVVDEIRQVGNDDAIRTSRELAAKEGLLVGISSGAAVYAATELAKLPENEGKLIVVLLPDTGERYLSTILYAFEEYPL

SEQ ID NO: 45647 - protein, 800 aa, Candidatus Kuenenia stuttgartiensis
MNNFLRIFNLIFKVNRVSIIMILLMLTIFIFGAVKSDIFSHNAQAQTAAKISTEMPAFDIGHPLMSTKGTAEDSSRSIPILWWIAPFGAICGLFFAMKFYRGVMKFPEGNEKMISIAMHVRKGAYAYLKQQYKVIGIFIVGAFLVLLFISYGLKLQSTVVPFAFLSSAFLSGFAGFLGMKTATNASARTAEGARKSLNQGLQIAFRSGAVMGLVVVGMGLLDISLWFFVFRKFTNFTLLDMAMMLPCFGIGASSQALFARVGGGIFTKAADVGADLVGKIEAGIPEDDPRNPATIADNVGDNVGDVAGMGADLYESYYNSMLACAALAITAGLGIAGMVVPMILAGVGIILSIIGIYTVKTKEEATQKELLKALGKGVNISSILILITSAIVIKFMLPQNFGVWGSIFTGLIAGIIIGKGTEYYTSSNYSPTKGIAGHAKTGPATVIIDGIATGMKSTIIPVVTISVAILLSFGFAGGFANTSLGLYGIAIAAVSMLSTLGITLATDAYGPIADNAGGNAEMSGLEPYVRERTDALDALGNTTAATGKGFAIGSAALTAMALIASFVEQVKIGLERAGTHVIQVAGINIDIAKATLADLMASMNITLINPKVLVGLFIGGLISFVFCALTMKAVGRAAGSMVEEVRRQFREIPGIMEGKNPPDYAACVSISTKGAQREMILPSVLALLTPIATGLILGVPGIVGLLAGSLTTGFLLAVFMANAGGAWDNAKKYIEGGAFGGKGSDAHKAAVVGDTVGDPFKDTSGPSLNILLKLMSVVSVVFAGITLKYSEQISAFLHLN

SEQ ID NO: 45648 - protein, 367 aa, Bacteroides fragilis YCH46
MALQCGIVGLPNVGKSTLFNCLSNAKAQAANFPFCTIEPNVGVITVPDERLNKLAELVHPNRIVPTTVEIVDIAGLVKGASKGEGLGNKFLANIRETDAIIHVLRCFDDDNVTHVDGSVNPVRDKEIIDYELQLKDLETIESRIQKVQKQAQTGGDKAAKQAYDVLVQFKDALEQGKSARTVTFETKDEQKIAKELFLLTSKPVMYVCNVDEASAVNGNKYVDMVREAVKDEDAEILVVAGKTEADIAELETYEDRQMFLAEIGLEESGVARLIKSAYKLLNLETYFTAGIQEVRAWTYEKGWKAPQCAGVIHTDFEKGFIRAEVIKYEDFLQYGSEAAVKEAGKLGVEGKEYVVQDGDIMHFRFNV

SEQ ID NO: 45649 - protein, 601 aa, Francisella tularensis subsp. holarctica
MRRFLLSYTYSVFKNTLRLLVKKLFVNLMSLLILLPSLTLIAAPVPTGYGFIPIQEEMQIAQPFTATHGMVSSQEALASKVGLDILKQGGNAVDAAVAVGFALAVTLPRAGNLAGGGFMIIHLQDGNKNIAINYREKAPAKASRDMFLNDKGDIDYAKVSGSYSASGVPGTVACLIDAQQKYGKLKLSQVIEPAIKLAEDGIPVSYDLHQSLVTAKPWLQKSPDAMKIFYKKDGSAYEVGEILKQPELANSLKLIAKQGKKAFYEGEIAHKIADSMAKNGGLITLQDLKNYNIEEMKPVKGTYRGYTIYSMPPPSSGGVILIELLNILENFPLSDYGNNSAKTINLMSNAMSYAYNDRNSDLGDPDFVKMDLAKFLSKKYAKQIAQKITTDKHIPSKDISTIDPDDHEKLQTTHFSIIDKDGNMVSNTYTLNYSYGSGIVVPGTGIFLNNEMDDFAAKVGEANVFGLVQGEVNTVAPNKRPLSSMTPTIVLDNDGKPFLATGSPGGSRIITTTLQVILNIIDFNMNLQAAVNNPRIHSQLWPEEIGVEQGISVDTINLLKKMGNTVTPYAAMGAAESVMSDGQYVYGAADPRRASALAIGY

SEQ ID NO: 45650 - protein, 496 aa, Aspergillus oryzae
MDPQKHSEEPPEKAVASPDAVPIDVAPSENMQKGRWERSWPTIACGAGLFSDGYLNGVIGSVNTILGKIYPDSYSNSPASQNVSSITFAGTVLGQLVFGYVSDHWSRKWSLMISTIILIIFSALCAGAYGLNGSQYGLFAALTAYRFFLGIGIGGEYPAGSVAAAENTGELKKGHRNRWFIMFTNFQIDFAYVVSALVPMILVLICTENHLRLVWRIALGLGVIPPLSLFYLRLKLEEPEEFNRERMHKFPVWLIIRFYWKRLVCPQCCHFRTVVSLIWFIYDFSAYSFNIYSSKWVGIILGDSAPLWKTFGWTTVTNAFYIPGSFLGALVSDWIGPRNTLAIGVGLQGVIGFVMSGCYEYLSIPKNVAGFVVVFGIFSALGEFGPGDNIGLCAAKSSATAIRGQYYAIAAAAGKIGAFVGTYVIPIIQKNAPNEVRSGQDPFFVSSSLCLLSAAMAYFLLPHIGQDTITEEDEKFRAFLEANGYDTSTMGNREAR

SEQ ID NO: 45651 - protein, 172 aa, Burkholderia xenovorans LB400
MAKMQAKVQADERDDGLREKMISVNRVTKVVKGGRILGFAALTVVGDGDGRIGMGKGKAKEVPVAVQKAMEQARRNMFKVPLKNGTLQHEVHGKHGASAVLLAPAKDGTGVIAGGPMRAVFDVMGVQNVVAKSHGSTNPYNLVRATLDGLRKQSTPGDIAAKRGKSVEDILG

SEQ ID NO: 45652 - protein, 170 aa, Oryza sativa Indica Group
MASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 45653 - protein, 268 aa, Bouteloua dimorpha
ASYAAAAMPALDVLPEKAHHGWESNGGAAVAPTPAPRRLDGKVAIVTGGARGIGEAIVRLFVKHGARVVIADIDAAAGDALAAALGPQVSCVRCDVSVEEDMKRAVEWAVARHGRLDVLCNNAGVLGRQTRAARSILSFDAGEFDRVLRVNALGAALGMKHAALAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45654 - protein, 398 aa, Vitis vinifera
  misc_feature (42)..(42): Xaa can be any naturally occurring amino acid
MEKSWVLAFLLLQVLPTEGDFGVGAGIGVGIGNGDGGGGGGXHLCGLVVGLTAKTHLALQAWKSAITDDPLKVLRTWVGSNVCAYRGVFCADPEEDGSGQTGPVVAGIDLNRANLQGTLVKELSVLTDMSLLHLSGNRFTGTVPESFRYLLSLKELDLSNNHFSGPFPTVTLLMPNLIYLDIRFNNFAGPIPDDLFNKELDAIIINNNQFDGELPPNLGNSPASVINLANNKFSGNIPTSFAYMNPKLKEILFLNNQLTGCIPEGVGMWDGMEVLDLSHNSLMGHLPNSISCLEEIEVLNLAHNKLSGSLSDLVCSLRSIVNLTVAYNFFSGFGQECSKLFFRNVGFDFSVNCIPGRDMQRPQPDCSVIPGGGLNCLRIPSARPLICGLYICKLLYLS

SEQ ID NO: 45655 - protein, 431 aa, uncultured archaeon GZfos1C11
  misc_feature (409)..(409): Xaa can be any naturally occurring amino acid
  misc_feature (428)..(428): Xaa can be any naturally occurring amino acid
MSLLPLRFYAVTDTIYEHANRIAEEGKVEKVKEFVGELRNKHDMAASVAIGDTQVLKKVKGEIKERIAEMEKALIGICLLGELTLRSLDYIGSFGERLAAPILAGAIQSAGIDAVHFTGGDIGIITNAEYGSAQLMGGVEQEVRARIMPLLGDKIPVVCGFTGETKDGKITTLGRGGSDYTATIIGAAIDADEIWLWKDTEGIMSADPKRIKNARKIPYMSYIEAMELSYFGAAVLHPRAIEPAMKKKIPIRVKNLLNPDDEGTLIGEEQEKTKKAAKAITLIENTSIVNIAGTGIGSISDVASRIFSVLAAKNVDIIMISHGSSERTVSLVIDSAQLERAIDAIHSIPAVDTVIRDISYNSNVCTVGVVGVGMAGTVGVAGKVFSALGNEGISVKMISQGSSEFNISXVVQKEEAYKAAQAIHDVFXMGS

SEQ ID NO: 45656 - protein, 268 aa, Bouteloua dimorpha
ASYAAAAMPALDVLPDKPHHAWESNGAAPVAPTPAPRRLDGKVAIVTGGARGIGEDIVRLFVKHGARVVIADIDAAAGDALAAALGPQVSCVRCDVSVEDDVKRAVEWAVARHGRLDVLCNNAGLLGRQTRAAKSILSFDAGEFDRVLRVNALGAALGMKHAALAMAPRRAGSIVSVASVAGVLGGLGPHAYTASKHAIVGLTKNAACELGAHGIRVNCVSPFGVATPMLINAWRQGHAAAAPSGEEVEKMEEVVRGFATLKGPTLRP

SEQ ID NO: 45657 - protein, 397 aa, Oryza sativa Japonica Group
MSNPESNPPPPSATSCPPPGSAAHAGHAPLCRSCGAPTTTPVPPPWSASSDSPPPAYRPIRMPAINAPTNTAAIVLSPVPQPLPVPPASPPFAFQVPAKRITSPDDIARFHASVHGRHFLGFVAALSASVHGRKLSDPLPSPPSPVVSALLELISALSAFVASTPPLPHNSRYGNPAFRLWHEKLSDSANQLIAPIMATAGSPDLAGAEAELAPYLLDSFGNATRIDYGTGHETNFAAFLYCLARLGLITEADYPAVVLRVFAAYLDLMRTLQDTYLLEPAGSHGVWGLDDYHFLPFIFGAAQLIDHKYMKPKSIHNPDILDNFSKEYMYLACVAYVKKVKKGPFAEHSPMLDDISGVPHWKKVNSGLLKMYKAEVLEKVPIMQHFLFGSLIKWYGS

SEQ ID NO: 45658 - protein, 175 aa, Oryza sativa Indica Group
MAPSVMASSATSVAPFQGLKFTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 45659 - protein, 221 aa, Corynebacterium glutamicum
MQARIDATLNEHNRPEGSVRLLPVTKFHPVEDIKILQEFGVTAVGENREQEARAKALELPDMDFHMIGQIQSKKANSIARWAAAVHSVDSEKIAEALGRGVALALDRGDRTSDELPCFIQLSLDGDPSRGGTPLSQVTQLADCISDTTHLRFEGLMCVPPLGWGPEKAFSQARDVLSGLEEHFDRSLEFSAGMSGDLVAAIKHGSTIVRVGTEILGNRPLA

SEQ ID NO: 45660 - protein, 318 aa, Synechococcus sp. RS9916
MVSASQGVASVLSPLSGRDFLSSEDANAEQTAALLTLAAQLKSGDRRIDLGNRVLGLIFTKASTRTRVSFQVAMARLGGQTVDLNPQVTQLGRGEPLEDTARVLSRFCDALAIRTFAQQELVDYAHWASIPVINALTDLEHPCQALADFLTMQEAFGDLQGQTLAYVGDGNNVAHSLMICGALLGVNVRIGCPDGFEPLPGVLDQARALAVGGAQITVTSDPVAAVRGAQALYTDVWASMGQEQEQAERERAFQGFCLNEDLLAEADSRAIVLHCLPAHRGEEISAGVMEGPASRIFDQAENRLHAQQALLAALMGGL

SEQ ID NO: 45661 - protein, 278 aa, Shewanella sp. ANA-3
MAPIDIEDTRENAMSIVIKTAEEIEKMRAAGKLAAQVLEMIAPYVKAGVSTNELNDICAKYTEEQGAISAPLNYHGFPKSICTSLNNVICHGIPSDRVLEDGDILNIDITVIKDGYHGDTSKMFLIGEVSPKDKRLCRIAQESLYLAIRKVRPGLKLGEIGNTIEKFIKASKTGLEKYSIVQDYCGHGIGAGFHEEPQVMHYRNGDNTILRPGMCFTIEPMINAGRHTTVLDRDDKWTVTTSDGKNSAQWEHTLLVTETGVEVLTLRDEEDFPRIINH

SEQ ID NO: 45662 - protein, 505 aa, Lolium rigidum
MASFELDSTLVLLCLVFVVSCFAVVVRGSGTGRKYGVRAVPPGPLALPIIGNLHKLGGAHPHRSLQGLARRHGPLFLLHLGSVPTVVVSSASLAEALLRTQDHVFCSRPQPYTARGTLYGCRDIAFSPYGEKWRQIRRIAVVHLLSMKRVDSFRALRVEEVARFVQRIGAASGRERVDVSELIIDLTNTVISKAAFGNKLGGMEPATVRDMMKELTVLLGTIAVSDVFPRLGWLDWAMGLDARVKRTAARLDTVVERTLAEHEGNRVKDGEACDLLDDLLSIYKDGDQGFKLDRTDVKALILDMFIAGTDTIYKTIEWTMAELVRNPREMAKVQYEVRLHAAASAQGVVLEEELEKMSLLHAAIKEALRLHPPVPLLIPRESIEDTRLHGYDILAKTRVMVNTWAIGRDSESWENAEEFLPERFIGQAMEYNGKDTRFIPFGAGRRGCPGIAFGTRLVELTLANMMYHFDWKLPNGQDIESFELIESSGLSPGLKSALILAVKPL

SEQ ID NO: 45663 - protein, 329 aa, Erythrobacter sp. SD-21
MTIGVLGAGAWGTALAQMVASDGSDVLLWAREAELVDEINRDHTNSAYLPGAPLSPTIRATDALADMADLDVMLVVTPAQHMGQVLADMPKHPRDLILCSKGIEAGSGRLMNGVASDVAPDSDIAVLSGPTFAHEVVAGLPAAATLACGGGEAQWDRIAPQIARPTFRPYYSDDVTGAEIGGAVKNVLAIACGVVDGLALGQNARAALIARGYAEMLRFGEAKGAKPETLTGLCGLGDLVLTCSSTSSRNFSLGKALGEGQSAEALMADRRTVAEGAHTAPVLVELAARHGMAMPIVTAVYDLLKGDDPREVVQGILARPLKAEQESLG

SEQ ID NO: 45664 - protein, 331 aa, Brassica napus
  misc_feature (183)..(183): Xaa can be any naturally occurring amino acid
  misc_feature (311)..(311): Xaa can be any naturally occurring amino acid
MSSDGGGSRRIRWLLGFGFFVQGFRGFPWLGANFFLTDELRVNPSVLQLLQNSANLPMVAKPIYGVVSDAVYFFGQHRVPYIAFGALLQAVSWLAIAFLARSNVSILALSLYLLLSNLGASVVEVANDAIVAEAGKQKSLLRVSCLRFVWMASSLGGILGNLLGGIAIKTFASQPTFLVCGLXALLQFLVTLNIREKSLNLPENHSPSGGGGGIKSHVSDLSRVLRKPEISYSIAWMALSTALVPVLTGTMFFYQTKILNMDASLLGISKVVGQVAMLLWGVAYNRWLKTTSPRKLIAAIQGTIAVFVVSXLLFVRGVYRDLGVADSVYVL

SEQ ID NO: 45665 - protein, 262 aa, Thermus thermophilus HB8
MDPLALLRKAGLEAEGPALPLHGGDISRVWRVGRFVVKTAQDPPPGLFRAEARGLQALAERGVRVPRVHWVGEEGLVLAYLEPGPEDWEGLARTLAALHRRREGSYLAEPGFLGTFPLPGREGGEWTAFFYERCVLPLLEATWDRLQGLGPKVEALYQRPLPAEGPAPLHGDLWHGNVYFAREGPALLDPSFFVGERGVDLAMMRLFGGFPRRFWEVYGELYPVPEEVERALPRYQVYYLLAHVHFFGQGYLGALWRAISAS

SEQ ID NO: 45666 - protein, 372 aa, Arabidopsis thaliana
MARGESEGESSGSERESSSSSSGNESEPIKGKISEYEKQRLSRIAENKARLDALGIPNQSSASKRRVSSRKILNTSVFLGEDDDDLDKAIALSLQGSVAGGSRTKNTRSDKEAATMKKKRQGFFFTSSISELMSKMQMTQDELVMYFCQFDEGGKGFITRRDVAKMATVHDFTWTEEELQDMIRSFDMDKDGKVGTKLKTDRQTDRIGQTDRTDRSSDGSDGTGRSSDGTGRTDRSSDGMDREKCSRKHKDKCIRTHPRVAHGCNLTGKGRKHQEWVRNVIHHIGSTSRPPSCIYLLSHGETDQRSVRPKGDSMDNQRESPRNDRDWFINSQPMTSRLTNGVSKILLRMTTQLGQYTISSPSSVELSVSSPS

SEQ ID NO: 45667 - protein, 207 aa, Staphylococcus epidermidis ATCC 12228
MNQTTIIGIAGGSGSGKTTVTNAIMKNLEGHSVALLAQDYYYKDQSHLTFEERLETNYDHPFAFDNDLLIHNLKDLRNGKPVEVPTYDYSQHTRSKETIAFDPKDVIIVEGIFALENNTLRDMMDVKIYVDTDADLRILRRLTRDTKERGRTMESVINQYLNVVRPMHEQFIEPTKKHADIIIPEGGSNKVAIDIMTTKIQSLVSKK

SEQ ID NO: 45668 - protein, 114 aa, Zea mays
RVLHRRLLNSSPARHEWRRTGGRDHIGLEHHPSGMLDARYMFWPCVFMLCNFGRHPSSVKLPLRVDVLFTHIQKMMTGDSVVMAEPGDSWFSRHKLKLPEGYGYEFQTQYGLIG

SEQ ID NO: 45669 - protein, 325 aa, Arabidopsis thaliana
  misc_feature (138)..(138): Xaa can be any naturally occurring amino acid
  misc_feature (293)..(293): Xaa can be any naturally occurring amino acid
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTXVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLXPEKIHERSPIFLGSYDDVEEIKALYAEEEKKN

SEQ ID NO: 45670 - protein, 344 aa, Pediococcus pentosaceus ATCC 25745
MNTKRDFIDTNTYTQEEITYMINLGLKIKESIKNGYYPPLLKNKTLGMIFEQSSTRTRTSAEAAMTELGGHAQYLAPGQIQLGGHETIEDTSQVLGRILDIIGARVDRHKTVAEVGKYAKVPVVNFMSDYNHPTQELGDITTMVEHLPAGKKLSDCKIVFVGDATQVCVSTMFMTTKMGMDFVQFGPKGFQMKDDVVEIGKENAKKYGGSVTITEDADEAMKDADFVYTDVWYGLYDDEMPKEERMNIFYPKYQVNAELMAKASDHVKFMHCLPATRGEEVTDEVLDSDYSIVWDEAENRKTAMRAIFVYLLNPSLNYASKAVAEKYDAEFELMLKNAVDSRNN

SEQ ID NO: 45671 - protein, 249 aa, Brassica napus
  misc_feature (211)..(211): Xaa can be any naturally occurring amino acid
  misc_feature (234)..(234): Xaa can be any naturally occurring amino acid
MSNYSAGLGKPGSGKRRIRDLLNQPDNRVCADCGAPDPKWASANIGVFICLKCCGVHRSLGTHISKVLSVTLDDWSDEEVDSMIEIGGNASANSIYEAFVPEGSSKPGPDVSHDQRLRFIRSKYELQEFLKPSLRITSGKTTSTKKPPSFLSSSLSTKFMDSFRTNSSSKKIFEEGMVEFIGLLKVTVKKGTNLAIRDMMSSDPYVVLNLXGKQKLQTTVVNSNLNPVWNQELXLSVPESYGPVNLQCM

SEQ ID NO: 45672 - protein, 496 aa, Gibberella zeae PH-1
MNTRTNYYQDHPNTGVIRKYDFTVNRAKIAPDGYELSTILVNGQFPAPLIEANWGLSLHWHGILQKNMPWEDGVPGVTQCPIAPGQSYTYSFIADLYGTSWYHSHYSAQYLAGLFGPLVIYGPQERKDYDIDVGPILLSDWYHKEYFDLVEEIMTPGAPGIVFSDSNLINGKMNFNCSSVQPGDKTPCKNNAGISKFRFRRGKVHRLRLINPSAEAIQRFSIDGHTMTVIANDFVPVEPYNTKVVTLGIGQRTDVLVKGNGKLESYWMRSNISANCSLARAHDALAAIYYDNANPKKEPKSKPWNIPDPATCANDDLSMTRPLMKLPLPPADKTIELDIASFKNASNITLWSLGGVAARTNYNSPTLLLSKLGNHTFDKEWNVINTGKAKSVRVVVNNKTPVAHPMHLHGFNMYVLHEGLGDWDGTIINEHNPQRRDVVQIRGRGHLVIQFDAGSNPGVWPFHCHIAWHVSAGLLAQFLTNPDQVEKLRSSASSVL

SEQ ID NO: 45673 - protein, 624 aa, Schizosaccharomyces pombe 972h-
MDLLGLKELDNNKLVSKAKENGVEFSDLFLLSSGYLRDRENASASVSSKNERMVLNEERQNCWTKRNDPKGLTYYQLLKPSEVEILSRPETRRKRMACQVFFLNYYISTIEYHKLRKERLEEFTACTSSLKQSKQKRLWKEHCGRERAFLRKKRTKIQCSHFDLLVKLGQGGYGSVWLAKKRNTHELLAMKMMKKSTLQQLNEVKHILNERDILTNTNSEWLVKLYYAFQDKEKVYLAMEYVPGGDFRTFLTTKGLLHENQTRFYLAEMVAAISAVHKLGYMHRDLKPENFLIDQKGHIKLSDFGLSTAIVTSNQVNRLQHALVSAVNPQRPYLTQKQRRNIYKALLEKNENKVNSVVGSPEYMAPEVVYGKKYDRTVDYWSLGCICYECLVGYPPFSGSTLQETWTNLYYWREMLQRPSKNENGIYDKKARSVSDEAWSFITKCLTEPTSRFQSTIEIQKHPFFKRLHWNGLRKRAVPPFVPRLENQLDTSYFDDFNDEQVLDAYKDVYEKQRKAEQKAKSNGVMNGNQRQFLGFTFKYRPNARKPLVGRHREKRQLRKEKPEKKNNSTKQKDLITVSHNKGTTAIEDLDEDKRSKTKGHKTKSSRVHRLLERKGKDLYEFLL

SEQ ID NO: 45674 - protein, 364 aa, Pediococcus pentosaceus ATCC 25745
MKTLDSTPKKDGYRMPGEFEEHSGAYMLWPQRPDNWRNGGKPAQQTFAKVAEAISKFEHVTVGVNDDQYANARNMLSDDVEVIEISNDDSWIRDCGATFVKNDQGDLRAVDWTFNAWGGLVDGLYFPWDKDDRVAQKMAELEGTDRYRLDDFVLEGGSIHVDGEGTLITTEECLLSEGRNPQLSREQIEEVLKEHLNLEKIIWLKKGIYLDETNGHVDNIANFVKPGVVALAWTDDENDPQYKISKENLEILENATDAKGRKLKVVKMYVPKPVLITKAESEGVDAVDGTLPRTEGERLAASYINYYTANGGIVFPLFNDPMDEKAKATLKELYPDREVIGVPAREILLGGGNIHCITQQVPKK

SEQ ID NO: 45675 - protein, 363 aa, Pediococcus pentosaceus ATCC 25745
MKLMSTPRKDGFRLPAEFEFQNEGFMIWPQRPDNWRNGGKTVQKEFVKLITLLAKYQPMTMLVNESQYKNARASLPSNIRVLEMSSNDAFIRDTGPLYLKNKQGEIRCMKFNFNAWGGLLDGLYFPWDKDNEVASKLADLYHQDFYQDDFTLEGCSILTDGEGTLITTEEVVLSEGRNKGINKQIAEEKFKEFLGIEKVIWLPEGFFMDEAGGDIDNILNFVKPGEIVLSWTEDQSDPQYQISKNALEILSSVTDAKGRKLIIHKLDLPQNKVELSKDQAYGVDPINGMLPRVEGQRLTATYVNYITLNKVIIVPEFGDFNDKIAQKQLASYYPDRKVIGFAANEILTGGGGLHTIVLTMPGR

SEQ ID NO: 45676 - protein, 251 aa, Francisella tularensis subsp. holarctica
MSNSNVDFSSVATLYQKARPSVPVEIINFLKQKIPSNQKAWDCSTGNGQIAIKLAEFINEIHATDISSAQLAKAFKHNSIKYFKADEANSMFADRCVDLITVSQVAHWFDMSKFEKECLRILKPNGIVAIWAYHHNISVNTAVEIIYQEFYRTIRPYFPQGREHIDNFYKDINIDLPKLDSPEFRQTKEMNFDDFIEYLKSFSAYAEYLRNHNKCPIVKLGFYDKFRESWGDSKKVYTVVWPIIFKCYINK

SEQ ID NO: 45677 - protein, 576 aa, Legionella pneumophila subsp. pneumophila str. Philadelphia 1
MTLIGLVVMIFLFTMQKYNDFALLTGELFACIKIIRTCENQMNKNLSALSLLWISITSMVGSGWLFGSLYSAHFAGPAAIIAWPLAGFLLLFVALSYAELGTMFPQSDSLACLPLYTHGRLTGIIMNVMTWFSLAILPVIETQGVIQYASNYIPDLVSHDALHYRNTPTGYMLSLLVLMSFILFNYFGIGLFARINAAFTIWKIIIPILTIASLVTMSYHPGNFFQHGGFMPYGWQGVMAAMSSGGVLFSLLGFRQVVIMMGELEKPGQYIPLILGGSLVFVTLLYTGLQWSFIGSVSEQALEKGWVNLSFTGDAGPFAALAALAGMLWLSILLYADAFISPYSTGLVYSTTAAHMLSSMGSVVPTPVILTKQNRYQVPWVSLGVNFLLAATMSLVLHGWQEMSAFLVAILMISYSIGPVALVCLRQQLPHYKRPFRLQGSNLIGFLGFYVCTVGVYWAGFHSVRKLLVITILGVVCSFLYCLMKNTHREIDSKQALWFIFYLFGLGIFSFLGNYGGKHILPQYWDLLYLLVFSLLVFGFALLSRKPSAHTQNMVAQNTRTTITAPAFSIERYDIA

SEQ ID NO: 45678 - protein, 378 aa, Candidatus Kuenenia stuttgartiensis
MGMFSLIAILISLAAIFSYINFRLIKLPTTIGILLITILTSLVIVILGLFGLGEIHVKAAYALNRIDFNKTLMNGMLSFLLFAGALHVNLEDLSKHKYIIIILATFGIIANTFIVGSLAWLVFALVNIKLSYIYCLLFGALIAPTDPIAVIGILKKAGVSKSLETKITGESLFNDGVAVVVFLILLEIATGGHEVTFQHISFLFIEEAVGGIVFGFVTGMIAFFMLKAVDNYQVEILVTLAMSEKTRGHLDSFWELIDEVLNAVLFLMIGMEVLVVTIKINYLIAGLIMIPIVLIARFISVGVPVTLMRFLKEFSPNAIKILTWGGLRGGISVALALSLPAGESREVLLTITYIIVVFSIVAQGLTIGHYVSSLKTTE

SEQ ID NO: 45679 - protein, 315 aa, Picrophilus torridus DSM 9790
MNEIISSLEEEKPPGSPLLSGAYLRGIIDSDRVFVKYEGANPTGTQKDRISENHVKRALSLGMKTVSVATCGNYGASISYYSRKYNIDAVIGIPEYYSNVRSKEMVANGSRVIKYPYKYEEIVELFHKISERNGWYDASPGSRNDVYDIIGYSIIAIEIYKQLGHSPDYIAVPVGNGTTLAGIYYGFRALYDYGYASNVPRFIAASTSGGNPIVESYMNGSKKIMELSEEKIRETNINEPLVAYRSYDGQKALDALYDTEGYAFYVNDDEMINASHLMKMNGLSVLPASASAAVAAARVLKNNDECVIVITGRDH

SEQ ID NO: 45680 - protein, 218 aa, Picrophilus torridus DSM 9790
MFENEKRMAAMEALKFVRNDMRIGIGTGSTAYYFIEGLSELVKNGLRITGIPTSKKSEELCRSFNIPVDYNIKDIDIDFDGADEFDPYGNLIKGGGGALVREKIVAYNSREFYVLVDHSKYSERLHKFPLPVEVLPFMSEKTLENIERLGCRASFRDDKKFISDNGNYIIDCVFSYTDPELESQIKMIPGVVEVGIFRHLSTKIFQGTIDGCRIIDVK

SEQ ID NO: 45681 - protein, 268 aa, Bouteloua dimorpha
ASYAAAAMPALDVLPDKPHHGWESNGGGAVAPTPAPRRLGGKVAIVTGGARGIGEAIVRLFAKHGARVVIADIDAAAGDALAAALGPQVSCVRCDVSVEDDVKRAVEWAVARHGRLDVLCNNAGVLGRQTRAAKSILSFDAGEFDRVLRVNALGAALGMKHAALAMAPRRAGSIVSVASVAGVLGGLGPHAYTASKHAFAGLTKNAACELGAHGIRVNCVSPFGVATPMLINSWRQGHAAAVPSDEEVEKMEEVVRGFATLKGPTLRP

SEQ ID NO: 45682 - protein, 314 aa, Aspergillus oryzae
MASPTTKESQAAMDFLHHPYTRAALPFINGGLAGMTATTVIQPIDMIKVRLQLAGEGVRTGPRPTAFGVARDIIAGGKILDLYTGLSAGLLRQAVYTTARLGFFDTFSKTLNKRAEAANRKITFAERAGAGLTAGGIAAMIGNPADLALVRMQSDGLKPLEARANYRSVVDALFRISKNEGIPALWAGALPTVVRAMALNVGQLTFFAESKAQLKAHTSLSAQNQTFAASAIAGFFASFLSLPFDFIKTRLQKQQKDPKTGQVPYKGVLDCARKVAKDEGWLRFYRGFGTYYVRIAPHAMVTLIVADYLNLITK

SEQ ID NO: 45683 - protein, 293 aa, Nostoc sp. PCC 7120
MDLYSSIFRCLCIVEAQVNSYMTNTVIITGASQGIGKATALLFARHNYNVVLAARQLDRLEAIATEIREMGQQAIAISTDVKDATQVNNMMQKAIAHFGQVDVLINNAGIFCLGSVENFSLEDWHQIIDTNLWGYIHTIHAILPHFLQRGAGTIVNVSSIGGLEPIPYHVPYTASKYAITGLTKSLHAELSPKNIHVSGIYPSFISTQLMERAIFRGKDEEMAQARTELVGKAIQMPVLEKPEDVAKAIWSAVKEKRSDVVVGSANFWKAAYQLTPSLIQSLVRRVFGMEERK

SEQ ID NO: 45684 - protein, 268 aa, Bouteloua dimorpha
ASYAAAAMPALDVLPEKPHHGWESNGGAAVAPTPAPRRLDGKVAIVTGGARGIGEAIVRLFVKHGARVVIADIDAAAGDALAAALGPQVSCVRCDVSVEEDVKRAVEWAVARHGRLDVLCNNAGVLGRQTRAAKSILSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHAAAVPSDEEVERMEEVVRGFATLKGPTLRP

SEQ ID NO: 45685 - protein, 1251 aa, Ustilago maydis 521
MNQSVDVITKRFTPKIDALPASRSSAANTTRSALRAKLAHASSTLLRSPSLSTRKSCPTELPLVNAMPFASREIAQVRAGLKRKKGAREQLGGVAHEPTQINRSFEKLEVEASTADGSRRIAPRTPRRRSGKQIHIVTSPHLPRDKPSSSASELSDWSSVVSTSPTASRVPTSRAEESAAVQLSRPGIQTRRSSRNSLYKTLDGMTLEDSLASVRSLARSSRSQSRSVSRKNSNLNAGNDNETGFPSAASHRIVSAHKVPDSELSSEASIDMDDKEAEQARLVSSAPTWQLHRLRKDELVQLCLSARAWDASPTDAELELVTKQDLVNQIITCRSRLDHSRSDELHASTTVQRQSRSVRSSYHTYKQRSNDLPDEHADESDALWMALPARESLHRSARSSLCASPTGSADDDEADLTDASNEAGGEETEAEPHGSPSSRRHMGRPSQARLKAYEGGALRRMDSSTFDEFEPSKANQAPRRQLRDKTTLRNGVARRQLIGNASEAMSASTSSSIFGGRSSRASNTSHSAFVQRRQLGVFVASSPIRTRSRTARLTAGLPSRRKVGTRVVSASIDGASTGPDPMATPKVGHRLPQRTKKSVKFCAASPGQHGEYDRDEWMEDLSSGSDDVAVGLQTRSISLLQDEHEHTAVRNAPTRCSTRRTLRTRRSTAESEASFTFHPPRSRSASSEAASSATQEDDLVAERDGDVDMANSDHGDDDVAATPTKFRKLRNGKLRLVVGASNGDSDVRTSGNEQLGDVDMESAAEHADRSREQRTESPDSDTAPSEGLDSVMAQPTFATLTRLRKSELGQLCLDRAIDMDGDDKKANLIKKLLDWFQLSELDAAKNADSDADDGDETQSDISNATAVAQDDQAQAGQRTPTRRRNTRATSNAHASATDSDQPLLLRARSTMVSSEKLLTPPLTSNNEEAAAPQVGDGVDELNGLDLESLNLTDKEIAPSKLEKLEKIGSGGFKDVYVGKYRISKTRVNKVAIADIRDQLTEMDIKELSLLRDLRHENIVRFIGVSIPEDPRHVPCMIVSELCSNGDLFDYIRNTAAPSDAEVFRILLETARGLEYLHTRTPAIIHRDCKSTNVLITRRKTAKINDFGLARVKNTSRSMMRSLVGTVNWQAVELWVPKPQYNEKVDVWSAAMTFWEALQWHQPEKKYPFQGMNEHQIYQDVGQKRQRPYTGFIRRQFGDEIVDLLDRMWDQTPKNRPSMTEVCNELESLIQMKKDAAAATAATAGSSIRFRA

SEQ ID NO: 45686 - protein, 331 aa, Arabidopsis thaliana
MGNKNSMCGLKRFPNYKKSPIGSFAKNSSSHDGIKTIEAVNSCSFSRKADLCIRIITWNMNGNVSYEDLVELVGKERKFDLLVVGLQEAPKANVDQLLQTASSPTHELLGKAKLQSVQLYLFGPKNSHTLVKELKAERYSVGGCGGLIGRKKGAVAIRINYDDIKMVFISCHLSAHAKKVDQRNTELRHIANSLLPRDKRKRDLTVWLGDLNYRIQDVSNHPVRSLIQNHLQSVLVSKDQLLQEAERGEIFKGYSEGTLGFKPTYKYNVGSSDYDTSHKIRVPAWTDRILFKIQDTDNIQATLHSYDSIDQVYGSDHKPVKADLCLKWVNS

SEQ ID NO: 45687 - protein, 268 aa, Bouteloua dimorpha
ASYAAAAMPALDVLPEKPHHGWESNGGAAVAPTPAPRRLDGKVAIVTGGARGIGEAIVRLFAKHGARVVIADIDAAAGDALAAALGPQVSCVRCDVSVEDDVKRAVEWAVARHGRLDVLCNNAGVLGRQTRAAKSILSFDAGEFDRVLRVNALGAALGMKHAALAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45688 - protein, 512 aa, Nicotiana attenuata
MDGSTVQGGSSVESFLRNYKLGKTLGIGSFGKVKIAEHTLTGHKVAVKILNRRKIKNMDMEEKVRREIKILRLFMHPHIIRLYEVVETPSDIYVVMEYVKSGELFDYIVEKGRLQEDEARKFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGMYTLPSHLSAGARDLIPRMLIVDPMKRMTIPEIRMHPWFQAHLPRYLAVPPPDTMQQAKKIDEDILQEVVKRGFDRNSLVASLCNRVQNEGTVAYYLLLDNRFRASSGYMGAEFQETMEYGYHQINSSEAVASPVGQHLPGIMDFQQVGARQFPVERKWALGLQSRAHPREIMTEVLKALQGLNVRWKKIGPYNMKCQWVPGVPGHHEGMSNNSIHNPFFGDDSTIIENGGVTIPNAVKFEVQLYKTREEKYLLDLQRVQGPQFLFLDLCAAFLAQLRVL

SEQ ID NO: 45689 - protein, 314 aa, Anabaena variabilis ATCC 29413
MASPTLRANRTFQERGVWGEVIEFTLIYLKKIRGAAMLGDLKIAFIGGGTMGEMIISRLLSTKTVEKSELIIVSEPYSTRCLYLEKEYGVHTTNCNIEAVQGASIVILAVKPQVLPEVMAVLKDQIPPDALVISIVGGASVSSLCQGLNHGAVVRTMPNIAVQVGHGTTVWSASSNVTEIQRSHTQIILQALGKEFVTQNEHYLDMATALSSAGTGFVFLYIEAMIDAGVQMGLTRIQAQELTLHTIAGSVELMLQTNEHPAVLRNKVTSPGGVTAAGIYELEKGGMRTSISNAFSTALSRTQQLGNISCSISG

SEQ ID NO: 45690 - protein, 268 aa, Bouteloua dimorpha
ASYAAAAMPALDVLPEKPHHGWESNGGAAVAPTPAPRRLDGKVAIVTGGARGIGEAIVRLFVKHGARVVIADIDAAAGDALAAALGPQVSCVRCDVSVEDDVKRAVEWAVARHGRLDVLCNNAGVLGRQTRAAKSILSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45691 - protein, 661 aa, Glycine max
  misc_feature (342)..(342): Xaa can be any naturally occurring amino acid
MGSISNTEVHNHHNDDDDDDHRHRVNFSIQRGFGTKLKEALKETLFPDDPFRQFKNEEKPMGRVMKGVQYFIPIFEWLPTYNFRLFCSDLIAGLTISSLAIPQGISYAKLADLPPLIGLYSSFVPPLIYAVFGSSRHMAVGTIAAASLLIAQTIQTVVDPVEDPTLYLHLIFTTTFITGVFQACLGFFRLGILVDFFSHSTINGFMGGTAVILILQQLKGVFGMKHFSTKTNLVAVVKSIVNNRQEIRWEPTILGVIFVAFLQFTRHLRNKNPKLFWVPAIAPMVTVVVAAVFTYVPKGQHHGIQIADHLYKGLNPLSIHYSNFNGKYIRTHVQAGLDTSVXPLAKRIPIGRSFAVADNTPHDGNKEMIAFGLMNLFGSFTSCYLTSGPFSKTAVNYNAGCKTAMANVVQAIVMALTLQFLAPLFGFTPLVALSAIIISAMLGLIHYEEVIHLYKVDKFDFVICMAAFLGVIFISMDVGLMLSVGLGVLRALLYVARPAPCKLGKLPEIGLYRDTEQYNVSTYPGVLVVQLGSPVYFANSIYVKERIMRYIRSEESSTGDVVEHIILDLSGVTAIDTTAIKGLDELIKILGKNGVKVLFVNPRLEVMEKLIISKFVEKIGKESFYLILDDAVMASQYTLRSSKAANNAQENHDTPSLKVTA

SEQ ID NO: 45692 - protein, 182 aa, Idiomarina baltica OS145
MKWNIPNILTSFRILLIPVFLIVFYLPFEDARFWSAFIFWLAAITDALDGWIARQFNQFTEFGAFLDPVADKAMVIAALVVLVEDYNAWYITVPALTMICRELIVSALREWMAQRGNRDKVAVSNLGKLKTIAQMVALIGLLWDANIWTFWISIVLFFTAFVLTLWSMWEYLRAAGSQLTRN

SEQ ID NO: 45693 - protein, 490 aa, Zymomonas mobilis
MAQNKMLSFVHLKQAYPEKRSAQERDKDFNEIYRSFSDEQASCQASRCSQCGVPYCSAYCPLHNNIPDWLKMTAEGRLQDAYALSSATSTMPEICGRICPQDRLCEGNCVIENSGHGAVTIGSVEKYITDTAWKEGWVEPLQPITELGISVGIIGSGPAGLTAAEKLRQQGYQVHVYDRHVRAGGLLTYCIPGFRLDKDIVARRVKRLADWGCHLPYQFARRVKMPALKNCVTHAAILIATGVYKARGLATPGKELNGIVDALDFLISSNRKSFGDKVEAFDNGTLDAKGKKVVVIGGGDTAMDCVRTAIRQGAESVRCLYRRDRVNMPGSAREVKNAEDEGAEFVWLSAPESFVGKDHVQSVKVRGMRLGAPDGSGRRSPEPDPARLFDMDADLVICALGFSPEDLPTLFNAPELSVTPWGTVEADPVTLQTSIEGVFAAGDIVRGASLVVWAIRDGLVASEQMHQWLATRQQDKQDAPTKAKKKAVFA

SEQ ID NO: 45694 - protein, 183 aa, Arabidopsis thaliana
MYLTCRFEESKSAEKAVVALEESTSGEPKTPTESHEKLRKVRSDQGSSTTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 45695 - protein, 351 aa, Pneumocystis carinii
MTASSRNVRFNVSDDYEILDVIGEGAYGIVCSAIHKPSGQKVAIKKISPFDHSMFCLRTLREMKLLRYFNHENIISILDIQQPQDFESFSEVYLIQELMETDMHRVIRTQDLSDDHCQYFIYQILRALKAMHSADILHRDLKPSNLLLNANCDLKVCDFGLARSAVSTEDSSSFMTEYVATRWYRAPEIMLTFKEYTKAIDIWSVGCILAEMLSGRPLFPGKDYHHQLMLILDVLGTPTMEDYYGIKSRRAREYIRSLPFKKRVSFASIFPRANPLALDLLEKLLAFNPAKRVTAEEALQHNYLEPYHDPDDEPTAPPISPSFFDFDRIKDSLTKNDLKILIYKEIMSMNN

SEQ ID NO: 45696 - protein, 378 aa, Streptomyces avermitilis MA-4680
MATDYYAVLGVRRDASQDEIKKAFRRLARELHPDVNPDPKTQERFKEINAAYEVLSDPQKKQVYDLGGDPLSQSGGGGAGGFGAGGFGNFSDIMDAFFGTASQRGPRSRTRRGQDAMIRVEIELDEAAFGTTKDIQVETAVVCTTCSGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHQTFQRRGDDLHCTVTIPMTAAALGTKVPLETLDGMEEVDIRPGTQSGQSIPLHGRGITHLRGGGRGDLIVHVEVTTPTKMDPEQERLLRELAKLRGEERPTGQFQPGQQGLFSRLKDAFNGR

SEQ ID NO: 45697 - protein, 437 aa, Synechococcus sp. CC9311
MHIAVVGLSHRTAPVEVREKLSIPEQTMEESLQNLRNHEQVLEASILSTCNRLEIYTLVRNPDLGIAAVRDFLSGHSGLESRDLSPHLFTYHHDEAIAHLMRVTAGLDSLVLGEGQILSQVKKMMRLGQEHKSIGPILNRLLTQAVSTGKRVRSETNLSTGAVSVSSAAVELAQLKLGQSRGQDALVTLETEQIAVVGAGRMSRLLLQHLQAKGASGVVLLNRTIERASALATDFPNLPIQCRGLDDLDQCLSTCSLVFTSTAVDDPIIDANRLNALNRRSSLRLIDIGVPRNIASDVHEVSGVESHDVDDLQEVVERNQEARQQVAREAEGLLLEEGRLFLEWWDSLEAVPTINRLRASLEEIRVEELTKALSRMGPDFSARERKVVEALTKGMINKILHTPVTQLRSPQQRSERQQALQVVEKIFDLESGAATQD

SEQ ID NO: 45698 - protein, 368 aa, Thermus thermophilus HB8
MLAVGIVGLPNVGKSTLFNALTRANALAANYPFATIDKNVGVVPLEDERLYALQRTFAKGERVPPVVPTHVEFVDIAGLVKGAHKGEGLGNQFLAHIREVAAIAHVLRCFPDPDVVHVMGRVDPLEDAEVVETELLLADLATLERRLERLRKEARADRERLPLLEAAEGLYVHLQEGKPARTFPPSEAVARFLKETPLLTAKPVIYVANVAEEDLPDGRGNPQVEAVRRKALEEGAEVVVVSARLEAELAELSGEEARELLAAYGLQESGLQRLARAGYRALDLLTFFTAGEKEVRAWTVRRGTKAPRAAGEIHSDMERGFIRAEVIPWDKLVEAGGWARAKERGWVRLEGKDYEVQDGDVIYVLFNA

SEQ ID NO: 45699 - protein, 397 aa, Zymomonas mobilis
MKPKLPLNRRQNPVRIMFLRLLSEQPQVKRRPLSRPMISQQQWPNWMLPRRLWQPMMINMLSVLSVMIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITQKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQVPSMSIRAFPSLLARKPHQVKSLKKTWISQAI

SEQ ID NO: 45700 - protein, 650 aa, Brassica rapa
MVLRTQRWNRLTTLRLVHLRSTETGTLRNAAFFQSPYEFFFCVQGFSGLTSDRKMSSYKERLRSGLVDIKKDDAVALFQSMLRSRPLPTVIDFNRLFGLLARTKQYDLVLALCKQMELKGIAYDLYTLNIMINCFCRRRKLGFAFSAMGKIFKLGYEPNTVTFNTLLNGLCLEGRVFEAVELVDCMVLSQHVPDLITLNTIVNGLCLKDRVSEAVDLIARMMANGCQPNQFTYGPILNRMCKSGNTASALDLLRKMEHRKIKPHVVTYTIIIDNLCKDGRLDDALSFFSEMETKGIKANVFTYNSLIGSFCSFGRWDDGAQLLRDMITRKITPNVVTFSALIDSLVKEGKLTEAKDLYNEMITRGIEPNTITYNSLIYGLCNDKRLDEANQMMDLMVSKGCDPDIWTYNILINGFCKAKQVDDGMRLFRKMSLRGMIADTVTYSTLIQGFCQSRKLIVAKKVFQEMVSQGVHPGIMTYAILLDGLCDNGELEEALGILDQMHKCKMELDIGIYNIIIHGMCNANKVDDAWSLFCSLPSKGVKRDIQSYNIMLSGLCKRSSLSEADALFRKMKEDGYEPDGCTYNTLIRAHLRGNDITTSVQLIEEMKRCGFSSDASTVKIVMDMLSSGELDKSFLNMLSGPFGDKSSSLD

SEQ ID NO: 45701 - protein, 314 aa, Sporothrix schenckii
MRDELELWKAQREEMELEIKQDSGEIQEDLEVDHIDLETKQKLDWENKNDFREADLTIDSTHTNPFRDMNSETFQIEQDHASKEVLQETVSLAPTSTHASRTTDQQSPQKSQTSTSAKHKKRAAKRRKVSLDNFVLLKVLGKGNFGKVILSKSKNTDRLCAIKVLKKDNIIQNHDLESARAEKKVFLLATKTKHPFLTNLYCSFQTENRIYFAMEFIGGGDLMWHVQNQRLSVRRAKFYAAEVLLALKYFHDNGVIYRDLKLENILLTPEGHIKIADYGLCKDEMWYGNRTSTFCGTPEFMAPEILKEQEYTKA

SEQ ID NO: 45702 - protein, 281 aa, Brassica rapa
MVPRGIDPDTITYTSLIYGLCMENRLDEANQMMDLMVSKGCEPSIVTYGTLINGYCKAKRVVDGMKLFREISLRGLVANTVTYSTLIQGFCEAGKLNVAKELFQEMVSRGVSPSVVTYGILLDGLCDNGELEEALEILEKMQKCKMGIDIGIYNIIIHGMCNARRVDDAWELFSSLLPLKGVKPDVKTYNVMIGGLCKKGSLSEADKLFKKMGEEDETAPSECTYNTLIRAHLGGSGVATSVELIEEMKRCGFSADASTMKMVIDMLADGRLNKRFLDMLS

SEQ ID NO: 45703 - protein, 277 aa, Staphylococcus epidermidis ATCC 12228
MYIIIKKHRYNELESKELKMKHQFSRNELAIGQEGLNLLKNKTVAVLGVGGVGSFAAEALARTNIGHIILIDKDDVDITNVNRQIHALTSTIGQSKVTLMEERIKLINPDCKVTSLHMFYTEETYKDIFNNYDIDYFIDASDTIIYKVHLMKECLERGIELISSMGAANKTDPTRFEIADISKTHTDPMAKVIRNRLKRLGIRKGVKVVFSDESPIVIREDVKETVGDKNAINRKGQMPPSSNAFVPSVVGLICASYVVNDILKDIPVRRIKDKGQN

SEQ ID NO: 45704 - protein, 542 aa, Zea mays
MSAAQLLRHSRKLRSLQNPVGCENFSFVRHFSSGSGSFIARENGIGKRTRGTRFSQHNQPAKQLETFSAGVNGSCTWRIASNSLTPSAASWLSGSFSCGQVVSARPFSSSADLPPHQEIGMPSLSPTMTEGNIAKWLKKEGDKVSPGEVLCEVETDKATVEMECMEEGYLAKIIHGDGAKEIKVGEVIAITVEEEGDIEKLKDYKPSSSAEPVAPAEPKAEPEPSQPKAEEKKPTQAPEAKTPKIEEASQSGDRIFASPLARKLAEDNNVPLSSVKGTGPDGRILKADIEDYLASVAKGGLRESFADPGLGYVDIPNAQIRKVTANRLLASKQTIPHYYLTVDARVDKLVQLRGELNPLQDASGGKKISINDLVIKAAALALRKVPQCNSSWMNDFIRQYHNVNINVAVQTEHGLFVPVIRDADKKGLGAIAEEVKQLAQKARDNSLKPADYEGGTFTVSNLGGPFGIKQFCAIINPPQSAILAIGSAEKRVIPGSADGQFEFGSFMSATLSCDHRVIDGAIGAEFLKAFKGYIENPTSMLL

SEQ ID NO: 45705 - protein, 192 aa, Picrophilus torridus DSM 9790
MIEFYSKARLPSRFGSFEIYVFKNDENKDHAVIVHGDVRGKSDVPVRIHSECLTGDVLGSMRCDCRDQLIESLKYIGSQPYGMLIYMRQEGRGIGLLNKIRAYNLQDQGLDTVEANLEQGLPVDERKYDYAVDVIKYFNIESIQLITNNPEKLKYLEEHGIKITKRIPIIIPPTKFDEFYLETKRERMGHLF

SEQ ID NO: 45706 - protein, 334 aa, Pediococcus pentosaceus ATCC 25745
MAVLVLGGAGYIGSHAVDRLITKGYDVAVVDNLVTGHRAAVNQQARFYEGDVRDAEFMDSVFTKENVEGVIHFAAFSVVPESMKNPLKYFDNNTAGMVKLLEVMAKHDVKRIVFSSTAATYGEPERVPIQESDPQVPTNPYGESKLAMEKIMHWSDVADGIKFVALRYFNVAGAKPDGSIGEDHQPETHLVPIILQVAAGERDQLQIFGDDYPTADGTNVRDYVHVVDLADAHILALEYLKQGHDSNAFNLGSSTGFSNRQMLEAAREVTGKEIPAVMAPRRAGDPSTLIAASDKAREILGWQPQYDDVKEIIKTAWNWKVNHPAGYDDRGGQA

SEQ ID NO: 45707 - protein, 397 aa, Francisella tularensis subsp. holarctica
MASLNKKIQNVSTSPTNAMAALAKQIKDQGNDVISLAIGEPGFSTPDIIKAAGIEAINKDITKYTNVDGLKELREAIVARYKREYGIEFAADQVCVTSGAKHSLHNIFNCILEAGDEAIFFAPYWVSYPDMIALTGAKPVVVETKFENNFEIDVTDLEKHITAKTKAVIINSPNNPTGLIYSKKCIEDLANLLRKYPNIWIIGDDIYDQLYFKDRVTLITEVAPDLADRYVIASGVSKNFAMTGWRVGFTIAPKLLNDALKKFQSQSATCACSISQYAAITAMNMPAQDLQYFVESYKQKAQFITKYLEAMPYIDVKSAEGTFYLFPDLRKLLEHTNFSTDVELCNALLREEYVAMMPGVAFGLSGFARISCANEMPELEEAMTRVARFINKHVSTK

SEQ ID NO: 45708 - protein, 472 aa, Pediococcus pentosaceus ATCC 25745
MTLEPVKYKKFIAPLVVGVILWLLSPVKPVGVSLAAWHIFAIFVATIIGCITQPLPIGGVAIVGFSITVLTGEVPMDKAITGFGNDSIWLIVMAFFISRGFIKTGLGRRIAFHFVSMFGKKTLGLAYSLIGVDLVLAPATPSNTARAGGIMFPIIESLASAFGSSPKDHTQGKIGSFLLFSEFHGNIITAAMFLTAMAGNPLTQSLAKPLGIHITWMNWFIAGVVPGIISLIVVPLIIYKIYPPEIKETPNAKEWSKKQLDAMGKVSTAEKFMVLTFIVALVLWILGSFLGIDATLTAFIALSLLLVTGVLSWGDVTKETGAWNTLVWFSVLVMMAGQLNELGFIPWLSKTIGTSLHGMNWMLVLVILILAYFYSHYLFASATAHVSAMYGAFLAVAVSSGVPPLLAALMLGFFGDLIGSTTHYGNGPAPILFGSGFVTQKDWWRMNAILGVVYIVIWVGIGSLWMKVIGMW

SEQ ID NO: 45709 - protein, 268 aa, Bouteloua dimorpha
ASYAAAAMPALDVLPEKPHHGWESNGGAAVAPTPAPRRLDGKVAIVTGGARGIGEAIVRLFVKHGARVVIADIDAAVGDALAAALGPQVSCVRCDVSVEDDVKRAVEWAVARHGRLDVLCNNAGVLGRQTRAAKSILSFDAGEFDRVLRVNALGAALGMKHAALAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45710 - protein, 388 aa, Bacillus clausii KSM-K16
MEMFSKSVKKGVAVFALAAVTISLISIFFVQSWRYTEAGKVPPKTAVLLHAVNNRLLPEGKLEAPAFLAVKAPPTIERHQVTVPTRDGEDIPATVYQPIAAGPHPIIVYYHGGAFLEGYGDLDTHDNIIRSLAARTGAIVVAPAYRLAPTYAFPTAVNDSYDALTWAYEHADVLDGDRDRLAVAGDSAGGNLAAAVAIMSGEEGGPALSGQALLYPLATFEDTKFPSRDMYASGFYFLSRAVMEMAQQSYAPNEADWTSPYTSPLNAEDVSMMPSTLVITGEFDPLRDEGEALAKRLYNEGIYVQAQRFNGVMHGFISFYEVMERGDKGLQSAAAFLKEALNKELPEPQNSQPFAVEVIDGRDSWRDEAEAYVIGVYLLFKHMIQVFE

SEQ ID NO: 45711 - protein, 268 aa, Bouteloua dimorpha
ASYAAAAMPALDVLPEKAHHGWESNGGAAVAPTPAPRRLDGKVAIVTGGARGIGEAIVRLFAKHGARVVIADIDAAAGDALATALGPQVSCVRCDVSVEDDVKRAVEWAVARHGRLDVLCNNAGVLGRQTRAAKSILSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45712 - protein, 268 aa, Bouteloua dimorpha
ASYAAAAMPALDVLPEKAHHGWESNGGAAVAPTPAPRRLDGKVAIVTGGARGIGEAIVRLFVKHGARVVIADIDAAAGDALAAALGPQVSCVRCDVSVEEDVKRAVEWAVARHGRLDVLCNNAGVLGRQTRAARSILSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45713 - protein, 504 aa, Solanum tuberosum
MYRATSSRLRALKVRGTNRVLARFLCSTAVATKPSGGLFSWLTGGGSDSLPPLDFPLKDIQLPPPLPDYVEPGKTKITTLTNGLKIASEISASPAASIGLYVDCGSIYEAPASYGATHLLERMAFKSTLNRSHLRIVREVEAIGGNVTAAASREHLIYTYDALKTYVPQMVELLVDSVRNPAFLDWEVSEQLEKVKSEIDEYTKNPQHLLLEAVHSAGYSGPYGNSLAATEATVNRLNSTVLEEFVAENYTAPRIVLAASGVEHEELLKVAEPLLSDLPKVPRAEEPTPVYVGGDYRRQADSGMTHFALAFEVPGGWLKEKDAMTLTVLQMLMGGGGSFSAGGPGKGMYSRLYLRVLNAYPQIHAFSAFSSIYNNTGLFGIQAATTSDFAPRAIEVAVKELTAVANPGEVDMVQLDRAKQSTKSAILMNLESRMVASEDIGRQLLIYGERKPVEHVLKAIDAISANDIASVAQKLISSPLTMASYGDVLSLPTYDVVSSRFHSK

SEQ ID NO: 45714 - protein, 268 aa, Bouteloua dimorpha
ASYAAAAMPALDVLPEKAHHGWESNGGAAVAPTPAPRRLDGKVAIVTGGARGIGEAIVRLFAKHGARVVIADIDAAAGDALAAALGPQVSCVRCDVSVEDDVKRAVEWAVARHGRLDVLCNNAGVLGRQTRAARSILSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHADAVPSDEEVEKMEEVVRGFATLKGPTLRP

SEQ ID NO: 45715 - protein, 574 aa, Photobacterium sp. SKA34
MISGILASPGIAFAKALLLQEEEVVLNKALISADQIDNEIQRFFDARKKSSEQLEVIKEKARVTFGEEKEAIFEGHIMLLEDEELEEEIIALIKDKMSADYAIYSVIEEQAQTLESLDDEYLKERASDIRDIGSRFVKNALGINVINLSAISEEVILVANDLTPSETAQINLDYVRGFITDIGGRTSHTSIMARSLEIPAIVGTNDITSKVKSGDMLVLDAINNQVVINPTDDELNKFKAISDAHKAEQEELAKLKDLPAITLDGKQVEVCGNVGTVKDCDGVNRNGGEGVGLYRTEFLFMDRDSLPTEEEQYQAYKEVAEAMHGEPVIIRTMDIGGDKDLPYLDLPKEMNPFLGWRAIRISLDRREILRDQFRAILRASAHGKIRIMFPMIISVEEVRTLKAVIEEFKVELTAEGLAFDTDIEIGVMVETPAAAAIAHHLAKEVSFFSIGTNDLTQYTLAVDRGNELISHLYNPLSPAVLTVIKQVIDASHVEGKWTGMCGELAGDERATLLLLGMGLDEFSMSAISIPRIKKVIRNANFADVKAMAEHALTLPTAAEIEEHVEKFIAEKTIC

SEQ ID NO: 45716 - protein, 503 aa, Ustilago maydis 521
MTTIQKPQQLSRTTNMMAERVHWSGGQRGTGLKTDDRSFTYLQRLTFTANPKPPAAGSGVYNVGGKQPTHMCQADRGCTDTTLVHGARKREEHQSGLALARTGAPVPSGDSNVREMVAQPSMFSLGDRTQEQPTMLERRESSMIEEQLPSFMQVDQTEHKHRHHYRAALRRRLVLKNNVIAFVSEFIGTVLFLLFSFIIASQASNAQAATQRDSEATSLAQNAPVDTSALLFSSLGFGFSLAVNAWTFYRVSGGLFNPAVTLALFLTGTLGKLQLVHLTIAQFAGGIAAAALADGLLPGRLNARTTLANGTSVVQGFLFEFFLTSQLILAIFLLAAEKHRGTFLAPVGIGLALFLAELAGTNYTGGSLNPARTLGPNTVLATFQQYDWIYWIAPYSAAIVTSGFYMLLKYLQYESANIGQDSDDTKQVFKDTYGNVVGVLETMAASEFSFVSQVAPPAEAEIQALVNIDPSKPALTAARTKMPTQNQKAAANLGPATVHNNLA

SEQ ID NO: 45717 - protein, 525 aa, Photorhabdus luminescens subsp. laumondii TTO1
MTTNIHQHRILILDFGSQYTQLIARRIREIGVYCELWAWDVTEEQIREFNPSGIILSGGPESTTAQGSPRAPEYVFNAGVPVLGVCYGMQTMSVQFGGKVEDSTEREFGYAQVEIKAESALFRGIQDSLNEQGKPSLDVWMSHGDKVTAIPEDFITIASTDTCPFAIIANEEKRFYGVQFHPEVTHTHQGQRILERFVLDVCQCEALWTPASIIEDTVVRLREQVGEDHVILGLSGGVDSSVTALLLHRAIGNRLTCVFVDNGLLRLNEATQVMEMFAGKFGLNIVHVPAEDRFLTALAGINDPEEKRKTIGRVFVEVFDEEASKQAQVKWLAQGTIYPDVIESAASATGKAHVIKSHHNVGGLPEEMKLGLVEPLKELFKDEVRKIGLELGLPYDMLNRHPFPGPGLGVRVLGEVKKEYCDLLRQADAIFIEELHKADLYNKVSQAFTVFLPVRSVGVMGDGRKYDWVVSLRAVETIDFMTAHWAHLPYDFLGRVSNRIINEVNGISRVVYDVSGKPPATIEWE

SEQ ID NO: 45718 - protein, 764 aa, Vitis vinifera
  misc_feature (210)..(210): Xaa can be any naturally occurring amino acid
MAILSDLGTEILVPACAIVGIVFSVVQWILVSRVKLSPERHSLSNSSKNGTAEYLIEEEEGLNDHSVVQKCAEIQNAISEGATSFLYTEYQYVGIFMVAFAILIFVFLGSVEGFSTKSQPCLYNKGEMCKPALANAIFSTISFLLGGLTSLLSGFLGMKIATYANARTTLEARKGVGKAFITAFRSGAVMGFLLAANGLLVLYIAINLFXIYYGDDWEGLYEAITGYGLGGSSMALFGRVGGGIYTKAADVGADLVGKVERGIPEDDPRNPAVIADNVGDNVGDIAGMGADLFGSYAESSCAALVVASISSFGINHEMTAMFYPLIISSIGILVCLITTLFATDFFEIKAVKEIEPALKKQLIISTILMTAGIAFVSWIALPSSFTIFNFGSQKVVKNWQLFLCVGVGLWAGLIIGFVTEYYTSNTYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGTLLGVETLAGVLAGSLVSGVQIAISASNTGGAWDNAKKYIEAGASEHAKALGPKGSDPHKAAVIGDTIGDPLKDTSGPSLNILIKLMAVESLVFAPFFAAHGGLLFKIWK

SEQ ID NO: 45719 - protein, 309 aa, Brassica rapa
MGSSVEQNILVTGGAGFIGTHTVVQLLKEGFKVSIIDNLDNSVIEAVDRVRELVGPDLSKKLEFTQGNRFDAVIHFAGLKAVGESVGNPRRYFDNNLVGTINLYETMAKHNCKMMVFSSSATVYGQPEKIPCMEDFELKAMNPYGRSKLFLEEIARDIQAAEPEWRIVLLRYFNPVGAHESGRIGEDPKGIPNNLMPYIQQVAVGRLPELNVYGHDYPTEDGSAVRDYIHVMDLADGHIAALRKLFDDPKIGCTAYNLGTGRGTSVLEMVAAFEKASGKKIPIKLCPRRLGDATAVYASTEKAEKELGW

SEQ ID NO: 45720 - protein, 505 aa, Salinibacter ruber DSM 13855
MLFLRVAAESHLWTSLPSFSPPVRSPAFLPMPMWHDSVLGTIGDTPLVRLNEIGSDLPPTILAKVEFFNPGGSVKDRIGRALIEEAEKEGRIEPGGTIIEGTSGNTGAGLAITAIAKGYRCIFTTTDKQSQEKVDVLRGLGAEVLVCPTNVEPDDPRSYYSVARRLSEEIPNSIYLNQYDNPANAKAHYETTGPELWEQTEGQITHFVAGAGTGGTISGTANYLKEQDDDISVIGVDPCGSVFHKYFHEGVFDEDEIYPYFTEGVGEDILPDNMDFDIVDDFVEVNDKASMQMTRRLAREEGLFIGQSCGLAVAGTLQWVKAHRDELTPDDVVVVLLPDSGFRYLSKTYNDDWMQNHGFLEKSPDVTADKVLNVQQEETDVIAAAPDDNLGNVIETMTDQGISQMPVLDADQEVVGSITETRVLNELIEDPESRKAPVREIMGTPFPVVPASLHLEHLSAYLEEDAGAVLVDHGPESQGSYSILTKSDLISALADVGQSNGNGAA

SEQ ID NO: 45721 - protein, 301 aa, Thermus thermophilus HB8
MGGEALTLPKDLLDFSGYGPKELQALLDLAEQLKRERYRGEDLKGKVLALLFEKPSLRTRTTLEVAMVHLGGHAVYLDQKQVGIGEREPVRDVAKNLERFVEGIAARVFRHETVEALARHAKVPVVNALSDRAHPLQALADLLTLKEVFGGLAGLEVAWVGDGNNVLNSLLEVAPLAGLKVRVATPKGYEPDPGLLKRANAFFTHDPKEAALGAHALYTDVWTSMGQEAEREKRLRDFQGFQVNGELLKLLRPEGVFLHCLPAHYGEETTEEAVHGPRSRVFDQAENRLHTAKAVLLTLLK

SEQ ID NO: 45722 - protein, 759 aa, Photorhabdus luminescens subsp. laumondii TTO1
MDEKLKQSALDFHQFPQPGKITITPTKPLITQRDLALAYSPGVAAPCLEIAEDPLAAYKYTARGNLVAVISNGSAVLGLGNIGALAGKPVMEGKGVLFKKFSGIDVFDIEVDESDPDKLIDIIAALEPTFGGINLEDIKAPECFYIEKKLREKMNIPVFHDDQHGTAIICTAAVLNGLRIMKKEISAVRLVVSGAGAASIACMNLLVALGLQRKNIVVCDSKGVIYRGRDKNMEETKAAYAIEDNGSRTLGDVIPGADIFLGCSGPGVLTQDMVKMMAKDPLIMALANPEPEILPPLAKQVRPDAIICTGRSDYPNQVNNVLCFPFIFRGALDVGATTINEEMKLACVHAIADLALAEQSEEVASAYDDQDLFFGPEYIIPKPFDPRLIVKIAPAVAKAAMDSGVATRPIKDFGAYIEKLNEFVYKTNLFMKPIFSQAKKAKKRIVLAEGEEVRVLHATQELISLGLAYPILIGRPSVIEMRIQKLGLHIEAGKDFEVVNNENDPRFKKYWQEYHHIMKRRGVSAEQARRAVIGNPTLIGAIMVLRGEADGLICGTVGSYSEHYDVVRNVFGFRDGVHTAGAMNALMLPSGNTFIADTYVNNDPTPEQLAEITLMASETIRRFGIEPKVALLSHSSFGSTDCLSAQKMRQTLELVNKMSPSLEIDGEMHGDAALVESIRRDIMPDSPLKGAANLLIMPNMESARISYNLLRVTSSEGVTVGPVLMGVAKPIHILTPISSVRRIVNMVALAAVEAQTHPL

SEQ ID NO: 45723 - protein, 479 aa, Escherichia coli
MSVPVQHPMYIDGQFVTWRGDAWIDVVNPATEAVISRIPDGQAEDARKAIDAAERAQPEWEALPAIERASWLRKISAGIRERATEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 45724 - protein, 348 aa, Brassica rapa
MTLMMRRRLITLHPRFMETGTLKTFRHEFLSCCERDFSCLNRSDRNLSYRERLSSGIADIKKDDAVDLFQSMIRSRPLPSIIDFSRLFSAVAKTKQYELVLSLCKQMELQGIAHSIYTLSIVINCFCRRRKLGFAFSVLGKILKLGYEPDTVTFSTLVNGLCLEGRVSEAVVIVDRMVEMKVRPNLVTLNTLVNGLCLKDQVSEAEALVDRMVEHGCQPDQFTYGPILNRICKSGNTVSALDLLRKMEDKKVKPQVVTYNMIIDSLCKNGNYDEALSLFNEMEREGIKADVITYNSLIGGFCNAGRWDDGAQLLRDMITRNITPNVVTFSALIDCFVKEGKLINEHRR

SEQ ID NO: 45725 - protein, 172 aa, Staphylococcus epidermidis ATCC 12228
MDLKQYVSEVKDWPSAGVSFKDITTIMDNGEAYGYATDQIVEYAKEKNIDIVVGPEARGFIIGCPVAYSMGIGFAPVRKEGKLPREVIRYEYNLEYGTNVLTMHKDAIKPGQRVLITDDLLATGGTIEAAIKLVEQLGGIVVGIAFIIELKYLNGIDKIKDYDVMSLISYDE

SEQ ID NO: 45726 - protein, 445 aa, Gibberella zeae PH-1
MTSTTPPKLNALEILDLRSSPPAFTTPSKRINEGSDVARFLTSLAYRDIGVFILQLNRALCPRNQSSSPLPRTFPLNSKPATTPSVQTLQALLAKIGSFIDEAPPDPGPRRFGNVSFRKWHAIFEERLSELLDEGLLGETLKVGDGKAKEEVSLYLLGGFGSVQRLDYGTGHELSFVAFLGCLWKLGFFKDGEQGGEIEREIVLKIIEPYLNVVRKLILTYTLEPAGSHGVWGLDDHSFMPYIFGSAQLTRPINENEPMPLEGSVKGAPKPSDVTKAVVVEDQRQVNMYFSAIGFINDVKKGPFWEHSPILFDISGIRDGWGKINKGMIKMFNAEVLSKFPVVQHFPFGSLFSWDVDPDATTPTQSVHMVNQPAMAAPTPSGPGTSAPWAQATRMPPSGPGIPYSRMPPPGPNSGSLARPPRNTSGTGSTDAQITVTKAPWARDS

SEQ ID NO: 45727 - protein, 277 aa, Brassica rapa
LYNEMVPRGIDPDTITYTSLIYGLCMENRLDEANQMMDLMVSKGCEPSIVTYGTLINGYCKAKRVVDGMKLFREISLRGLVANTVTYSTLIQGFCEAGKLNVAKELFQEMVSRGVSPSVVTYGILLDGLCDNGELEEALEILEKMQKCKMGIDIGIYNIIIHGMCNARRVDDAWELFSSLLPLKGVKPDVKTYNVMIGGLCKKGSLSEADKLFKKMGEEDETAPSECTYNTLIRAHLGGSGVATSVELIEEMKRCGFSADASTMKMVIDMLADGRLT

SEQ ID NO: 45728 - protein, 443 aa, Oryza sativa Indica Group
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNSNGLDIAKLMKHSSENRGIKGFDGGDAIDPRSLLTEECDVLIPAALGGVINKDNANEIKAKYIIEAANHPTDPEADEASTSDSIWQTNTPTATKCTICLKCFLSEFLLQILSKKGVLILPDILANSGGVTVSYFEWVQNIQGFMWDEEKVNNELKTYMTRGFRDVKEMCRSHHCDLRMGAFTLGVNRVARATVLRGWEA

SEQ ID NO: 45729 - protein, 271 aa, Brassica rapa
LCRLVYLKGVDDLQGDLRNKGDIEKLFSKQRYCSLLNSSLCSAVGESVGNPRRYFDNNLVGTINLYETMAKHNCKMMVFSSSATVYGQPEKIPCMEDFELKAMNPYGRSKLFLEEIARDIQAAEPEWRIVLLRYFNPVGAHESGRIGEDPKGIPNNLMPYIQQVAVGRLPELNVYGHDYPTEDGSAVRDYIHVMDLADGHIAALRKLFDDPKIGCTAYNLGTGRGTSVLEMVAAFEKASGKKIPIKLCPRRLGDATAVYASTEKAEKELGW

SEQ ID NO: 45730 - protein, 394 aa, Pediococcus pentosaceus ATCC 25745
MNGISNYKKLLAASGVAWLFDAMDVGILSFVIAALTSEWHLTESQVGMIGSISSLGMAVGAILFGALADRYNRKTILIISLLIFSIFNGISAFTTTYAAFVMIRFIVGCGLGGELPVASTLISESAPAHVRGRAVVLLESFWAGGWLISALISYFIIPSWGWRIAVFITSLAALYALVLRFSIREADSNHSFTPKARLALRLKNIWSRPYAKATLMLWIVWFMVVFSYYGMFLWLPSVMVMKGYSIVHSFGYVLIMTVAQLPGYFMAAWLIERWGRKWTLMVFLFGTAVSAIAFGFAQGLMMLLLAGILLSFFNLGAWGALYAYSPEQYPEEIRGTGSGLAAGIGRIGGIVGPLLVGFLTEKGVALSTTFIIFFISIMIAVIAIGFLGKETMEK

SEQ ID NO: 45731 - protein, 342 aa, Mesorhizobium sp. BNC1
MRALQLVADRKLEIADVSPPPPPGHGEVTLRISAVALNHIDVWGWRGMAFAKRKLPLTVGAEASGRVDAVGPGVSNLVPGQLVSIYGARTCGLCRPCREGRDNLCEHVGGVHGFHLDGFAQEKINLPARLLVPAPPGVDEIGAAVAPVSFGTVEHMLFDNAKLEPGETILVHAGGSGIGSAAIQLAKRMGCTVLTTVGSNEKIERAKALGADHVINYREDRFEGAVRKITKKRGVDVVFEHVGADTWAGSMLCLKRGGRLVTCGSTSGVSTNMNLMQLFQQQLKILGSFGCRMENMADAMQKMAAGIVAPVIDTEVGFEAIDTALKRMEGRDVFGKIILRVG

SEQ ID NO: 45732 - protein, 448 aa, Burkholderia mallei ATCC 23344
MTTVFHRAPRASLPIAVAGDGIEIVDSTGKRYIDACGGAAVSCLGHSNQRVIDAIKRQAQQLPYAHTSFFTTQPAEALADRLVAAAPAGLEHVYFVSGGSEAIEAALKLARQYFVEKGEPARRHFIARRQSYHGNTLGALAIGGNAWRREPFVPLLIEAHHVSPCYAYREQRADETEEAFAQRLADELESRILALGPDTVAAFVAETVVGATAGAVPPVREYFRKIRAVCDKYGVLLILDEIMSGMGRTGYLFACEEDGVAPDLLTIAKGLGAGYQPIGATLVSDAIYRTIVDGSGFFQHGHTYVGHASACAAALEVQRVIDEERLLENVKARGEQLRASLAARSAEQPHIGDVRGRGLFVGVELVRDRDTKAPFDPRLKLNALVKREAMQRGLMVYPMGGTVDGHLGDHVLLAPPFICTAPQIDTIVERLGDAIDAALASIGAAALR

SEQ ID NO: 45733 - protein, 265 aa, Capsicum annuum
KVVSRNSTTPNGLGIFNYYPNHPRRYPPTVPPPGPRWNDVAPRVAQSVAIKSHKDFIHAPPQTSMLNTQNRVNGFTRWSVNNVSFNMPHTPYLIALKHNLLHTFEQIPPPDNYDHENYDIFNIAKNVNATTSNSIYRLKFNTSVDIILQNANTMNPNNSETHPWHLHGHDFWVMGYGNGKFNQSIDPKNYNLVNPIMKNTIPVHPYGWTALRFRADNPGVWAFHCHIESHFFMGMGVVFEEGIEKVGKLPTNIMGCGESKRYHKP

SEQ ID NO: 45734 - protein, 268 aa, Bouteloua dimorpha
ASYAAAAMPALDVLPEKPHHGWESNGGAAVAPTPAPRRLDGKVAIVTGGARGIGEAIVRLFVKHGARVVIADIDAAAGDALAAALGPQVSCVRCDVSVEDDVKRAVEWAVARHGRLDVLCNNAGVLGRQTRAAKSILSFDAGEFDRVLRVNALGAALGMKHAALAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45735 - protein, 87 aa, Arabidopsis thaliana
  misc_feature (24)..(24): Xaa can be any naturally occurring amino acid
  misc_feature (34)..(34): Xaa can be any naturally occurring amino acid
  misc_feature (51)..(52): Xaa can be any naturally occurring amino acid
  misc_feature (66)..(66): Xaa can be any naturally occurring amino acid
MDSYSSPPMGGSGSSVSPEVMMEXVKTQLAQAYXEELIETLRTKCFDKCVXXPGSSLGGSESSCIXRCVERYMEATAIISRSLFTQL

SEQ ID NO: 45736 - protein, 124 aa, Burkholderia xenovorans LB400
MAIAKEDILEAVSSMSVLELNELVKAFEEKFGVSAAAVAVAGPAGGGAAAAAEEQTEFTVNLTEVGANKVSVIKAVRELTGLGLKEAKDLVDGAPKPVKESVPKAAAEEAKKKLEEAGAKAEIK

SEQ ID NO: 45737 - protein, 485 aa, Mesorhizobium sp. BNC1
MLKKTSHFLREANFIAGEWVNADSGATIEVINPATRQTIGTVPKCGRAETRRAIEAAQEAFQSWKKTSANDRAKLLRKLHDAIMDNQDALAELLVMEQGKPLAEAKGEVGTSAAYILWFAEEGRRIYGDIVPAPWTDRRILVTKEPVGVIGAITPWNFPSSMLARKLGPALAAGCTTVAKPASQTPYSGLAWGVLAEEAGFPKGVVNIVTGSASEIGDELTENPLVRKITFTGSTEIGKLLMEKAAGTVKKVSMELGGNAPFLVFDDADLDRAVKGAMIAKYRNAGQTCVCTNRFFVQDGIYDRFLEKFVEASRKLKVGSGLDEGVEQGPLIDGGAVEKVEELIADAVSKGGKVVTGGKRHALGGSYFEPTVIAEATPQMRFMEEEIFGPVAPVFRFKDEADGIRMANDTSFGLACYFYTSDLGRAFRVMEGLKYGLVGVNEGLITTVEAPFGGLKESGLGKEGGRQGIEDYLDTKYVCIGGLGL

SEQ ID NO: 45738 - protein, 383 aa, Listeria monocytogenes str. 1/2a F6854
MMNHSKIAKKHQQMPVNILADIGTLAKTMPDILDLSIGDPDLITDESIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDDFAINVDILEAAITDKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPTPSQRAAIYALNHSETLIPLVAETFQKRLEYIAKRVEKIPYLSLHPLKGSIYAFINISKTNMDSVSFTEYVLKETQVLVIPGLAFGESGDNYVRLAATQDISVLEEAFNRLAKLTF

SEQ ID NO: 45739 - protein, 1017 aa, Sinorhizobium meliloti 1021
MNDMLKTTPDFTTEEAQALLKQHFGVDGSLQPLDSERDQNFKVNTGEGRCYILKIVNGAEPEIESDFQTALLKHAGENAGDLPVPHLQPTLSGANLAATTRRGMVHRLRLVTWVPGTPLAQSDRSDGALHSLGRMLGRFDASLKGFMHPGALRDLDWDIRNAGRSAGRLAHVADLQDRALLQRFLDRFDERVAPRLPMLRSAVIHNDANDWNVLIDEDDRDRISGIIDFGDALYAPVIAEVAIAAAYAGLDHPDPIGAAAAIANGYHAEYPLLEEEVDLLFDLIAMRLVTSVTISASRRAHTADNPYLAISERPAWALLRKLDAMNPRFATAILRKACGFETVAGAHAVASWIGENRKSLLPLLDRPAATYPAALVPYGDPTHPMTVSSADGRPHDARSVWEEHCRTTGVELGIGPWGEARTVYSGEMFVSRLIEETRRTRHLGLDLFMAAGTKVHTPLAATVASVEIEKDPLGYGCLIALRHEPDGCPPFLTLWGHLAHEAVGRLKAGDRLEAGALVGEMGAPEENGGWAPHLHLQISTDTSLAATDILGVGEERYLDVWAELFPDASTFAGIAREFYDQSGRPHEEIIRRRKELLLPNLSISYEKPIKFVRGEGVWLIDDRGRAYLDCFNNVCHIGHAHPAVVEALARQAGTLNTNTRYLHDNIVAYAERLTATMPKELAVAAFANSGSEANSLALRLMRAHTGCENAVVLDWAYHGTTQELIDLSAYKFRRKGGKGQKPHVHVAAVPDSYHAPAAWPLEEHGKRFAENVAELIAAMRARGEAPGFFLAESIPSVAGQVFLPDGYLKEVYRMVREAGGVCIADEVQVGFGRVGSHWWAFETQGVVPDIVTMGKPIGDGHPLAAVVTTREIAASFDNGMEYFNTFGGNPVSCAVGLAVLDVIEGEDLRRNALDIGNHLLTAFRTMQERYEVIGDVRGLGLFLGIELVSDRRTRAPATEIARAVANGARQRGVLMGTEGPHDNVLKMRPPMIFSKRDADHLIAVLEETFGAVLAQAG

SEQ ID NO: 45740 - protein, 474 aa, Thermus thermophilus HB8
MPPFKRTKIVATLGPATDDKEVIRALAEAGADVFRLNFSHGAPEDHRRRVGWVREVAEELGRTLAVLQDLQGPKIRVGRFREGQVLLRPGQRFVLTAEPVEGDEHRVSVSYKGLPEDVSPGQILLLDDGRIRLKVLEVRSPEILTEVEVGGVLSNNKGINIPGADLSIPALSEKDIQDLALGAELGVDWVAVSFVRTRDDLLLARHYLSRYGSKARLMAKIEKPSAVARFEEILEEADGIMVARGDLGVEMPLEEVPIVQKRLILRCIAAGKPVITATQMLESMVQNPSPTRAEASDVANAIFDGTDAVMLSAETAAGAYPVEAVAMMARIAKAVESSPEFLQKLNVLRPAPTPTTQDAIAQAADDVVEAVGARAIVVFTATGGSARRIARTRPQVPILALTPNPEVRNQLALVWGVYPHLAPDPQDTDDMVRIALREVKALGLAQVGDRVVIAAGVPFGVRGTTNLIRVERVG

SEQ ID NO: 45741 - protein, 537 aa, Vitis vinifera
  misc_feature (140)..(140): Xaa can be any naturally occurring amino acid
  misc_feature (146)..(146): Xaa can be any naturally occurring amino acid
  misc_feature (381)..(381): Xaa can be any naturally occurring amino acid
MESLCLSATAFPPVRPIKHVPIATTRKPFIRATICNPVPLTVTYSETSSPPLRRVSPDSLQYEEGYLGAVPAGRVDESREGVVKAMRYLTNILSSKVYDISTESPLHQTSLHPSPVPPLKRVSSDSLQYQPGCIGAVPDXTIHDGXDGVVGAMEYLTNILSSKVYDVAIESPLQLAPKLSERLGAQIWLKREDLQPVFSFKLRGAYNMMAKIPKEQLERGVICSSAGNHAQGVALAAKRLGCNAVIAMPWKSVERLGATVVLVGDSYDEAQAYAKQRGEEECRTFIPPFDHPDVIMGQGTIGMEIVRQMQGPLDAIFVPVGGGGLIAGIAAYVKRVSPEESEAGTPTISLQALIIISFVQVKIIGVEPCDANAMALSLHHXQRVMLDQVGGFADGVAVKVVGEETFRLCRELIDGIVLVSRDAICASIKNMFEEKRSILEPAGALALAGAEAYCKYYGIKGGNIVAITSGANMNFDRLRLVTELADVGRQREAVLATLLPEEPGSFKQFCEMVGHMNITEFKYRYNPHKEKALVLYR

SEQ ID NO: 45742 - protein, 268 aa, Bouteloua dimorpha
ASYAAAAMPALDVLPEKAHHGWESNGGAAVAPTPVPRRLDGKVAIVTGGARGIGEAIVRLFVKHGARVVIADIGAAAGDALATALGPQVSCVRCDVSAEDDVKRAVEWAVARHGRLDVLCNNAGVLGRQTRAAKSILSFDAGEFDRVLRVNALGAALGMKHAAQAMAPRRAGSIVSVASVAGVLGGLGPHAYTASKRAIVGLTKNAACELGAHGIRVNCVSPFGVATPMLVNAWRHGHAAAVPSDEEVEKMEEVVRGFATLKGPTLRP

SEQ ID NO: 45743 - protein, 507 aa, Aspergillus oryzae
MASFTLVSAYAAAGLLAIIVLNLLRQLLFRNKTDPPLVFHWIPFLGSTVTYGMDPYAFFFSCRQKYGDIFTFILLGRKITVYLGIQGNEFILNGKLKDVNAEEIYSPLTTPVFGSDIVYDCPNSKLMEQKKFIKFGLTQAALESHVPLIEKEVLDYLKTSPNFKGTSGRVEITDAMAEITIFTAGRALQGEEVRKKLTTEFADLYHDLDRGFTPINFMLPWAPLPRNRKRDAAHARMREIYMDIINERRKNPDRETSDMIWNLMHCTYKNGQPLPDKEIAHMMITLLMAGQHSSSSISSWIMLRLASEPAVMEELYQEQITKLSPDGRTLPPLQYRDLDLLPLHQNLIKETLRLHLSIHSLMRKVKNPMPVPGTPYVVPADHVLLASPGVTALSDEYFPNASRWDPHRWENRVEKEDEEDIVDYGYGTVSKGTSSPYLPFGAGRHRCIGEKFAYVNLGVIVATMARHMKLFNVDGKKGVPATDYSSMFSGPSKPAIIGWERRFPEKS

SEQ ID NO: 45744 - protein, 268 aa, Bouteloua dimorpha
ASYAAAAMPALDVLPEKAHHGWESNGGAAVAPTPVPRRLDGKVAIVTGGARGIGEAIVRLFVKHGARVVIADIDAAAGDALAAALGPQVSCVRCDVSVEEDVKRAVEWAVARHGRLDVLCNNAGVLGRQTRAARSILSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45745 - protein, 615 aa, Thermus thermophilus HB8
MILDKVNSPEDLKRLSLEELLLLAEEIRSEIIRVTAQNGGHLASSLGAVELVLALHRVFDSPRDRILFDVGHQAYAHKLVTGRKDRFHTLRKEGGISGFTKVSESPHDAITAGHASTSLANALGMVLARDLMGEDYHVVAVIGDGALTGGMALAALNKIGELQKRMLIVLNDNEMSISENVGALNKYFKELQIRKWVQDAEKLGKNILERISPQLFGLVDRAKEAAKFLLHQENPFYAWGIRYVGPVDGHDLKGLVHILEHLKALDGPTLLHVVTKKGKGYKVAEADPIYWHGPPGFDPKKPEKVSKGYTWSQAFGDAVTELAHMEPRLFVLTPAMREGSGLVRYSLEHPERYLDVGICEDVAVTTAAGLALRGMKPIVAIYSTFLQRAYDQVIHDVAIENLPVVFAIDRAGIVGADGATHHGVFDIAYLRTVPNLQIAAPKDALELRAMLKKALEVGGPVAIRYPRDNVERAPEGVWPEIAWGKWEVLKEGTEAYILAFGKTLRYALEAAGDDPRVGVVNARFLKPLDREMLRELSRYKLLTVEDHQKMGGFGSAVLEALNEMGLKPEVQILGLPDRFFEHGAIPSLHRQAGIDAEGIRKALAAMGVALVHERA

SEQ ID NO: 45746 - protein, 268 aa, Bouteloua dimorpha
ASYAAAAMPALDVLPEKAHHGWESNGGAAVAPTPAPRRLDGKVAIVTGGARGIGEAIVRLFAKHGARVVIADIDAAAGDALATALGPQVSCVRCDVSVEDDVKRAVEWAVARHGRLDVLCNNAGVLGRQTRAAKSNLSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45747 - protein, 566 aa, Saccharomyces cerevisiae
SSATVYGDATRFPNMIPIPEECPLGPTNPYGHTKYAIENILNDLYNSDKKSWKFAILRYFNPIGAHPSGLIGEDPLGIPNNLLPYMAQVAVGRREKLYIFGDDYDSRDGTPIRDYIHVVDLAKGHIAALQYLEAYNENEGLCREWNLGSGKGSTVFEVYHAFCKASGIDLPYKVTGRRAGDVLNLTAKPDRAKRELKWQTELQVEDSCKDLWKWTTENPFGYQLRGVEARFSAEDMRYDARFVTIGAGTRFQATFANLGASIVDLKVNGQSVVLGYENEEGYLNPDSAYIGATIGRYANRISKGKFSLCNKDYQLTVNNGVNANHSSIGSFHRKRFLGPIIQNPSKDVFTAEYMLIDNEKDTEFPGDLLVTIQYTVNVAQKSLEMVYKGKLTAGEATPINLTNHSYFNLNKPYGDTIEGTEIMVRSKKSVDVDKNMIPTGNIVDREIATFNSTKPTVLGPKNPQFDCCFVVDENAKPSQINTLNNELTLIVKAFHPDSNITLEVLSTEPTYQFYTGDFLSAGYEARQGFAIEPGRYIDAINQENWKDCVTLKNGETYGSKIVYRFS

SEQ ID NO: 45748 - protein, 413 aa, Oryza sativa Japonica Group
MGNCGTREENAVVAAHAQVQQLHLLQHPVKNAVAERKHTRISSDMSDPSTPRKIEDAKNISIYNDVIDFTLFELETITRSFRADYVLGEGGFGTVYKGYIDENVRVGLKSLPVAVKVLNKDGHQGHREWLTEVRFLGQLRHPNLVKLIGYCCEDDHRLLVYEFMFRGSLENHLFRRTATPLSWATRMSIALGAAKGLACLHNAERPIIYRDFKTSNILLDSDYTAKLSDFGLAKAGPEGDQTHVSTRVMGTYGYAAPEYVMTGHLTARSDVYSFGVVLLELLTGRKSIDKSRPSREHSLVDWALPKLNDKRRLLQIIDPKLEGQYSVRAAHKACSLAYYCLSQNPKARPLMSDVVETLEPLQGSGGSDGAVQSVLGSGLPSYRVNRRLMTNRVHCRALPNPKCSPAVPACRVR

SEQ ID NO: 45749 - protein, 412 aa, Escherichia coli O157:H7 EDL933
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEIGKTLTLEQLKAENRAVLVTVGLSSGSGLPLFEHSDVEIAVDFLLRARQAQGDISIPQSALIIGGGDVAMDVASTLKVLGCQAVTCVAREELDEFPASEKEFASARELGVSIIDGFTPVAVEGNKVTFKHVRLSGELTMAADKIILAVGQHARLDDFAKLEPQRNTIKTQNYQTRDPQVFAAGDIVEGDKTVVYAVKTGKEAAEAIHHYLEGACSC

SEQ ID NO: 45750 - protein, 467 aa, Thermoplasma acidophilum
MLYGVCRRKHLIIDGYLFSMIMEDQERTERYNEDALRYSEYFKGKIQTISKVPVRSLDDFSIWYTPGVAAVSRKIASDPDLSFELTGRWNSIAILTDGTRVLGLGNIGPEAAMPVMEGKALIFNYLGGVNAIPIPIRVQSKEEFVKVAKALEPSFGGINLEDIESPKCFFLLETLQNEMNIPVWHDDQLGTASITLAGVINSLRIVGKKIDQVKVVFNGAGAANIAAAYLFKAAGFKMKNMILVDSKGILHPEREDIDALMINNPWKYQLAIETNGERVKGDLSNAIEGADLLISAAKSGPDTIDSRIVKKMNNDAIVFVLANPIPEMWPQEAKENGARIVATGRGDFPNQINNSLVFPGVFRGVLDARAKGVNFDVMVAASYEIANFVEDPTEEKIVPTMEEWELYPRLASAVASKTVELGLARKSDSKEGFYRRAREIIESNRNIYSKLMDLGLIKRMPNGEHKN

SEQ ID NO: 45751 - protein, 516 aa, Oryza sativa Japonica Group
MDMLLCFVEIFSILCCCIIYYYHLQTKKASASEPTEWPVLGHLFGMFANIHRFHDWATDILAGGWHNFEARAGLTGIRFFITCDPSNVRHIFTSNFANYPKGDEYAEIFDVLGNGIFNADGESWRSQRAKAQMLMAGARFRAFAARSSRDKAEKSLLPLLAHAADTGARCDLHDLFLRLTFDVTCTLVFGVDTGCLSAGLPVIPFARAMDDVLETLFLRHIIPMSCWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRATMASC

SEQ ID NO: 45752 - protein, 492 aa, Synechococcus sp. CC9311
MNNGRKSTMAERFSQQNQRVRPSSKEDQVVQKAKEHFERTLIPIAGSLAGSVAALQHPRDDEALNYGEIFLRDNVPVMVYLLTQKRFKVVKQFLKICLDLQSTTYQTRGVFPTSFVEENGELIADYGQRSIGRITSVDASLWWPVLCWMYVKASGDEQFGSTPGVQRGVQLLLDLVLHPTFEGTPVLFVPDCAFMIDRPMDVWGAPLEVEVLLYASLRCCSQLMELGLRNQSSRLLDQRLVLTRQWIHDLRKFLLKHYWVTSKTMQVLRRRPTEQYGDNQHQNEFNVQPQVIPDWLQDWLENRGGYLIGNIRTGRPDFRFYSLGNSLGCLFGLLTAPQQRALFRLTLHNRNHLMAQMPMRICHPPMETLEWQNKTGSDPKNWPWSYHNGGHWPSLLWYFGASILLHERRHPNADILLMGQMKAMLEDCYWSQLNQLPRQQWAEYFDGPTGTWMGQQSRTYQTWTIVGFLLLHHFLRVNPDDVDMLDLDGPSG

SEQ ID NO: 45753 - protein, 616 aa, Synechococcus elongatus PCC 7942
MAIALTDKVRNGRAADHIVMALIVQKYGGTSVGSVERITAVAQRIAQTVAAGNQVVVVVSAMGHSTDELLKLANAISANPSRRELDMLLATGEQVSIALLSMALHEQGCDAISMTGAQVGIITEAHHSRARILEIDPQRLQSQLDAGRVVVVAGFQGIASSDRTALTEITTLGRGGSDTSAVALAAALNADRCEIYTDVPGILTTDPRLVPEAHLLEEITCDEMLELASLGASVLHPRAVEIARNYGVRLVVRSSWTQEPGTGVVAPPRRSDRSLQGLEIGRPVDGLALDTDQAKVALLHVPDRPGIAASLFGEMAQRGVNVDLIIQSIHEGNSNDISFTVSQADLEKAEAGTTQLLADLGGEQQSEAAVAKVSISGVGIVGRPGIAAQMFSALAQGGINIQMISTSEVKVSCVIAAADQQRAIAALQESFELEEAIAATATDACTTDLPAVRGVALDRDQARLAILNVPDLPGMAATIFQILADRQISVDMIIQSQRGRIHNGQPCRDIACTLPPADAELAAAALQAFADQHGCSLEIQTEIAKVSIVGSGMVQQPGVAAQMFAALANHGINIHMIATSEIKVSCIVDASQAVEALQTVHAAFGLASDRRIEVPA

SEQ ID NO: 45754 - protein, 517 aa, Zea mays
DIEFTVQESRLWMLQCRTGKRTGKSAVKIAVDMVNEGLVERRAAIKMVEPGHLDQLLHPQFENPSAYKDQVIATGLPASPGAAVGQVVFTAEDAETWHSQGKSVILVRAETSPEDVGGMHAAAGILTERGGMTSHAAVVARGWGKCCVSGCSGIRVNDAEKVVKIGGNVLREGEWLSLNGSTGEVILGKQPLSPPALSGDLGTFMSWVDDVRKLKVLANADTPEDALAARNNGAEGIGLCRTEHMFFASDERIKAVRQMIMAPTVELRQQALDRLLPYQRSDFEGIFRAMDGLSVTIRLLDPPLHEFLPEGNVEEIVRELCSETGANQEDALARIEKLSEVNPMLGFRGCRLGISYPELTEMQARAIFEAAIAMTNQGVQVFPEIMIVVPLQFKIMTKIHLIAEQAEFFSFGTNDLTQMTFGYSRDDVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 45755 - protein, 536 aa, Mycobacterium bovis AF2122/97
MFDTGHQTYPHKLLTGRGKDFATLRQADGLSGYPNRHESPHDWVENSHASVSLAWVDGIAKALALQGQCDRRVIAVIGDGALTGGVAWEGLNNLGAATRPVIVVLNDNGRSYDPTAGALAAHLEELRVGTPRGPNLFENMGFTYIGPVDGHNIPDTCAVLRKAAAAARPVVVHAVTSKGRGYPPAEADERDHMHAYGVVDIATGLASTPSQRSWTDVFEDEIARIADDRSDVVGLTAAMRLPTGLGALSRRYPHRVFDSGIAEQHLLASAAGLAAAGTHPVVAVYSTFLHRAFDQLLFDIGLHRLPVTLVLDRAGVTGPDGPSHHGLWDLALLACVPGFQIACPRDAPRLRQQLRTAIATAAPTAVRFPKGAPGEPITAEHTIGGLDVLHTPPPHWRPDVLLVAVGAMSRPCMDAARCLSEEQIGVTVVDPQWVWPISPALTELAGRHRITVCVEDAIADVGIGAHLSHHIGRTHPRTRTYTLGLPPAYIPHASRDHILSSHGLTGPAIRIRCKSLLNALHEVPGPEDHPDSGDSY

SEQ ID NO: 45756 - protein, 281 aa, Lactococcus lactis
MRELHLGDKTVPAIGLGTWHMGNSTATRAKEIKAIQAGIDAGATVIDTAEMYGNGRSESLVGEAIANIDREKLFLIDKVLPSNASADRMSHSLDTSLKLLGTDYVDLYLYHWRGAVPLSETVETLQSLQQQGKIKHWGVSNFDLPDMKELLALPGGDQVAANEDLYNLGSRGIEYSLLPWQRKQGIPLIAYTPVAAGDERGQLINNPAVKEVAEAHQATPWQILLAWAIRDGSTLAIPQSGDPKHAVDNIKAASLTLNEDDLAKIDKAFPKPTSKQPLDIR

SEQ ID NO: 45757 - protein, 812 aa, Arabidopsis thaliana
MEQLKVLPLLFLSWVMFLQSTHQLPNSQTQVLYQLRKHLEFPKALESWGNYYGDLCQIPATAHMSITCQGNSITELKVMGDKLFKPFGMFDGSSLPNHTLSEAFIIDSFVTTLTRLTSLRVLSLVSLGIYGEFPGKIHRLNSLEYLDLSSNFLFGSVPPDISRLVMLQSLMLDGNYFNGSVPDTLDSLTNLTVLSLKNNRFKGPFPSSICRIGRLTNLALSHNEISGKLPDLSKLSHLHMLDLRENHLDSELPVMPIRLVTVLLSKNSFSGEIPRRFGGLSQLQHLDLSFNHLTGTPSRFLFSLPNISYLDLASNKLSGKLPLNLTCGGKLGFVDLSNNRLIGTPPRCLAGASGERVVKLGGNCLSIIGSHDQHQEFLCEEAETEGKQFQGRKVGILIAVIGGAVLVLVFFVLVILLLLCTNRCSSCCSREKSVPQTRLKVVTDNSHTSLSSEVLASARLISQTAKLGAQGVPSCRSFSFEDLKEATDDFDSSRFLGEGSLGKLYRGTLENGSSIAIRCLVLSRKFSSQSIRGHLDWMAKLNHPHLLGFLGHCTQTSGEHDPVATILYLVYEYMPNGSYRTHLSESFSEKILTWPDRLAILIEIAKAVHFLHTGVMPGSFNNQLKTNNILLDEHKIAKLSDYGVSAIIEENEKLEDSTLLLLLHFADKVRNPQVKVCIFCPCIAKLHGIYENLIQTLRLCRKKAKREDDVYNFGFILLESLIGPVPTTKGEAFLLNEMTSFGSQDGRQKIVSPTVLTTSSQESLSIAISIANKCVLLEPSARPSFEDVLWNLQYAAQMQSAADAERKSDTSS

SEQ ID NO: 45758 - protein, 570 aa, Vitis vinifera
MASEGRCLYEVLGLTTDATADEIRSAYKKLALQRHPDKLVHSGLSKADATAQFQELLNAYEVLSNPEERAWYDSHRSQILFSNPTSSNGSVPNLFSFFSNSVYSGYDDTRKGFYKVYSEVFDKIYATEVNFAKKLGLGSIKEAPMMGNLESPYSQVTAFYGYWIGFSTVMDFAWVDEYDVRAGPNRKSRRLMEEENRKLRKKAKREYNETVRGLAKFVKRRDKRVIDMQVKKSLEEEKRKEEEKTRKWEEFERGRLERARAKVEPEWVRAVEDDGNDDDWEFEDAGGGRKEEEEFYCVLCRKKFKSEKQWKNHEKSKKHKEWVAEFRESVKEEDERYGDAEAGIHGNGDQSEVELQEQFEDGLELEEEEIEDGAQIESSNEEEFVVGDVSHSGNGTNAELGSDDEMSVLEAMLSGHKNRKNGKTAVASVLEPESSVTEAPVDINNDEMDFMEYDNRKSSRRRRGKKDKGKRSNGEAMKPDSSTGDKGGQDEQNSGSDASHIQDSSTYSVAENETDGKEDHHAETNKIPKQPVNRKATSKGEIDTKPKESNKVRKAKLSLVFILDNLERKK

SEQ ID NO: 45759 - protein, 185 aa, Salinibacter ruber DSM 13855
MDRKTFLKHLGWAAVAPLALTACTPSRSTPASTSAPDTLGVHTLPEDFPPLDKSEEEWRRLLTKSEYQILFEAGTEPRRSSPLLDETRTGTYICAACRLPLFSSKTKYESGTGWPSFWAPLDGQVDTKKDTKLGYTRTEYHCARCGGHQGHIFEDGPDPTGLRYCNNGLALSFVPADASLPDLRT

SEQ ID NO: 45760 - protein, 249 aa, Vitis vinifera
MKKTEDESEFSYIEGSETGPEKWGTIKAEWKTCGKGKRQSPIDLRNRRVSIFPDFGQLKRKYRPAHAVLKNRGHDVAVEWKGNAGKIKLHGVHFKLEQLHWHTPSEHTVNGTSFQMELHLVHKSARGKIAVIGKTFKLGPPDPFLAKMIDHVTGIPAGEEKDIGIVDANDIKHWGRKYYRYIGSLTTPPCTEGVIWTISKKVNTVSKEQVESLRRVVHDGHEGNARPAQRLNGRPVWLYIPFQMGRPSN

SEQ ID NO: 45761 - protein, 211 aa, Vitis vinifera
MQSPIDLLDARVQVLPNLEKLKRDYKPAPAVVKNRGHDVTVEWKGYAGKININGTYFKLQQCHWHSPSEHTFNGSRYNLELHVIHLSSDEKIAVIGITYKYGRADPFLTRMLRHIDSLPVGEEKELGIVNPGDIKFGSRKYYRYIGSLTVPPCTEGVIWTISKKVRTATREQVRALRKAVQDGYEANARPSQEVDGRTVLLYKPSLRRGST

SEQ ID NO: 45762 - protein, 143 aa, Bacillus subtilis subsp. subtilis str. 168
MAYNKEEKIKSLNRMQYEVTQNNGTEPPFQNEYWDHKEEGLYVDIVSGKPLFTSKDKFDSQCGWPSFTKPIEEEVEEKLDTSHGMIRTEVRSRTADSHLGHVFNDGPGPNGLRYCINSAALRFVPKHKLKEEGYESYLHLFNK

SEQ ID NO: 45763 - protein, 490 aa, Lactococcus lactis subsp. lactis Il1403
MDAENKKGIGLAALVAIIVSGAIGGGVFNLSNDLATNASPGGVVISWIVIGFGILMLVLSLNHLVVNKPELSGVSDYARAGFGNMVGFISGWGYWLSAWAGNIAFAVLMMTSVDYFFPGVFQAKNGSLTILSVIVVSIVSWGLTLLVMRGVEGAAAINAIVLVAKLIPLFVFVIAGIVTFKAGVFSAHFWQNFVANTNADGVIKSLTWSNMTGGDLFSQVKGSLMVMIWVFVGIEGAAMMGDRAKRKSDAGKASILGLIALLVIYILLSLLPFGFMSQQELANTGQPGLVHILNAMVGGWGGSLMAIGLVISLLGAWLSWTMLPVEATQQLSEQKLLPSWFGKLNDKGAPKNSLLLTQLIVQIFLIVTYFVADAYNVFVYLCTAVIMICYALVGLYLFKLGIQEKKTSNIIIGFIAAAFQILALYYSGWQFVWLSLILYAVGFILYALGKKEYGTKMSTAELIATFVLTVLGILAVFGVYGNWLARCTWN

SEQ ID NO: 45764 - protein, 1373 aa, Burkholderia mallei ATCC 23344
MSKHRQAPGPRGGLVMGNLAAYKRNPITMLLRLHQQYGDVARNRLGPFVTHALAHPDHIQYVLQENHRNYVRGRFYDNFKMFFGDGLLTTDGEFWRRHRRVVQPLFHKKQVDAHTAAVGDAALALAYRWSALPPGKALDVVEEMMHLSLRMLGLMVFNTDVSSHAEAAGPAVRFGIEAMMPQGNLNDFIPRWAPTRFNRRIAHARRAIDTIVAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGATISLRPVHGIRLIVKPRERQQSHLARVREHESARALRPLGDTATTAGAACPMTAAREPGASAAALAAVEAGALDAAHRGGAAAAAAGEPCPPRDPAEAAPLPLAAAPAPASPAVDADASARGVPAWRFTWRPVPVDPVPDEPSPALSGRRIALVNGRGGTAERVAAALARTCAKVSVFAPAASADHAEAARVFVNEAGPLDGIVDLGLEAPFALDDAGAWEAPMRRTVELLKACYGDWAAEDDTSRLFYVALTWMDGQMGYGETAGAQPLGGLWAGLAKTLPQELPNCNVRVLDIAPDETGRVDRLVVNELYRWGLFEVGYRGGVRYTLHAKRNELPPHAVDARTTLGAGDTVLFSGGARGIGLLCARSLAERHGCTVIVTGRETPPDGGEPWMALDEPGFKHYGLEQLRAATPEHPPKAIRAALQRLKRRRELRTALDEMAALGLPVHYRVCDVTDRAAVRALCDELGDSLRMVIHNAGVDRPVRLIQKRAEDFADTVRTKVLGFANLCDAVRARPRLVQFCNVGSLTGRWGGMTGETDYAAANEALARLGLWAARHAFSPACGVKTLVWPTWEGVGMITNFAVTQRYVSPMNVDEGVRHWLRELAAPGSGEVMFMGAVGRAPTPMQIKGFVPIRELPNIGELVTRRHHVGEPVRFRPFKRFESRYAIDPAVAPYAHAFRFNGRAVLPASLVLEHACAVGDWVMPPTGEPRELSEMTNVVLRLDALPDVPAGGAPVELASEAAGYMIGDVWCVDVRCSDARTQAELLSMTLVYRPQPEQIGAAFARAPDTTPEPAPLTSAPHAAWNGELLPAGDWSVPDDASAGIVRIGRVPSAAVLSLWALPFPLELRLPVNHVEHVLRVLLAEWGAARADAPAVWRIGGAKLARLPAASADGVVEYAAGRFAVLDARGYVLLRIDDARVDGEPAQAALPETGALADPLTA

SEQ ID NO: 45765 - protein, 354 aa, Lactococcus lactis subsp. lactis Il1403
MTSPLITKAEVNSVFQGRSLLAEKDFTPAEINYLVDFGLHLKALKQQNIPHHYLEGKNIALLFAKTSTRTRAAFTTAAIDLGAHPEYLGANDIQLGIKESTEDTARVLGSMFDAIERRGFSQKEVEDLAKYSGVPVWNGLTDDWHPTQMIADFMTVKENFGHLKGLTLVYVGDGRNNMANSLIVTGSMLGVNVHIVAPDSLHPTKEVMDIANKFAEKSGAKPLATSNIEEGVKGANIIYSDVWVSMGESNWEERVKLLTPYRITMDMLKMTGNADNGQLIFMHCLPAFHDTETEYGKEIKEKYGLTEMEVTDEVFRSKYARQFEEAENRMHSIKAIMAATLGNLFIPAVPEDFK

SEQ ID NO: 45766 - protein, 975 aa, Sinorhizobium meliloti 1021
MEDELLKRRTQLARPDVSIEEAQAILAQHYGLSGDLTELGSQQDRNYRVDTSEGPFVLKIARAEYARVEIEAQNAALRHVATRPDAPKVPEVVSALSGEEIVTAAVREETYQFRLLTYLDGTPLTRRRHLAVETVAALGDVAGRLAVALRDFDHPGLERELQWDLRRAGPVALHLLSAMSDVDLRKRIAEAMVGAMRRVQPLMPDLRLQAIHQDVTDDNVVSRADRSGRLIPDGVIDFGDVLKGWVVADLAVTCASLLHHAGGDPFQILPAVKAFHAVCPLTDAELKALWPLIVARACVLVASTAQQLEVDPENAYVEGNAAHEREIFDVAVSVPLDLMEHAIGEAVERSPQLSPPGMGRRLLPELDPSEIGIVDLSSLGPHLPADRWHYEDTEALLLQSAARAAGAAATRYGEYRLTETRLLQASAPRTFALHVDLCLHGQTAVHAPFAGRLHQRGGKLIFSGEGLHLHLYGVEAADLAEEAFEAGARIGVVPGDPSALGFMRVQLCTTPELHPPAFAASHQAGAWCRLCPSPSPILGFDCDAALPDAAGLLERRRRHYARPQKNYYRTPPQIERGWKEHLFDVEGRAYLDMVNNVTLVGHGHPRLSAAVGRQWSLLNTNSRFHYAAVTEFSERLAALAPEGLDTVFLVNSGSEANDLAIRLAWAHSGARNMISLLEAYHGWTVASDAVSTSIADNPQALTTRPDWVHPVVSPNTYRGPFRGEDSTVGYVDAVSRKLADLDEKGGKLAGFISEPVYGNAGGIPLPSGYLEAVYAMVRERSGVCIADEVQVGYGRLGHHFWGFEQQGVVPDIITVAKGMGNGHPLGAVITRREIADALEKEGYFFSSAGGSPVSSVVGLTVLDILHDDALQENARAVGTHLKSRLEALGDRFPLVGAVHGMGLYLGVEFVRDRETLEPATEETAAICDRLLDLGIVMQPTGDHLNVLKIKPPLCLARESADFFADMLGRVLEEGW

SEQ ID NO: 45767 - protein, 268 aa, Yersinia pestis KIM
MKSRSSLTALREILAMILDSFELKGKVALVTGCDTGLGQGMAIGLAEAGCDIIGVNIVEPRETIEQVTALGRRFFSLTADLSNIECIPSLLERAVAEFGHIDILVNNAGIIRREDAINFSEKDWDDVMNVNIKSVFFMSQAVAKQFIKQGNGGKIINVASMLSYQGGIRVPSYTASKSAVMGVTRLLANEWAKHGINVNAVAPGYMATNNTQQLRKDEERSKEILDRIPAGRWGLPDDLKGPVVFLASKASDYISGYTIAVDGGWLAR

SEQ ID NO: 45768 - protein, 171 aa, Candidatus Kuenenia stuttgartiensis
MEYLKKLIRDVPDFPKVGVLFKDITPLLQDAKGLKDSIACIASYVENKKIDIVVGAEARGFILATTVAFSIGTGFVPIRKPGKLPYEKASMTYNLEYGTDTLEIHKDGIKKGQQVLMVDDLLATGGTMNACCKLVESLGGNIVGCAFLIELGFLNGRDILSKYDLFSLIKY

SEQ ID NO: 45769 - protein, 338 aa, Vitis vinifera
MAESSSFPSVPPILSVQELAKEPMTAVPQPFILDDPELPLDLSKRASLPTIPTIDMKHLIMSETTDFELENLHSTCREWGAFQLVNHGVSSSLMEKLKSEIGKFYRLPLEEKMKYKIRPGSVEGYGLSLIRSQDQKLDWGDRDTLESYLSEMQKLAMTLLGFMAKALNLDKRDMEELFDDGMQSVRMTYYPPCPQPELVMGLTPHSDASGITVLLQVNGVDGLQVKKDGVWIPVNFLPDAFVVNLGDILEIVSNGIYNSIEHRAVANSVTERISIAMFFNTKFSAEIGPAIGLINPQNPPLFKRVGMEKYFRDFFARKLEGKAYLEYMKIKNGEGDTA

SEQ ID NO: 45770 - protein, 268 aa, Bouteloua dimorpha
ASYAAAAMPALDVLPEKAHHGWESNGGAAVAPTPVPRRLDGKVAIVTGGARGIGEAIVRLFVKHGARVVIADIDAAAGDALAAALGPQVSCVRCDVSVEEDVKRAVEWAVARHGRLEVLCNNAGVLGRQTRAARSILSFDAGEFDRVLRVNALGAALGMKHAAQAMAPRRAGSIVSVASVAGVLGGLGPHAYTASKHAIVGLTKNAACELGAHGIRVNCVSPFGVATPMLVNAWRQGHAAAVPSDEEVEKMEEVVRGFATLKGPTLRP

SEQ ID NO: 45771 - protein, 172 aa, Anabaena variabilis ATCC 29413
MTLPNWITFSRLLGVPFLLYGLYDSTPQARWVCVAIFLVAALTDWLDGYLARKLNQVSDLGKFLDPLVDKFLVLAPLLVLVELGKIPAWGVFLILARELAIAGWRVNQTTITGANIWGKLKTVSQIVAIALLIAPLSSDWQQVSLIAFWLSVALTLISGGIYLWPQKVSQAS

SEQ ID NO: 45772 - protein, 214 aa, Zea mays
MAPAVEAVKETGTFQKVPALNERILSSMSRRSVAAHPWHDLEIGPGAPTIFNCVIEIPRGSKVKYELDKKTGLIKVDRVLYSSVVYPHNYGFIPRTLCEDSDPLDVLVIMQEPVIPGCFLRAKAIGLMPMIDQGEADDKIIAVCADDPEYRHYNDIKELPPHRLAEIRRFFEDYKKNENKEVAVNDFLPASAAYEAIQHSMDLYATYIVEGLRR

SEQ ID NO: 45773 - protein, 239 aa, uncultured archaeon GZfos1D1
MKDRSSHDTDGSKSREKEASALSAVTLVADGMIVGIGTGSTAGYAIVELGRLVARGIDILCVPTSYQSEMLAAQQKIPITTLSEHPKLDIVLDGADQIDRNLVAIKGGGAAHTREKVIAHAASRVVLMADHEKVVPGLDHAVPIEVLPYARTLVEREVRALGGIPELRMAARKDGPVVTDNGNFVIDADFGAIDDPARLSGELSALVGAIEHGIFLNVDEVHIGTADGVKVLKRQGLRK

SEQ ID NO: 45774 - protein, 342 aa, Thermus thermophilus HB8
MLDPRLSVAPMVDRTDRHFRFLVRQVSLGVRLYTEMTVDQAVLRGNRERLLAFRPEEHPIALQLAGSDPKSLAEAARIGEAFGYDEINLNLGCPSEKAQEGGYGACLLLDLARVREILKAMGEAVRVPVTVKMRLGLEGKETYRGLAQSVEAMAEAGVKVFVVHARSALLALSTKANREIPPLRHDWVHRLKGDFPQLTFVTNGGIRSLEEALFHLKRVDGVMLGRAVYEDPFVLEEADRRVFGLPRRPSRLEVARRMRAYLEEEVLKGTPPWAVLRHMLNLFRGRPKGRLWRRLLSEGRSLQALDRALRLMEEEVGEEGEKEKPGPRGQREAAPGPAREGV

SEQ ID NO: 45775 - protein, 292 aa, Triticum aestivum
  misc_feature (71)..(71): Xaa can be any naturally occurring amino acid
  misc_feature (176)..(176): Xaa can be any naturally occurring amino acid
MAKDIEAAPPGGGYAAKDYSDPPPAPLFDAEELTKWSLYRAVIAEFVATLLFLYITVATVIGYKHQADPAXGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGXLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 45776 - protein, 362 aa, Burkholderia xenovorans LB400
MATPQFHPLRIREVRPETADAVSVAFEVPAELREQYRFTQGQFVTLKTHIDGEETRRSYSICVGVTDYDRDGELRIGIKRVRGGRFSNFAFDTLQPGHTIDVMTPDGRFFTHLNADQGQQYLAFSGGSGITPVLAIIKTTLEVEPRSTFTLVYGNRSVDQIMFAEELEDLKNRFMNRFVLYHVLSDDLQDVELFNGVLDQEKCAAFIENLLPADAIDEAFICGPAPMMDAAEAALKAAGVPPEKVHVERFGSPLPQAGVPQIEITEDTPAADLEIVLDGKRRKLRLPYQGVSVLDVGLRAGLALPYACKGGVCCTCRAKVLEGEVKMEKNYTLEEHEIRDGFVLTCQCHPVSDRVVVSYDER

SEQ ID NO: 45777 - protein, 518 aa, Zea mays
  misc_feature (451)..(451): Xaa can be any naturally occurring amino acid
  misc_feature (460)..(460): Xaa can be any naturally occurring amino acid
  misc_feature (476)..(476): Xaa can be any naturally occurring amino acid
MDKERKQGFFAALKEEVVRGLSPSRSRGKSPAPPRSASPARMLIPRRRKAPAAPPPPPPEKVLEQYLGEQLVARSGSLRPGGEALAPLIEGPDAERLAAGDPDAEDSGRREGFGHWVRGHLTRTPSMASSAAGGGGGPGGSSGSFRRSDLRLLLGVMGAPLAPIPSKTAEPLPLLSIKGTPIESSSAQYILHQYTAASGGYKLLQSVRNAYAMGKVRMVASEFETATRVVKNRGPSGRGAAAVEQGGFVLWQMAPDMWYVELAVGGSKVHAGSNGRLVWRHTPWLGAHAAKGPVRPLRRVLQGLDPLTTAGLFAEARCVGENKVNGEDCFILKLSADPQTLKLRSEGPAEIIRHVLFGYFSQRTGLMVQMEDSHLTRIQPHAGGDAVYWETTISSALEDYRAVEGVMVAHSGRSAVTLFRFGEAAMSHTKTRMEEAWSIEEVAFNVPGLSXVDCFIPPAXDIRSGSVGEACELPSXPTASAPRTGAAVHPSRVAAVERAGTAAGAGGRGEKVMWRVQV

SEQ ID NO: 45778 - protein, 625 aa, Pseudomonas syringae
MQSKTSRRTFVKGLTAMGVLGGLGLWRNPSWALSGPSQLNTLTGTDFDLSIGEMPVNITGKPRTAMVINGGLPGPLLRWKEGDTVTLRVRNNVRDHTSIHWHGIILPPNMDGVPGLSFAGIEPDGMYVYKIHVKQNGTYWYHSHSGFQEQAGVYGPLVIEAKDPEPFAYDRDYVVMLTDWTDEDPASLMRKLKKQSDYYNYNKRTVGDFIEDVHKQGWSATMADRKMWAEMKMNPTDLADVSGATYTYLLNGHAPNTNWTGVFRPGEKIRLRFINGSSMTYFDMRIPGLKMTVVASDGQYVKPVTVDELRIAVAETYDVIVEPTEQAYTLFAQSMDRTGFARGTLAVREGLLAPVPPLDPRPLVTMADMGMGGMDHGSMGDMGSMQGMEGMDHGAMGAGDKGMDSMSGAPMQGMDGGQTQGMDHSKMSGMDHGSMGDMAGMAGMSGMGDMPMQAHPATEKDNPLVDMQAMSPTPKLDDPGLGLRNNGRRVLTYSDLRSTFEDPDGREPGRTIELHLTGHMEKFAWSFNGVKFADAEPLRLKYGERVRVVLVNDTMMTHPIHLHGMWSDLEDENGNFMVRKHTIDMPPGSKRSYRVTADALGRWAYHCHLLFHMEMGMFREVRVEE

SEQ ID NO: 45779 - protein, 489 aa, Escherichia coli O157:H7 EDL933
  misc_feature (57)..(57): Xaa can be any naturally occurring amino acid
MVSETKTTEAPGLRRELKARHLTMIAIGGSIGTGLFVASGATISQAGPGGALLSYMXIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 45780 - protein, 296 aa, Photobacterium sp. SKA34
MRKAVIPVAGLGTRMLPATKAIPKEMLPIVDKPLIQHVVNECVAAGIKEIILVTHSSKNSIENHFDTSFELEATLEVRVKRQLLEEVQAICPPDVTIMHVRQGQAKGLGHAVLCAHPLVGDAPFAVVLPDVILDDVASDLRCDNMAAMVKMFNETKVSQVMVEPVPMSEVSNYGVADINGVELHAGESAPMTKVVEKPSVEEAPSNLAIVGRYILPAEIWALLARTPVGAGDEIQLTDAIDMLMQSQQVNAFHMSGVSHDCGSKIGYMKAFVEYGMRHNQFGEEFTAYLKQRAKSS

SEQ ID NO: 45781 - protein, 265 aa, Arabidopsis thaliana
MGKVASDKCHKWVFKEPSESEPNLANYWQSSFDALPPEWTDQFESGIQTIAVIQAGHGLLQLGSCKIIPEDLHFVLRMRQMFESIGYRSGFYLSQLFSSNRTATPSSSTVPNQIPQSQGFNWGSHSPLLPSPSFQNQLPASARFGFLQDNNVPPQMLPPMEEHEDDIKWPNGLSLFNALTGRADEASRLLFNQEQNPMNVENQNEFLNLEGHHPNKFRRSYTLPARMDSSSSSTSLDQQQPLEFRNNNSGSNSGLFPDVMETFLR

SEQ ID NO: 45782 - protein, 330 aa, Hordeum vulgare
VEARPGSGYGGGHPPSPTPISPAPKHEKPPKGHKPPHHHHHAKPPVGSQAPPTYSPPTAKPTPPAPKPAPPTYAPIPKPPKPSPPAYHPTPKPAPPTYKPPTQPKPSPPAYKPAPKVSPPAYKPAPKVSPPAYKPAPKVSPPAYKPAPKVSPPAYKPSPKVSPPAYKPAPKVSPPAYKPAPKVSPPAYKPAPKVSPPAYKPVPKPSPPAPKPTPPPYKPPTPTPPAQKPPTPTPPAYKPPTPTPPAHKPPTPTPPAHKPATPTPPAHKPPTPTPPAHKPTTPTPAYKPPTPTPPADKPPTPTPLAHKPPTPTPPAYKAPTPSPPPPPYHH

SEQ ID NO: 45783 - protein, 313 aa, Escherichia coli O157:H7 EDL933
MEKRKIILDCDPGHDDAIAIMMAAKHPAIDLLGITIVAGNQTLDKTLINGLNVCQKLEINVPVYAGMPQPIMRQQIVADNIHGDTGLDGPVFEPLTRQAESTHAVKYIIDTLMASDGDITLVPVGPLSNIAVAMRMQPAILPKIREIVLMGGAYGTGNFTPSAEFNIFADPEAARVVFTSGVPLVMMGLDLTNQTVCTPDVIARMERAGGPAGELFSDIMNFTLKTQFENYGLAGGPVHDATCIGYLINPDGIKTQEMYVEVDVNSGPCYGRTVCDELGVLGKPANTKVGITIDSDWFWGLVEECVRGYIKTH

SEQ ID NO: 45784 - protein, 398 aa, Cucumis sativus
MALQAASLVSPALSIPKEGKSSVCLKDSSLFGISFSDHLKSEFSSSTLRCKRELNQQIGAIRAQTTATESPAVNKATPDGKKTLRKGSVVITGASSGLGLATAKALAETGKWHVIMACRDFLKAERAAKSAGITKENYTVMHLDLASLDSVRQFVDNFRQSGRPLDVLVCNAAVYLPTAKEPTFTAEGFELSVGTNHLGHFLLSRLLLEDLNKSSYPSKRLIIVGSITGNTNTLAGNVPPKANLGDLRGLAGGLNGLKSSMIDGGEFDGAKAYKDSKVCNMLTMQEFHKRYHEETGITFASLYPGCIATTGLFREHIPLFRILFPPFQKFITQGYVSEDEAGKRLAQVVSEPSLTKSGVYWSWNKNSASFENQLSQEASDAEKARKVWELSEKLVGLA

SEQ ID NO: 45785 - protein, 422 aa, Bacillus subtilis subsp. subtilis str. 168
MKPLLKENSLIQVKDILKAHQNVKDVVIHTPLQRNDRLSERYECNIYLKREDLQVVRSFKLRGAYHKMKQLSSEQTENGVVCASAGNHAQGVAFSCKHLGIHGKIFMPSTTPRQKVSQVELFGKGFIDIILTGDTFDDAYKSAAECCEAESRTFIHPFDDPDVMAGQGTLAVEILNDIDTEPHFLFASVGGGGLLSGVGTYLKNVSPDTKVIAVEPAGAASYFESNKAGHVVTLDKIDKFVDGAAVKKIGEETFRTLETVVDDILLVPEGKVCTSILELYNECAVVAEPAGALSVAALDLYKDQIKGKNVVCVVSGGNNDIGRMQEMKERSLIFEGLQHYFIVNFPQRAGALREFLDEVLGPNDDITRFEYTKKNNKSNGPALVGIELQNKADYGPLIERMNKKPFHYVEVNKDEDLFHLLI

SEQ ID NO: 45786 - protein, 183 aa, Zea mays
  misc_feature (73)..(73): Xaa can be any naturally occurring amino acid
MAEHLASIFGTEKDRVNCPFYFKIGACRHGDRCSRLHNRPTISPTLVLANMYQRPDITPGVDAQGQPIDPEKXRSRSPPPQRRGHRDRDDYHHRDRDDYRGGGGGGRGRGSRYDRYDDGAGRGGRHARYDDGAGRGGRHDRYDDGGRRRHGSPSRRARSPVRESSEERRAKIEQWNREREGKQ

SEQ ID NO: 45787 - protein, 307 aa, Gibberella zeae PH-1
MTSRTALRGFSRSLNPSRCSQTFVRPFSSANVVRKNYQTPTSDRPTHFGYETVTEAEKQQRVAGVFTSVAETYDKMNDFMSLGIHRLWKDYFISSLNPGATNPPGQAQRILDVAGGTGDIAFRHLQHAHEFNCNPNVSVIISDINPDMLGVGRQRSLALPASHQSALSFLEANAEVLPSQIEDNSLDLYTVAFGIRNFSNIPAALKEAHRVLKPGGVFACLEFSKVDKHPIFNTIYKQWSFKGIPLIGQLVAGDRDSYQYLVESIERFPSQTQFRDMIKDAGFVVAGEGYEDLTGGIAAIHKGMKPV

SEQ ID NO: 45788 - protein, 547 aa, Oryza sativa Japonica Group
MSEAMAVTMPPMRAPALVAMLVVVLVALVRRRRHRSKGAGGRLESLPPGPVGLPVIGNMHQMLVNKPVFRWVHRLLADAGGEIVCVRLGPVHVVAVTSPEMAREVLRKNDAVFADRPTTFAAESFSVGYRSASISPHGDQWRKMRRVLTAEILSPATEHRLRGARGEEADHLVRYVLVRCGRDGAAVDVRHVARHFCGNVIRRLTLGRRHFREPRADDEDAAAPGRDEAEHVDALFATLNYLDAFCVSDYFPALVGLDLDGQEKVIKKVMRTLNRLHDPVVEERVEEWRLLRKAGERRDVADFLDVLASLDDAAGRPLLTVEEIKAQTIDIMIATVDNPSNAVEWALAEMMNKPEVMRKAMDELDTVVGRDRLVQESDVRDLNYLKACIREAFRLHPYHPFNPPRVAMADTTIAGYTIPKGSQVILSRVGLGRNPRVWDDPLEFRPERHLSPYPAGGRGDAGVVALTEAELRFVSFSTGRRGCPGVSLGTLITVTLFARLLQGFEWSKPAGVERVELREEAASLVLAQPLVLQATPRLAAHLYGAGK

SEQ ID NO: 45789 - protein, 293 aa, Zea mays
  misc_feature (179)..(179): Xaa can be any naturally occurring amino acid
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGXETPEGRKADGREAGELRVGRVRGHQGRPRAVHPDRVGRVQDPGLPEDLRQHAEARLRLRRPQHRRLREAEGDRLHRLLHRQAARRLAQGHARGRLIPPPSPMDWIPGRKRREAG

SEQ ID NO: 45790 - protein, 378 aa, Oryza sativa
MDHHQRWHPTVNEREFIERALQSDLRVDGRRPFDFRRLKILFGREDGSAEVQLGDTRVMGYATAQLVQPYKDRPNEGTLAIFTEFSPMADPAFEPGRPGESAIELGRVVDRGLRESRAVDMESLCVVAGKHVWSVRVDLHILDNGGELNVPDAMVLSLRNLIDAANIAALAALSTFRRPECTVGGEDGQQVTVHDPEVRDPLPLTIHHLPIAVTFAYFGEGNIMKAGGEGVMSSVIMQCLRIASVKAADITSKIKNEVNSYTSAKALQKVKRLPASALKKDNAPDVAMKESSDGALETQSTKPSSDGQQINKEPPSVVEDNKQEDVEPMLSECNPEPQSESRLTAGGSDETQEAISPKSLKDAVKPKHKIKKKQHSKS

SEQ ID NO: 45791 - protein, 159 aa, Francisella tularensis subsp. holarctica
MSFRIGHGYDVHKFTSAKQNIIIGGVEIAYHLGLEAHSDGDVLIHALCDAILGALGLGDIGKHFLDTDNQFKNIDSKFFLAEIKKMLDEKQYSISNIDCTIIAQAPKMLPHIEKMRACLANILEIQISQINIKATTTERLGFIGREEGIATHVVCLLYR

SEQ ID NO: 45792 - protein, 444 aa, Pediococcus pentosaceus ATCC 25745
MKKYDVVIIGAGPGGLGLAYPLKEAGLEVAVVEENLWGGTCPNRGCDPKKVLLAAIEAKKQNQYLLGNGIKNETQIDWPALMQFEKTFTDPVSRSSRSGLTDAQIDVYDGHAEFIDHHTLKIDQTTITSEKFVIATGQRPSRLTNIENQEMMQTSTDFLKMDHLPNELALVGGGYIAFELAMIASGAGAKVHIIHHNQRPLKAFPKAYVDDLVDQLKTQGVEVHLGIDLKRVEPKDERFELSDGQGFKQIVDQVFVTAGRKPNDDSLNLEKIGVQTDRGGIVVNEYLETSVDNIYAMGDVVSKALPKLTPVSGFEARYLAKKLTNATQAAIDYPAIPTVVYGMPKLAKVGVELDEAQQHPEQYEIKTAEMTEWFTYRRLQDPFAKISVIHEKSSGKIVGAITMSSEAEHLINDLTMIINQGGLVDQINNQILAYPTEASDLGYM

SEQ ID NO: 45793 - protein, 386 aa, Pediococcus pentosaceus ATCC 25745
MEFVGVLVLILVLTLLAGHFAQRMGFPAVVGQLLVGIILGPGILGIIHSDELISVFSEIGVIILMFLAGLESDLKMLKKYIKPALVVAILGVVLPIVLVGGASLLFGVHPMEALFIGVIFSATSVSISVEVLKEYHTLNTKEGATILGAAVADDIIGVLLLGVMIALTSSKSGSNSNVGMAIFYQVLFFIGVYVIGKWVVPMLMRLSDQLFITASRPVMSIIICLGLAWLADVAGLSGAIGAFFAGVAVSLTDEDDEINESIEPIGYAIFIPVFFVSVGLSMNFDGLQTVLGLIVVLTILATITKLFGCGLGARMSGFDLTSSGVIGAGMISRGEMALITLQIGYGEHLMSETYYSAIVLVIVLVTLIAPFILKDAIKKNKAATHA

SEQ ID NO: 45794 - protein, 232 aa, Picea sitchensis
MGARDEARPPGKRRQNPFPRANLSLLVGREGAPDRGGHARSPVEGRGHEDHACAKTDEGRAEDSIQGLRCCGRRQWSRRARGQVQQEVATAIRGAIILAKLSVIPVRRGYWGNKIGKPHTVPVKVTGKCGSVTVRMVPAPRGAGIVAARVPKKVLQFAGIEDVFTSSRGSTKTLGNFVKATFECLLKTYGFLTPDLWRETRFSKSPFQEYTDLLAKPAKALILEDVDKEALV

SEQ ID NO: 45795 - protein, 414 aa, Thermus thermophilus HB8
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKDVIPRALREGYRVYAYDFHRNPIPGQEGPNLYWRDVGTLDAYYEASMDLVKVVPEFDLFNPEWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 45796 - protein, 204 aa, Oryza sativa
KVINRRKMQLLGVACPLKASKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKYKFVAKKYSPPSIPAEFFEDPSSYKPD

SEQ ID NO: 45797 - protein, 760 aa, Burkholderia xenovorans LB400
MDEQLKQSALAYHQNPKPGKISVTPTKPLSNQLDLSLAYSPGVAAACMAIYDEPLDAQKYTSRGNLVGVITNGTAVLGLGNIGPLAAKPVMEGKGCLFKKFAGIDVFDIELSESDPDKLVEAIAMLEPTLGGINLEDIKAPECFYIEKKLRERMKIPVFHDDQHGTAIIASAAILNGLKVVGKKLGEVKLVCSGAGAAAIACLDLLVNLGLSKKNILVTDSKGVIYEGRGNLDPSKERYAANTGARTLADAIRGADVFLGCSSAGVLKPEMVAEMGTQPLILALANPEPEIRPEDAKKVRPDCIIATGRSDYPNQVNNVLCFPFIFRGALDVGATTITEEMKLACVRAIAELAEETDQGDEVAKAYEGHSLEFGPEYLIPKPFDPRLIIKIAPAVAQAAMDSGVATRPIKDMDAYREELGTTVYRTGMVMRPVFAAAKSEPARIVFAEGEDERVLRAAQFVLLEKIARPILVGRPSVIEMRLKKMGSKLKCGDDFEVVDPEDDPRYQQSWQAYHELGAREGVTPDVAKAAMRKFNTLIGAILVRLGEADGMICGMIGQYHTHLKFIEQVLGKAENVQNFAAMNLLMLPGRNLFICDTYVNETPTAEQLADMTMLAAGEIEKFGITPKVALLSNSNFGSAPSSSSQRMAAARKLIVERAPTLEIDGEMHGDAALSEAVRKAAFPGTTLSGEANLLIMPNVEAANITYNLLKMIGGEGVTVGPFLLGAEKPVHILTPAATVRRIINMTAVASANARKPANAK

SEQ ID NO: 45798 - protein, 207 aa, Photobacterium sp. SKA34
MSYQEKNAMSPILDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAKGKRYCLPNSRVMIHQPLGGFQGQASDIQIHAQEILTIKQRLNGLLAEHTGQPLEVVERDTDRDNFMSAEQAVEYGLVDAVLSQRD

SEQ ID NO: 45799 - protein, 237 aa, Listeria monocytogenes str. 1/2a F6854
MTETKEEKVHKVFEKISPSYDRMNSVISFKLHVKWRKETMKLMRVQKGTNVLDVCCGTADWSIMMAEEIGPEGHVTGLDFSENMLKVGREKVKESDLHNVELIHGNAMELPFPDNSFDYVTIGFGLRNVPDYMQVLREMYRVLKPGGQLACIDTSQPNIPGWKQVFNAYFRYVMPVFGKFFAKSYKEYSWLQESTREFPGMARLAEMFQEAGFSYVRYISHSGGASATHFGFKKKEQ

SEQ ID NO: 45800 - protein, 629 aa, Anabaena variabilis ATCC 29413
MTTQEQLHQWHELAQQLRIDSIRATTVAGSGHPTSSMSSADLMAVLLTNYLHYDFDNPHHPNNDRFILSKGHAAPLLYAMYKAAGVITDEELMSLRQMGSRLEGHPTPVLPWVDVATGSLGQGLPIGVGLGLAGKYLDQLPYNVWVLLGDSETAEGSVWEAFDHAAHYTLDNLIAIIDVNRLGQRGQTELGWNTQAYANRAKAFGWQAIEIDGHNLTEIDQAFSAAISINDRPTVIIARTKKGKGVASLEDLGGWHGKALKPDAAKQAIAELGGERHITIQVAQPEPGQPTLLHPQPLQLPTYKQGAEVATRRAYGDALKALGAAQPDVVALDAEVSNSTYTEDFAEAYPERYFEMYIAEQQMVAAAVGLQVRQYKPFAATFAAFLTRAYDFVRMAAISRANIKLVGSHAGVSIGQDGPSQMALEDLAAFRAVGNSTVLYPCDANQTAKLVEQMSDRQGIVYLRTTRENTPVIYGIEEEFSIGGSKVIRSSDQDQATIIGAGITLHEAIKAGDRLKNEGITVRIIDAYSVKPIDVQTLHQAANDTEGNLVVVEDHWQEGGLGAAVLDAFAGIGDLPSYDGPPLQLIKLAVHHMPGSGTPEELLHAANIDADAIVEAVKSQVRHLIGTRV

SEQ ID NO: 45801 - protein, 375 aa, Physcomitrella patens subsp. patens
MRGQAGGEDLKAKLEKIKKQLSASSGSVLLQGPLLKRSETLRKWNQRWFTLDPSTGRMEYRFQRSDPSPRGLIHFDADSTITVSPLNIQGDRKYDGCCFYIGTSQKKESFLCAETPAAARAWVATLRAAALVLKAHKEAVNSLSGNGHAKLGTVAASVAAANATAQEAMKDVQASFRPSVAIPQSSALAANNSVDNSIILKETLRVKDEELNQLQRDLRARDLTIKELAERLSETADAAESAAKAVHYVDKERQVAVTEIEHLKKELQRASDEVSLIIKAAEEKVVAANMMRDLALQEAHRWRVELGKAREQCVIMEGAVQRGHEHARQLKIAHEQQLASLYQAQEPRFKSSSSSAYFHGQETAVSAQLLSIIVD

SEQ ID NO: 45802 - protein, 355 aa, Lotus japonicus
IVRLHEVLATKTKIYFIMDFVRGGELFAKVSKGRFGEDLSRRYFHQLISAVGYCHTRGVFHRDLKPENLLLDENGDLKVSDFGLSALRDQIRPDGLLHTLCGTPAYVAPEILAKRGYDGTKVDVWSCGVVLFVLAAGYLPFNDPNLMVMYRKIYNGEFRCPRWMSPDLRRFLSRLLDTNPETRITVDGMTRDPWFKKGYKEIKFHEEYRPESGSGSGSEVVDLNAFDIITFSSGLDLSRLFRQKEGEERLVVSGTPEKVLEMAEEVGAAEGMAVRWKKECGVELEGLNGDYGIGIDVSRLTAELAVVEVKMRGVDAVAFRNLWDEKLKPQLLGGATTSYHQEVEPESPESQVASD

SEQ ID NO: 45803 - protein, 420 aa, Triticum aestivum
MGATEPQWVLMATGRSPTNIAVIKYWGKRDETLILPVNDSISVTLDPDHLSATTTVAASPSFPSDRMWLNGKEIALSGGRFQSCLREIRKRARDVEDEKKGIKIKKEDWEKLHVHIASYNNFPTAAGLASSAAGLACLVFTLGKLMNVNEDYGELSSIARQGSGSACRSIYGGFVKWCMGKNDDGSDSMAVQLADESHWDDLVIIIAVVSSKQKETSSTSGMRDTVETSPLLQYRAQTVVPSRILKMEDAIKNRDFESFARLTCADSNQFHAVCLDTSPPIFYMNDTSHRIISLVEKWNHSEGTPQVAYTFDAGPNAVLIARNRKTATLLLQRLLYTFPPQKNDLDSYMLGDKSILSDAGLQSIADVEALPAPPEMKAPNQKFKGDVSYFICSRPGAGPKVLTDESHALIDSATGLAKGV

SEQ ID NO: 45804 - protein, 709 aa, Oryza sativa
MADDLFEQLQKFNIGSHYAYDNEMDLALERAFCSLLVGDVSKCRMWLGIDNESSPYRDPKILEFIVTNSSISEENDLLPGLCKLLETWLIFEVFPRSRDTRGMQFRLGDYYDDPEVLSYLERMEGGGASHLAAAAAIAKLGAQATAALGTVKSNAIQAFNKVFPLIEQLDRSAMENTKDGPGGYLENFDQENAPAHDSRNAALKIISAGALFALLAVIGAKYLPRKRPLSAIRSEHGSVAVANSVDSTDVVGCCCCGQHLLAAAASPDNVAAAQDAALLPPPSFAATAAAAQAEVACSSDRQNTHCLPVAARRHQNPLALSLPWMRGFEIYESQEQARKRDTVTVPFSRGVISTVRLELNGRDHQLQQQLQEKKGSHSKQNQKASEANASPPLPEPPTLQNLPPPAGAGAADSAAETLACARARPRSPATSGLRLLRLLLVSGPSAAVDRSDLDAVKPRWRTGPAVPSAKAEPLKSKWADEDVEEDDVKESWEEEEEEKPKPPPVEKTAPKPSGKGAAKKGKQQASTSSEVVQDEALDDPALEKLRQQRLVEEADFKSTTELFGKKDGSEKSLDTFIPKSESDFAEYAELIANKLRPYEKSFHYMGLLKNVMRLSMASLKGADAKDISSSIAAIANEKIKAEKEAAAGKKKQGAKKKQLHIENKDDDFIPGKEAPEHLKRLHGNNAHLFDVDFDSHRIGKSTCVLELDT

SEQ ID NO: 45805 - protein, 147 aa, Zea mays
MSAEASQIISLAGLTGDGAALCSPTSRSPKLPINCYHGNSTTTSSGKEKHGFASWLKIENPFSFKLENGSIKSPKSNMLFDSSVSNNRVNGNNSSFDEENEDLLADFIDEDSQLPSRIPKTKIVKGNSLHWKDGDISSQTGSSLSLL

SEQ ID NO: 45806 - protein, 472 aa, Lotus japonicus
SVMIPIFATQVSAIESAAGDIDEALKWNGNYQECRACVGSGGVCGSDGEFRCFCKDGPHTSACNSAIAPAPGALGAGFMTTLFFVLIICHRMRSMSFRQKMLFRKRRKYVDHNVEAFMKSYGSLAPRQYSYSEIKRITNSFLDKLGQGGYGVVYKATLPDGRLVAVKVISESNGSGEDFINEVASISNTSHVNIVSLLGFCYMNKRALIYEFMPNGSLDNFINGRGGSPNAVSYFDWNTLSKVAIGIARGLEYLHQGCNTRILHLDIKPQNILLDENLCPNIADFGLAKICKRKESIVSMLGTRGTPGYIAPEIFSRAFGGASHKSDVYSYGMLILEMVGGRENYDSGGGSQSSEMSFPDWIYKDLEQGDVHTNCLVITGEEHEMARKMILVSLWCIQTHPSERPSMSKVVEMLEGTLQSVPYPPKPILHSPEKLLLQNSDLTSGNTLETDSMTTEKDGSIELNVLSKNVPG

SEQ ID NO: 45807 - protein, 249 aa, Prototheca wickerhamii
GKSFGCPVHVEEAAGLPVRRITSSSERDGWREPVLPGVLTLTIVVAGASGDLAKKKTYPALLFLFQHGFLCPNMRIVGYARSSLTDQGLRDKLRPYLKDAPPAKLEAFLAACSYVSGPYDGAEGWKRLDAVLSKRERDHAINPAGRLFYLALPPSVYPQVCLGLKANCDAVATTGSPERSWVRVVVEKPFGKDLQSSEALAEELGKLFPEEQLYRIDHYLGKEMTQNMFVMRVCQHILLPRLVKELCVQ

SEQ ID NO: 45808 - protein, 458 aa, Marchantia paleacea
MPKRSNGSLVVRCAVSVVRFSKENVSCDLASENFTFSRDSFPVVSTVLRVSEAVYRMAAVASLGSALSVSSAALSQNVSVSNNATKESAFLGLRMGEVAKFGGALLSVSTVAANLKSKPGVLSVNAVTAPAETMNKPSSKKTATKSTCIITGASSGLGLATAKALADTGEWHVIMACRDFLKAERAARSVGIPKDSYTVIHCDLASFDSVRAFVDNFRRTERQLDVLVCNAAVYFPTDKEPKFSAEGFELSVGTNHMGHFLLARLLMEDLQKAKDSLKRMIIVGSITGNSNTVAGNVPPKANLGHLRGLAGGLNGVNSSSMIDGGEFDGAKAYKDSKVCNMFTMQEFHRRYHAETGITFSSLYPGCIAETGLFRNHVTLFRTLFPPFQKYITKGYVSEEEAGKRMAQVVSDPKLSKSGVYWSWNKDSGSFENELSEEASNPEKAKRLWELSERLSGLV

SEQ ID NO: 45809 - protein, 271 aa, Silicibacter sp. TM1040
MRSKTGRTTKDGIRIYEQADFAGMHKAGALAAKILDDIAAHVFPSQTTGEIDRIITQMVEDAGATSATIGYKGYQHASCISINHVVCHGIPGDKKLKDGDILNIDVTVIVDGWFGDTSRMYVAGKLPRKAERLIQITHDALMKGIEVVKPGNTFGDIGHAIQSYAESQRVSVVRDFCGHGLGQVFHAPPNVLHYGRPGTGPVLEEGMFFTIEPMLNLGRAETKVLADDWTAVTRDKSLSAQFEHSVGVTSDGVDIFTLSPAGRFHPTYDKD

SEQ ID NO: 45810 - protein, 207 aa, Campylobacter fetus
MVIVKKISAIEVLDSRGNPTIKTKVELCDGSIGEAIVPSGASTGKRERLELRDGGEAFGGKGVLKAIKNVNSMIAEEICGKDAYNQKAIDDAMLALDGTDNYSRIGANAVLGVSMAVARAAANSLNIPLYRYLGGANACTLPVPMFNIINGGAHANNSVDFQEFMIMPFGFSKFSNALRAATEVYQTLKKILNDLGHSTAVGDEGGF

SEQ ID NO: 45811 - protein, 345 aa, Thermus thermophilus HB8
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 45812 - protein, 440 aa, Davidiella tassiana
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 45813 - protein, 137 aa, Glycine max
  misc_feature (74)..(74): Xaa can be any naturally occurring amino acid
PTTTSSGGQWCVANQGASDTALQVALDYACGFGGADCSAIQPGASCYNPNTVRDHASYAFNDYYQKNPAPTSCXFGGTASLTSNDPSSGSCKYASPKSTSTNQPPPTPTFVSPPSSPTPVMTPTPPDMLNSGGGSTV

SEQ ID NO: 45814 - protein, 342 aa, Streptomyces avermitilis MA-4680
MPGSLRRPSVVSRVSDLIGYTPLLELAATETGSRLLLKLEMFNPTGTAKIRMARQMITDAEERGELRAGGRIIESTSGNTGLGLAVIAAERGYTFTAVVDNHAAVDKLRAMKALGAELVHVVDDGTDELATAAREELAEEMARGQDNTIFTEQHNNPSNGVGYFPVAHELHEALDGRLDVLVGAVGTGGGLCGTARELRTLIPGFTTIGVEPKGSIAFGGPAHDYYQSGTGTPEGAPIGALVDFGLIDEGAKVGDVEAFATCRAVARTGLLIGGSAGGVVHEALTRLPGLPPGTTMVALINDGGEKYMDTVFNDDWMRARDLLDPAAEREVDELLTKLRGNR

SEQ ID NO: 45815 - protein, 247 aa, Zea mays
  misc_feature (145)..(145): Xaa can be any naturally occurring amino acid
MGSSEPSSRSVQNLVLYAASAALSCLVLLAGLRHLDPNRAASQKAQQQKKEIAKRLGRPLVSTTPYEDVIACDVINPDSIDVEFDSIGGLDKVKQALYELVILPLRRPELFASGKLLSPQKGVLLYGPPGTGKTMLAKAIARESXGAVFINVRISNLMSKWFGDAQKLVSAVFSLAHKLQPAIIFIDEVDSFLGQRRTTDHEAMTNMKTEFMSLWDGFTTDRESFYTLPAAMKVDVQLSFVDNDVNL

SEQ ID NO: 45816 - protein, 395 aa, Hordeum vulgare
MALQAATSFLPSALSARKEGAAKDSAFFGVRLADGLKLDATSLGLRTKRVNTSSVAIRAQAAAVSAPTATPASPAGKKTVRTGNAIITGASSGLGLATAKALAESGKWHVIMACRDYLKTARAARAAGMPKGSYTIVHLDLASLDSVRQFVKNVRQLDMPIDVVVCNAAVYQPTAKEPSFTADGFEMSVGVNHLGHFLLARELLEDLKASDYPSKRLIIVGSITGNTNTLAGNVPPKANLGDLRGLAAGLNGVGSAAMIDGAEFDGAKAYKDSKVCNMLTMQEFHRRYHEETGVTFASLYPGCIATTGLFREHIPLFRLLFPPFQKYITKGYVSEEEAGKRLAQVVSEPSLTKSGVYWSWNKNSASFENQLSEEASDTEKARKVWELSEKLVGLA

SEQ ID NO: 45817 - protein, 448 aa, Staphylococcus epidermidis ATCC 12228
MHFVAISINHRTADVTLREQVAFRDDALRLAHEDLYETKAILENVILSTCNRTEVYAIVDQVHTGRYYIQRFLARSFGFEVDDIKDMSQVKVGDDAVEHLLRVTSGLDSIVLGETQILGQMRDAFFLAQNTGTTGTIFNHLFKQAITFAKKAHSETDIADNAVSVSYAAVELAKKVFGKLKSKHAVVIGAGEMGELSLLNLLGSGISNVTIVNRTLSKAKILAEKHNVSYDSLSALPSLLETTDIVISSTSAEDYIITNSMVKTISETRKLDSLVLIDIAVPRDIEPGIDAITNIFNYDVDDLKDLVDANLRERQLAAETIAGQIPEEIDSHNEWVNMLGVVPVIRALREKAMNIQAETMESIDRKLPDLSERERKVISKHTKSIINQMLKDPIKQAKELSTDKKSNEKLELFQNIFDIEAEDPREKAKLEKESRAKEILAHRIFSFE

SEQ ID NO: 45818 - protein, 195 aa, Staphylococcus epidermidis ATCC 12228
MNINFNNINLIISAVKKAQYPDTGLTEVALSGRSNVGKSTFINSMIGRKNMARTSQQPGKTQTLNFYNIDEQLIFVDVPGYGYAKVSKVQREKFGKMIEEYITQRENLKLVIQLVDLRHQPTEDDVLMYNYLKHFDIPTLVICTKEDKIAKGKVQKHIKRIKDKLELESGDNIISYSSIKNSKQQEIWNFIETYI

SEQ ID NO: 45819 - protein, 434 aa, Staphylococcus aureus
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSQRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 45820 - protein, 391 aa, Pediococcus pentosaceus ATCC 25745
MEFSKRANQVSPSATLAVSTEAKKMQAAGIDVVNLSTGEPDFATPKAIIKAAMESMESGKASYYTPVGGLPELRQAVATHIKTDTGYDAKMEQVAVTVGAKMGLFETFQALLNEGDEVMIVAPFWVSYEEQVKLAGGSVIAIHPQASDLKTTPSELSRFKTASTKLLILNTPQNPSGLVYSEEETRAIAQWAVDNNVILVADEIYGKLVYNGAKFSSVMSMGNEIVNNTILIDGVSKAYAMTGWRIGYVVAAPQIIRKILALQGHMTSNPTAVAQYAALEALRGDQYPVEEMRLAFEKRLNQTFDLMQVIPGFSFDYKPEGAFYLFPDVTEAMKIKGYATSTDLAMALLKEAHVAVVAGEAFGMPGHIRLSYATSQTLLSEAVRRIQNFMN

SEQ ID NO: 45821 - protein, 434 aa, Pasteurella multocida
  misc_feature (86)..(86): Xaa can be any naturally occurring amino acid
  misc_feature (211)..(211): Xaa can be any naturally occurring amino acid
MTILVIGINHKTASVAIREKVAFSAEKRVEALAQIQQQALAESAVILSTCNRTEVYFHHKAIPPQEAESWATRCMQWFAEIHQLSXDALADCLYSQQNQQAVLHLMRVACGLDSLVLGEPQILGQVKDAYQLSKPYYQGQNQPLSSEFSRLFQKTFSVAKRVRTETNIGGSAVSVAYGACSLARQIFDSLKTLNVLLVGAGETIELTCRHXLRHGVQRIMIANRTFERAQHLVTKLDGAENVQVLALTQLQEGLNQADIVISSTGSPTILITQDMVKIAQKVRCDLPMLLVDIAVPRDIEESVGELDSIYHYTVDDLQTIIQRNLAEREKASAQAWVIIQQECVDFFEWLKVHQFSNLIRSYRENAEDIRQILLEKALFALRQGEDSEAVLQALSYKLTNKLLHSPTQVMNAMVKTGNSTGLALFSSTLKSDVE

SEQ ID NO: 45822 - protein, 390 aa, Brassica juncea
MVKETEYYDVLGVSPTATEAQIKKAYYIKARQVHPDKNPNDPQAAHNFQVLGEAYQVLSDPGQRQAYDTIGKAGISTEIIDPAAIFAMLFGSEFFEEYIGQLAMASMASLDILSEGDQIDTKKIIEKMRAVQKDREDKLAQILKDRLNLYVTNKDEFISNAEAEVTRLSNAAYGVEMLNTIGYIYVRQAAKELGKKAIYLGVPFVAEWFRTKGHFIKSQVTAATGAYALFQLQEEMKRQLSAEGNYTEKELEEYMRSHKKVMIDSLWKLNVADIENTLSRVCELVLQDPTAKREELRARAKGLKTLGKIFQKNKLTSESDPLVRAELHKINGNGQDRDASTSPNSDEASHSTFGPQEPQSPYVEAPRVGVEQFDHYFPRPAPPPGAQRHS

SEQ ID NO: 45823 - protein, 429 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFNFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGA

SEQ ID NO: 45824 - protein, 177 aa, Triticum aestivum
  misc_feature (133)..(133): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEXVEEVKKEYPDAYVRIIGFDNMRQGQCVSFIAFKPTCLPRSPGKA

SEQ ID NO: 45825 - protein, 404 aa, Photobacterium sp. SKA34
MQKFGMSSKLNNVCYDIRGPVLKHAKRMEEEGQKILKLNIGNPAPFGFDAPDEILVDVIRNLPTSQGYCDSKGIYSARKAVVQHYQKRGLLDLDVEDVYIGNGVSELIVMAMQALLNHKDEILVPSPDYPLWTAAVSLSGGTPVHYTCDEQSDWYPDLDDIKKKITPNTRGIVLINPNNPTGAVYSRDFLIEVVEVARQHDLIIFADEIYDKILYDGAQHTSIAPLAEDVVCVTFNGLSKSYRVCGFRAGWMIISGPRHRAKGYIEGLEMLSSMRLCANVPMQHAIQTALGGYQSINELILPGGRLLEQRNKAYDLLTQIPGVSCVKPKGALYLFPKLDQKKFNIQDDQKMAMDFLLQEKVLVVHGTGFNWKQPDHFRIVTLPHVDDLELAMGRLERFLHSYRQ

SEQ ID NO: 45826 - protein, 429 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGGLWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGA

SEQ ID NO: 45827 - protein, 159 aa, Phaseolus acutifolius
MLVGAYPFEDQDDPRNFRKTIQRIMAVQYKIPDYVHISQDCRHLLSRIFVANPLRRISLKEIKNHPWFLKNLPRELTESAQALYYQRGNPSFSVQSVEEIMKIVGEARDPPPVSRPVKGFGWDGEEDEGEEDVEEEEDEEDEYDKRVKEVHASGEFQIS

SEQ ID NO: 45828 - protein, 429 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHNTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGA

SEQ ID NO: 45829 - protein, 213 aa, Prototheca wickerhamii
MSLAACSTAAGRPSPGAGMSGRTSQSGAPARLGAGRRRSRAFSPQASSDSARSLLSGNGLSTLATSLATPSPPLPRSVDFQRPVLQPLNWDSGSSRSGPPAPAQAPPALPQAGQPSRLRIFSGTANPGLSQEVVCYLGLELGAISIKRFADGEIYVQVGESIRGCDVFLIQPTAPPVNDALVELLITIDACRRASARSITAVLPYFGYARADE

SEQ ID NO: 45830 - protein, 161 aa, Silicibacter sp. TM1040
MISVGDKLPEATLTRLGAEGPEAVAIQDLAKGRKLAIFAVPGAFTPTCHSAHVPSFIRTKDQFAAKGVDEIICISGNDPFVMKAWGEATGATEAGITMLADAECSFTDAIGMRFDAPPAGLIGRSKRYAMIVEDGEVKILHLEESPGTCEVSAGEGLLDAL

SEQ ID NO: 45831 - protein, 458 aa, Escherichia coli K12
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 45832 - protein, 312 aa, Oryza sativa Japonica Group
MAAAWAAVVAVMLLLAQVSAAAPVMGPAFLWAPKNYGFSSDEAKEIVHYQTVSPKSLVKSVLEEGGWSNLVCSREDHAKSVDVAVLFLGSKLQSSDISKDKQADSTLVDTLKNSFASSEFSMAFPYIAMSDDDKLEKSLLSGFAENCNNGFGDNHITYTDTCSVSEDLNKHHNMDSIHGLVASQTKKNPSGQTDLIVFCDGGFKDNTKSEGELLSELVTLLKKSGAKYTILYASQPFGLLENPSNLPLGRYLAEKTNTTKPGRGKCDGECLVKSTLLEGSFVGIVLLIILISGLKCMMGIDTPSKFDAPPES

SEQ ID NO: 45833 - protein, 426 aa, Oryza sativa Japonica Group
LAREVLRDQDSVFANRVMLDAGDAVSFGGAQNIVGNPLGPMWRLLRRVCVQEMMSPAGLASVHGLRRREFRSTLRYLHSKPGEPVDVGAQMFLNTMNVITGTMWGGTIGSESERSAVGSEFRGLVAEVTELLGTPNVSDLFPVLKPFDLQGIRRKMERLRSRFDLLFTKIIQQRMRSQQDGGEMTTDFLECLLKMEKEGSDGKTTFTMDNVKGFLLEMVVGGTDTTSNSVEWIMAELLQNPQVLNKVQQELDSIVGRDAVVEESHLPQLHYLRMVIKETLRLHPPVPLLVPHSPSAAATVGGYHVPEGCRVLINVWAIQRNPLVWNKPLDFNPDRFARDGGHKGDFTGSQLDYLPFGSGRRMCAGMAMGEKVMVYSVAMLLQAFDWKLPQGVQLDLSEKFGIVMKKATPLVAIPTPRLSKPELYYS

SEQ ID NO: 45834 - protein, 500 aa, Staphylococcus epidermidis ATCC 12228
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 45835 - protein, 341 aa, Staphylococcus epidermidis ATCC 12228
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVAVKIGQLIDDKAMVKAI

SEQ ID NO: 45836 - protein, 259 aa, Picrophilus torridus DSM 9790
MIGSLFIAGPAGTGKSTFAGAFNDWLISQGFDSIIVNLDPGSDFMPYNPEIDIKEKISLNDIMSNYSLGPNGAQIVAADMILENVNYIKEKLENYPDYYVIFDTPGQIELFSFRPSSPYLVKALTNNKAMIAFVSDAVVSSMPSGYISEKMLYASLYSRFYVPMLFILNKIDLIGSEKVDEIIKWEDDPDILLDAFREEKGDMLKDYFENIVQALSNSGIMNKIYPVSSKDSFGMEDVYSEISNFFTGGEDTDTMYRDD

SEQ ID NO: 45837 - protein, 253 aa, Anabaena variabilis ATCC 29413
MLSILRADFRIIFERDPAARNLLEVLFCYPGLQALLFHRVANWLYRLGLPFIPRLISHIARFLTGIEIHPGATIGRGVFIDHGMGVVIGETAIVGDYALIYQGVTLGGTGKESGKRHPTLGENVVVGAGAKVLGNLQIGNNVRIGAGSVVLRDVPANCTVVGIPGRIVYRSGGRVDPLEHNNLPDSEAQAIRALVDRIESLEQQIQALQNNQSAAKVPVLVAASSQEAEISHDSQWCNLRDKAIQEFLDGAGI

SEQ ID NO: 45838 - protein, 159 aa, Solanum demissum
FASAVNNQAGYIDAKDQIMFSSILHKRLPAESGISVVCNTPGIVLTNVARDLPQFLQVGYRLIPYFIFNAEEGSRSTLFAATDPQISEYCEMLKADDWPVCAYISHDCRPTNASEEAHNIETSYKVWEKTLELVGLPSDAVERLIEGEEIKCRYGNSQE

SEQ ID NO: 45839 - protein, 819 aa, Solanum demissum
MGSSRAKNPWGVIRIFSKRFYCGFSERIVDIPVDARIVKTGFDPEISRFNFKLKDLVRANQIAKARQLFDEMPYRNTSSVNMMVSGYVKSRNLFRARELFESMFSRNEVSWTIMIGGYSQNNQPKEAFNLYTEMCRSGVKPDHITFATLLSGFDDTTTLKEVLQIHSHIIRFGFSASLIVFNSLVDSYCKTCCLDIASQLFSEMPTKDSVSFNVMITGYTKYGFREEALKLFMQMRNMDFQPSGFTFAAMLGMSVGSEDVIFGQQIHGLAIKTSYVWDIFVANALLDFYSKHDYIDLAKNLFDEMPELDGVSYNIIITGYAWNGQYEKSFDLFKRLQGTSFDRKNFPFATMLSVAAIELNLSMGRQTHAQAVVTTAVSEVQVGNALVDMYAKCEKFEDANRIFANLAYRNSVPWTAIISIYVQKGFHEEALKMFKEMNRENVHGDQATFASTLKASANLASVSLGKQLHSSVIRLGLLSSVFSGSVLVDMYANCGSMKDAIEVFKEMPDRNIVCWNALISAYSQNGDAEATFSSFADMIESGLYPDSVSFLSVLTACSHRGLVEKALWYFNSMTQVYKLDPRRKHYATMIDVLCRSGRFNEAENLISEMPFEPDEVMWSSVLNSCRIHKNQDLAKKAADQLFKMDALRDAAAYVNMSNIYAEAGKWENAAKVKKAMRERGVKKVTAYSWVEIDHRVHVFTANDRTHPQTEQIRRKINSLVELMDKEGYKPDTSCTLQNVDEEMKIESLKYHSERLAIAFALINTPEGSPIIIMKNLRACVDCHAAIKVISKIVGREITVRDSSRFHHFRDGSCSCGDYW

SEQ ID NO: 45840 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 45841 - protein, 573 aa, Frankia sp. CcI3
MPVPAASADRIAGARATGATGDDEESGIRYPVSVIPALGWPVADAPAGRRTSAWSPRRRQWWRDVRGETLSLTSTRPVPSIPPHSLLLFLLQLAMLLSLAILLGRVAVRLRMPAIVGELCVGVLLGPSLLGTLWPTFSDWFLPRDAAQFHLLDAVGQLGVLFLVALSGFEIDTRIIRRRSLTVARISLGGLLLPLGFGIVTGVLMPSSLLGPDGDRTVFALFLGVAMCVSAIPVMAKTLMEMRLTHREVGQLALAGGVIDDAVGWLMLAVVSAMATTGVRAGDTALSVLYVLGVGIFALTIGRVVVRAVLGRIIATSGAGAGAGADPGARSGSVVAFVAVLVLASAAGTQALELEAVFGAFLGGVVLGSSGLVDHASVAPLRIVVMAVLAPIFFATAGLRVDLTALSETRVLLAAVIVLAVAVFGKFAGVYAGARASRLTPWEGLALGAGMNARGVIEIVVASVGVRLGVLSTETYTIIVLVAIVTSVMAPPILRRAMRQVEQTAAEEQRRLVLDGHHASGAGGVGAAEAGVITRRETRTLPAARSRARYRRSVNPSNTTGRDGLEFEDESAG

SEQ ID NO: 45842 - protein, 79 aa, Chlamydomonas reinhardtii
RLMDEKGYVLGNLDCTIIAQKPKLSPHKENIRNNLSAILGADPSVVNIKAKTHEKVDSLGEERSIGCHAVVMLIRKDIA

SEQ ID NO: 45843 - protein, 602 aa, Zea mays
MDDEDYSWVRRTRFSQSIVRSSSGREQYGAFIEQFSRGAELRQNGLGTGYRNPRQSVQPLAKGSGVSNSARLPIPKAKSAVAQSERKLKHASSEGQLNRDGDRPLQESSAKQSRKGAVGLSLDIPQLHVVRPSKESPDALDFSFHSDEHSQRLQRVCSSPAPFSTKDGTAPAGDSRASSASMKIIGQVSKPAPKRRAKSPIPKRVISDVFKEAKAATKRFSSPQRQRKPTSPRSLDDSPPFGFASLRTPSKLKINSRTSSWPRRNLDSGLAKVAALEILERWTVDRSELLIGHRFASGAYSRLFHGIYKEQPVAVKFIRQPDDGEDDELSAKLEKQFTSEVTILARLQHRNVIKLVGACNCPPVFCVITEFLSGGSLRAFLRKLERKALPLEKVISIALDIARGLEYIHLQGIVHRDVKPENILFDGEFCAKVVDFGVACEETYCNLLGDDPGTYRWMAPEMYKHKPYGRKVDVYSFGLLLWELVTGSLPYEDMTPLQAAFAVVNKNLRPVIPLSCPAALKLLIEQCWSWQPEKRPDFQQIVSILEDLKTVLETDGTLHKVPSSICQALESNDQNKKKAGNWIQRLSYAQPDFSGPPPPKLL

SEQ ID NO: 45844 - protein, 163 aa, Prototheca wickerhamii
AKRSTRPWPPPAAGPAPTARCCRRCSRTTWCRATFARTWARAPSRPRAAARKCCSRAFNWESWQHNWYENISGKAEELANMGFTTIWLPPFTQSVSPQGYMPGDLYNLNSYYGSEAQLRSCIRSFQSAGIKVLGDAVLNHRCAEHRGEDGVYNRFGGRLAWDE

SEQ ID NO: 45845 - protein, 192 aa, Bacillus cereus G9241
MSMTEICLVRHGQTDWNFQEIIQGREDIPLNEVGKKQASQSAAALQAEAWDIIISSPLIRAQETAKEIAGATGLQSILLDERFVERNFGEASGKPVATVRELIAEGKVEGMEQDEEIVARCFAAVKDVAETHSGKRIIIVAHSHAIKAILHAIAPEDISFKTPLKNACISYVNENSGKWDVLKYNIAEHINV

SEQ ID NO: 45846 - protein, 611 aa, Yarrowia lipolytica CLIB122
MLNTCTNTTFTNNTMWAVQNPIRQAERDETDPPSPNPKWLSVAGDGQQTRAAAEMEQITSLWNRTDFWLAWASMFLVSIALALEKMTFKVYSTFATSDFNEMSLLSALNVVQAVMYTATMTIMAKFADVLGRFESFLLCVILFTMGEIMLAASSNISTYFAAHIFYVFGQVGIRFLQQVFAADTSSLRNRLFFVVIPNFAYIFVPWCSAPITNAIIKHSTWKWGYGMWCIILPVVSVPVLVILFRLKRRVKVVNGKKYDKEKYKGSRWNFIKERLLEFDMIGLVLFTGGLSLLFLAVTLVKSQDSWKQAHVLSMIIIGPILLILFPFWEMYPKYPFLPFSAMKNKTLITGCSFCLVYSIAQNLYNPYYFPWLLVCKGLSVTAASNTSATLMVASVASSVVAAFILRYTNRVKPVIVAGICIYMLGLGLTYHYRQPDQSLAKFIVTQAVEGVGQGFLQSPSLVIIQASVPKNHVVSATAIFYAANSIGQVIGDAISGSMYRQTYPKKLADYAPFLNATEIDQMVNNVAAPLRYKWGTSERTAVIEAFNHIYRKMLYGPMIVAAVCILIALALPNIDLSESEDGSECTIDDDKSVIVHKSSSKTASAVIEKQL

SEQ ID NO: 45847 - protein, 356 aa, Arabidopsis thaliana
MEVKGATRSSIIVPSVQEMVKEKMITTVPPRYVRSDQDVAEIAVDSGLRNQIPIIDMSLLCSSTSMDSEIDKLDSACKEWGFFQLVNHGMESSFLNKVKSEVQDFFNLPMEEKKNLWQQPDEIEGFGQVFVVSEEQKLDWADMFFLTMQPVRLRKPHLFPKLPLPFRDTLDMYSAEVKSIAKILLGKIAVALKIKPEEMDKLFDDELGQRIRLNYYPRCPEPDKVIGLTPHSDSTGLTILLQANEVEGLQIKKNAKWVSVKPLPNALVVNVGDILEIITNGTYRSIEHRGVVNSEKERLSVAAFHNIGLGKEIGPMRSLVERHKAAFFKSVTTEEYFNGLFSRELDGKAYLDVMRL

SEQ ID NO: 45848 - protein, 257 aa, Prototheca wickerhamii
MAPAILKSQPGTRPSECAPAGWLRSKMPWIGTVPCGEKTKCRMTVSVRAVAVDHVLPPPLDMKTAMQRAGPSVQERFWDEVLKRRDIIDDGHGVEMAESLTQHAWSPGPGHQSLTRLWDGIRAEAARLATSEAVLSPSIHASILSHASLSSCLAHLLAAKLASSTLLAPQLAHLISQIYESHPEALEAASADLQATVERDPACEGEVQALLYGKGWQAVQAHRAAHVLWLAGRRSLALALQSRASVAWSVDVHPAAA

SEQ ID NO: 45849 - protein, 247 aa, Prototheca wickerhamii
MAPAILTSQPGTRPSECAPAGWLRSKMPWIGTVPSGEKTKCRMTVPVRAVAVDHVLPPPLNMKTPMQRPGPSVQERFWDEVLKRRDITDDGHGMEMAESLTQHAWSPGPGHQSLTRLWDGIRVEATRLAASEAVLSPSIHASILSHASFSSCLAHLLAAKLASSTLLAPQLAQLISQIYESHPEALEAASADLQATVERDPAVKAEGQALLYGKGWQAVQAHRAAHVLWLAGRRSLALALQSRASVA

SEQ ID NO: 45850 - protein, 238 aa, Glycine max
VGKDLISGVSCKTPHEWVDKTKQQWEFSKVPGEAFHVVAYDFGIKHNILRRLASYGCKITVVPCTWSASETLKMKPDGVLFSNGPGDPSAVPYAVETVKNIIGKVPVFGICMGHQLLGQALGGKTFKMKFGHHGGNHPVRNLRSGHVEISAQNHNYAVDPATLPEGVEVTHINLNDGSCAGLAFPAQQLMSLQYHPEASPGPHDSDYAFREFVELMKQGKNRTKESLHQLSAAQALDA

SEQ ID NO: 45851 - protein, 374 aa, Vitis vinifera
MANSKGSSNFRNMISSGKHSLLPPKSPFPSISPSYADYAPSPAIGSKVIARPREGGNTHHQRTSSEGFLIEEQPSWLDDLLNEPETPVRRGHRRSSSDSFAYMDATNVSNIDHTAQDELKFRNLISATSWGSQDFEHYKDARNASFYVEPNSFGRQKNRTSMTYSSGLPSTRDSNVLQSSGSSCIPHETDGVSSTATEKQDLVESSLHDPKASSERRDCSHAKPSASETDTKRAKQQFAQRSRVRKLQYIAELERNVQALKAEGSEVSAELDFLNQQNLILSMENKALKQRLESLAQEQLIKYLEQEVLEREIGRLRSLYHQQQQQQQQPQQQQPASSHRRSSSRDLDAQFANLSLKHKDNSSGTDAVTGPLRI

SEQ ID NO: 45852 - protein, 453 aa, Rhodopirellula baltica SH 1
MVTFNLMQSSSARWQIRTRPNRHYPFLSRHPWVMANALAHATLREVTPEAPSDDGQSPSADTNAAETDQPAAESDPADRQLPACGEIIDLLDYDGNWIARGLINPASRLRIRLYAFSSEEQIDDSMWAERIEQAVARRRLTGPANPQGGERLIFSESDRMSGLIVDRYADCLSIQITGGALIPRTETLIREVTAAAARHQTPCQKVLVRMDDATVKHEGVSEETLAELQSLTTLDSEADSTVWYQHNGLEMAIDLQDGQKTGGYLDQQLNHAAAASYMADRRVLDICTYTGGFALAAARAGAKEVVAVDSSERALDIAKRNAERNQLTNVRFDQGDCFDDLKERRERGEQFDAIILDPPRFAGSRNQTNAALRAYTRLNASAVDLLPPGGILVTCSCSGRVSRADFLNMLVDVGRKRGRDLIVLESRGPSPDHVFAVSCPESDYLKCIVVQVI

SEQ ID NO: 45853 - protein, 397 aa, Thermotoga maritima
  misc_feature (1)..(1): Xaa can be any naturally occurring amino acid
  misc_feature (13)..(13): Xaa can be any naturally occurring amino acid
  misc_feature (16)..(16): Xaa can be any naturally occurring amino acid
  misc_feature (85)..(85): Xaa can be any naturally occurring amino acid
  misc_feature (180)..(180): Xaa can be any naturally occurring amino acid
  misc_feature (229)..(229): Xaa can be any naturally occurring amino acid
  misc_feature (315)..(315): Xaa can be any naturally occurring amino acid
  misc_feature (321)..(321): Xaa can be any naturally occurring amino acid
  misc_feature (334)..(334): Xaa can be any naturally occurring amino acid
  misc_feature (337)..(337): Xaa can be any naturally occurring amino acid
XGSDKIHHHHHHXYLXNTYSRFPATFVYGKGSWIYDEKGNAYLDFTSGIAVNVLGHSHPRLVEAIKDQAEKLIHCSNLFWNRPQXELAELLSKNTFGGKVFFANTGTEANEAAIKIARKYGKKKSEKKYRILSAHNSFHGRTLGSLTATGQPKYQKPFEPLVPGFEYFEFNNVEDLRRKXSEDVCAVFLEPIQGESGIVPATKEFLEEARKLCDEYDALLVFDEVQCGXGRTGKLFAYQKYGVVPDVLTTAKGLGGGVPIGAVIVNERANVLEPGDHGTTFGGNPLACRAGVTVIKELTKEGFLEEVEEKGNYLXKKLQEXKEEYDVVADVRGXGLXIGIQFREEVSNREVATKCFENKLLVVPAGNNTIRFLPPLTVEYGEIDLAVETLKKVLQGI

SEQ ID NO: 45854 - protein, 671 aa, Oryza sativa Japonica Group
MKRKQKLLFPSPPKQKHQNIPPKSKEKQSISNEPSLSILVPLLSPRIPPPETLVHRRAARLGDSITLRGIEVGPRVGKAKMAGSIDRPSGAGFEGIVHDDDKKEWKSDEDNSEGDKKAKAVSFKNRAISAGNKFRRSLRRKRRRRVGDHVASIEDIRDVKELEAVQRFHQCLHDEGLLPERHDDYHVMLRFLKARKFDIDKAKHMWSEMLRWRKEFGADNIEEFDYSELDDVLECYPQFYHGVDKEGRPVYIELIGKVDPNKLVQVTTIDRYVKYHVKESEKCLQMRFPACSIAAKRHIDSCSTILDVQGVGLKNFSKDARELIMRLQKINNDNYPETLHRLYIINAGQGFKMLWGTIKSFLDPQTASKIHVLGSKYQNKLLETIDESELPDFLGGKCRCEEHGGCIKSDKGPWKDPDIIKRVLNGEANYGRKILAISSVDGKKICYINPRHLTKKCSDASAESSSEMEDVSSPIASVNPIINPHLTPVDESKLPGNTSTSGAPPRVEDIPVVDKAVDTCAGPSTSSMAFNSDSFSLRNITMELGGLRNRITAWLIVLIVSFVAVLRSVPSRVTASLSSQAISRENSTHSSVLRRLGELEEKLQELEAKQSQMPPDREELLNGAIHRVDALEAELISTKKMLYDALMRLDELLAYADQQKNIQFRKKRFCF

SEQ ID NO: 45855 - protein, 133 aa, Physcomitrella patens subsp. patens
MAQNAKPLPPQLDQNSTKELNLTVLQRTDRHVEDILTTAAHVTFYQFNSDSNQWSRREVEGSLFVVKRRSQPRFQFIVMNRRSTDNLVENLLGDFEFEVQTPYILYRNANQETNAIWFYSARECEDVANLFQR

SEQ ID NO: 45856 - protein, 324 aa, Bacillus subtilis subsp. subtilis str. 168
MKLDAVTFGESMAMFYANEYGGLHEVSTFSKGLAGAESNVACGLARLGFRMGWMSKVGNDQLGTFILQELKKEGVDVSRVIRSQDENPTGLLLKSKVKEGDPQVTYYRKNSAASTLTTAEYPRDYFQCAGHLHVTGIPPALSAEMKDFTYHVMNDMRNAGKTISFDPNVRPSLWPDQATMVHTINDLAGLADWFFPGIAEGELLTGEKTPEGIADYYLKKGASFVAIKLGKEGAYFKTGTSEGFLEGCRVDRVVDTVGAGDGFAVGVISGILDGLSYKDAVQRGNAIGALQVQAPGDMDGLPTREKLASFLSAQRTVHQKKGDY

SEQ ID NO: 45857 - protein, 482 aa, Nostoc punctiforme PCC 73102
MVTTAEKTNIGYITQIIGPVVDVKFPGGKLPQIYNALKIVGTNESGQEINITVEVQQLLGDNQVRTVAMSSTEGLVRGFEVTDTGAPITVPVGKATLGRIFNVLGEPVDNRGPVNAEASLPIHRSAPKFTDLETKPSVFETGIKVVDLLTPYRRGGKIGLFGGAGVGKTVIMMELINNIATQHGGVSVFAGVGERTREGNDLYNEMIESGVINNENLNESKIALVYGQMNEPPGARMRVGLSGLTVAEYFRDVNKQDVLLFIDNIFRFVQAGSEVSALLGRMPSAVGYQPTLGTDVGELQERITSTTEGSITSIQAVYVPADDLTDPAPATTFAHLDGTTVLSRGLAAKGIYPAVDPLGSTSTMLQPNIVGDEHYNTARAVQSTLQRYKELQDIIAILGLDELSEEDRLIVARARKVERFLSQPFFVAEVFTGSPGKYVKLEDTIKGFQKILSGELDALPEQAFYLVGDINEAIAKAEKIKG

SEQ ID NO: 45858 - protein, 422 aa, Staphylococcus epidermidis ATCC 12228
MSAEKITQSKDGLNVPNEPIIPFIIGDGIGPDIWKAASRVIDAAVEKAYNGEKRIEWKEVLAGQKAYDETGEWLPQETLETIKEYLIAVKGPLTTPIGGGIRSLNVALRQELDLFTCLRPVRWFKGVPSPVKRPEDVDMVIFRENTEDIYAGIEFKQGTSEVKKVIDFLQNEMGATNIRFPETSGIGIKPVSKEGTERLVRAAIQYALDNNRKSVTLVHKGNIMKFTEGSFKQWGYDLAHNEFGDKVFTWQQYDEIVEQKGKDAANEAQSKAEQEGKIIIKDSIADIFLQQILTRPAEHDVVATMNLNGDYISDALAAQVGGIGIAPGANINYETGHAIFEATHGTAPKYAGLNKVNPSSEILSSVLMLEHLGWQEAADKITDSIEATIASKIVTYDFARLMDGAKEVSTSDFADELIKNIR

SEQ ID NO: 45859 - protein, 471 aa, Cucumis sativus
MEDDYSIFPPDSDLDFSFTSTTTDRTFTTSSSARTSLARSSLTLSFNESRLSAAAAALNLRPYHRSDSHWSAIRAATTLSSDGHLHLRHLKLIRHLGTGNLGRVFLCHLRDNDHASFALKVVDKEALSNKKLLQVQTEAEILASLDHPFLPTLYARLDVSHYTCLLIDYCPAGDLHSLLRKQPGSRFSVAAARFFAAEVLVALEYLHALGIVYRDLKPENVLLREDGHVMLSDFDLCFKSDVVPTFHTWTRPGPQATGSCFGWRTSPEFEEEIVGEFVAEPTSAFSKSCVGTHEYLAPELVTGGGHGNGVDWWAFGVFVYELLHGTTPFKGVNKEGTLRNIASSEGVKFRGGGEEEGGMGEARDLIERLLVKDPGRRLGWEKGATEIKRHPFFEGIKWPLIRTYRVPEVYGMMRKGRAQVSHVREVTERIRRRGWWNWRKVMRKRLIKNGSCSKSHSNTNYYSYSSKKKTG

SEQ ID NO: 45860 - protein, 403 aa, Vibrio vulnificus CMCP6
MTVEMKVERGLFDEVMVPCYNPMEMIPVKGQGSRIWDQNGNEYIDFAGGIAVSCLGHCHPVMVNALTEQAGKLWHLSNVMTNEPALRLAKKLTEVSFAERVFFANSGAEANEAALKLARRYAADVYGPEKSEIIAFKQGFHGRTFFTVTVGGQAAYSDGFGPKPGDVTHLPYNDIEALQAHISDRTCAVMMEPLQGEGGIIPPTAEFIQAVRELCDKHNALLVFDEVQTGNGRTGEFYAYQGLGVTPDILSTAKSLGGGFPIGAMLTTAKLAEHLKVGTHGSTYGGNPLACAVAEAVVTEVSKPETLQGVKEREQWFREGLAKLNEKYQIFAEIRGKGLLLGAALNEQWKGRARDVLVAAGKEGLLVLVAGANVVRFTPSLVITKQEIEEGFAKLDKAIASLV

SEQ ID NO: 45861 - protein, 550 aa, Magnaporthe grisea 70-15
MGSGLGPQSPPVGLPTGGMSGNMRFPPNIAANMQLNLGGRPLPQGFPKSAPAVPSARKAPPSLSERRAMKLGGLPGGPGATPSMGTPKLSDLQGGASGPTDGNSNADKTSGAGGQAVPDNKLHDFKQYIDAENGWITFDGAATITRTGVNFASGHKFSISLDEIQVLDELGKGNYGTVYKVRHAKPKVPRFGQGLGSLTKQSVSRQNSMKDEGEDANGVVDGQTTSGVVMAMKEIRLELDEAKFTTILKELVILHECVSPYIIDFYGAFFQEGAVYMCIEYMDGGSIDKLYAGGIPEGVIRKITYATVMGLKSLKDDHNIIHRDVKPTNILANTRGQVKICDFGVSGNLVASIAKTNIGCQSYMAPERISGGGFAQGGADGTYNVQSDIWSLGLTIIECAMGRYPYPPEVSSTIFSQLSAIVEGDPPDLPTEGYSDTARNFVRSCLDKNPAKRSTYPMLLAHPWLRSLAQPATISEEAEDTEDLEAAAQKLSLGAGPIGADDEVAQWVKSALDRKRRGDAQSPDKPALHAAPFDSASPMAAPKAGPMTGA

SEQ ID NO: 45862 - protein, 238 aa, Arabidopsis thaliana
MSSQICRSASKAAKSLLSSAKNARFFSEGRAIGAAAAVSASGKIPLYASNFARSSGSGVASKSWITGLLALPAAAYMIQDQEVLAAEMERTFIAIKPDGVQRGLISEIISRFERKGFKLVGIKVIVPSKDFAQKHYHDLKERPFFNGLCDFLSSGPVIAMVWEGDGVIRYGRKLIGATDPQKSEPGTIRGDLAVTVGRNIIHGSDGPETAKDEISLWFKPQELVSYTSNSEKWLYGDN

SEQ ID NO: 45863 - protein, 263 aa, Vibrio vulnificus CMCP6
MTPAVLFQSLWNDYIQRLCPSAAKVHQLLEEDEPLINDHIALRTFNVAPLGIETLAKPFLELGYVACGDYLFKSKKLIAKHFEHPDPTQPKVFISALKVDECSEALQAIVEKLVAQVDASRLEDSAFLHGGRLWDLSFVDYQTLAKESEYASWLAAHGYGANHFTVSVNQLKALDSVKGVNDHLRNAGFVINEVGGEVKGSPEVLLEQSSTMADKVAVHFSEGSEIVPGGFYEFAKRYPMDNGELYPGFVEASADKIFESTNG

SEQ ID NO: 45864 - protein, 895 aa, Ustilago maydis 521
MPSISPQHTAEPSSSTQSTLHSTPAVSQVRIQTPEAPASLDELLKSPHNPALQIRQPSSTLRGATPDDQRRRNGFHLWRTESEDARNARLRQAIQAAEAQANAPPSLKHRLGNALGKASDWIQSRGFLSLYRLNPIQLGDGTEAILSDAFAVRSPKLSRLGLIVLTISLAGAQLAWTLELAYGTPYLLSLGLSQQSTSLVWLAGPLSGLIAQPVVGSLSDHSTSSFRRRKYMIISALLLTVSTITLAYSVPISTSLVDLFGGGLADWDPRRHDLVHSTTQIISVMAFWILDFALNGLQAASRALILDTAPSEQQTIANAWQGRMTHAGNVVGYLCGWVDLASWKSLRWLGGGQFRRFAMISLLAMISCVSVTISCISESPTDDRFSQSTHQRQSMCTSAWSTAQATLDDVWHAIRRLPRSVRRVCLVQLFAFMGWFPFLFYSTTYILQIAQYERNLEHRRTHDDLILVQPFDAGQGGQAGRPSSDRDAERGSFAMLMFALISLVSAALLPYLALAGEKRDQPCLKNADSNNGQETPTPPLQINIPADRASLWSEPRHTADREHSERISRVQRVTRGLVQGLTLRTFWSVASIVFAALMLVGTAWASTVRQATVVIALVGVPWSVAAWAPFALVGEFVREAEDGASPFEFEQDHWSPARMRARAAATEEGRPRKHSQPSAHESVSRVDQADVGAGGGFKYIDQVSPTRMGRGGEQGARERIRASLVDCAPLPRTSTASSEDVESLHVAPHCGDGGGWRSSSYSSHAPTPQNATGGAGTILGIHNLAIVAPQFVVAIIASLIFSAVHSSLSATHLVLNSPALASLADRDHRVAQGGVVNPAKGTVWVLRFGGSMALIAAVVARFVPLTLSERQRRYPAQQPIQHHAAGQHDDYRDVL

SEQ ID NO: 45865 - protein, 560 aa, Leavenworthia crassa
MTSSTALICDTEAWKDLKKHVEDIKKTHLRDLMNDANRCESMMLEFDGLLLDYSRQRATVETMNKLLKLAKDAQLPEKISRMFNGEHINSTENRSVLHVALRAPKDAVIMADGKNVVPEVWNVLDKIKEFSEKIRSGSWVGATGKPLEDVVPIGIGGTFLGPLFVHTAPQTDPESVECAKGRQLRFLPNIDPVDVARNIKGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFKSTSLEENIPVLLGLLSVWNVSFLGYPARAILPYSQALEKFAPHIQQVSMESNGKGVSIDGLPLPFETGEIDFGEPGTNGQHSFYQLIHQGRVIPCDFIGVVKSQQPVYLKGEIVSNHDELMSNFFAQPDALAYGKTPEQLHKENVSENLIPHKTFSGNRPSLSLLLPELSAYNVGQLLAIYEHRVAVQGFVWGINSFDQWGVELGKVLASQVRKQLHSSRTQGTELDGFNYSTTTLLKRYLETSSEPQM

SEQ ID NO: 45866 - protein, 289 aa, Vibrio vulnificus CMCP6
MSAKHPIIAVTGSSGAGTTTTSEAFRKMFNMMSIKPAWVEGDSFHRFTRPEMDVEIRKAKEQGRHISYFGPQANDFPALGEFFRQYGKSGTGEVRRYLHTFDEAVPYNQMPGTFTPWQKLPENTDVLFYEGLHGGVVDGEVNVAQHVDFLIGMVPIVNLEWIQKYVRDTRDRGHSREAVMDSIVRSMDDYLNYITPQFSRTHINFQRVPTVDTSNPLNAKGIPSLDESFVVIRLRGIKNVDFPYLLAMIDGSFMSRHNTLVVPGGKMSFAMELIVQPILQQLIETGKIG

SEQ ID NO: 45867 - protein, 351 aa, Prochlorococcus marinus str. MIT 9303
MAKQGPMRIGINGFGRIGRLVFRALWGRPGIEICHVNDPSGEAATAAHLLEFDSVHGRWDQLVGGSENQLLVNQQTISYSQGSTPGAVPWNDAGIDIVLECSGKFKSPETLSVYFDQHALKRVIVACPVKGKLAGKEVLNIVYGINHHLYDPKIDHLVTAASCTTNCLAPLVKVVHENFGISHGSITTLHDITNTQVPIDSFQKDLRRARSCLQSLIPTTTGSAKAIAMIFPDLEGKLNGHAVRVPLLNASLTDAVFELKRSITVKDANEAFRHAAEHQLKGILGYEDKPLVSIDYVNDSRSSIIDGLSTMVVNGSQLKVYAWYDNEWGYSSRMADLTCYISNLENTSNTF

SEQ ID NO: 45868 - protein, 192 aa, Bacillus clausii KSM-K16
MNLANKITVARICLIPAFMLFLLVDWPLGETEWFQQPITYSMLVATAIFVVASATDWLDGYYARKLDLVTSFGKFLDPLADKLLVTAALIGLVEAQLVPAWIAIVIISREFAVTGIRLVAAAEGDVIAASKLGKWKTLTQIIAIIASLLHNIPFSALSFPFASIMLWIAALLTIWSGIEYFVKNKHVILKSM

SEQ ID NO: 45869 - protein, 287 aa, Zea mays
MMMHGNGHGHGRVHPASSSSDFSGEMNQSAVSDPSSSPLYSFHFEKPVPPPPPAGTYVVQVPKDKVFRVPPPENARLFDHYTRRARRRRRGSCSCACLLVGAAVALAAALAGVLACLVLGPKPPAYAVQALAVSGLVNASSSPAALSPGFDATVRADNRNGRLGVRYEGGRGRVSVSYGGALLADGAWPALYQAPRNVTVVVARARGSGVRLSRSVRGQLAAAERLRSVPFDMDVDVPVRLQLGVVRTWAVPLRARCTVAVDRLAADARVVSNSCDVKVRLLSWWRN

SEQ ID NO: 45870 - protein, 558 aa, Yarrowia lipolytica CLIB122
MFPFDVEKNKGTSSESIHSIHVSEIHSDVRSESIIGAPEEEESPLGQHVGKFTVVALNFSQMIGTGIFVTPGSILKGVGSIGASLMLWLAGIIISFSGFAVYTEFASMYPKRAGADVAYLEKAFPKPKYLMPVVFAVISVLLSYSASNAIVFSEYVLVAANQEVTEWTQRGIAIAAIAGVCLMSWVSNKWSMRLQNVIAYVKVIILFFVAITGLVVLGGHTRVKNPRDNFKDPFKGTTGNANVWANALVKIIFSFAGWNNANNVLNEIPDAVRTVKIYGSVALALVSVLYMLCAVAYFAAVTKEEIKHSNLLTAALFFKNVFGESAGQRVLPALVAVSSIGNLLAVTIGHSRIVREVGRQGVLPWPNFWTNTWPFGTPGGALLVKFILTVIVIVAPPPGDAFNFVVDLQSYPSNIFLCLLVVGLFIVRRRRQKAGLGRAPFRAYTVVAVFYFLVSLFLLAAPWVPPPGGANGGDVSFWYATYCVVGIGIILLCGIYYYIWAVVWPKFGGFKHVEQIITLPDGSTYTKINRVKNDVQHSDESEGESETKSARVEEKEIV

SEQ ID NO: 45871 - protein, 471 aa, Arabidopsis thaliana
  misc_feature (374)..(374): Xaa can be any naturally occurring amino acid
  misc_feature (398)..(398): Xaa can be any naturally occurring amino acid
RVDPRVRVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGXDPSAMPQKVLRNYNVGNRQTHRGXKHRKKSTKRSENCRSRRTAISVAEFEELLFRYQVEKETNFLHHSEFLVLFFSSLASQTQKREVYFYFKNSYIR

SEQ ID NO: 45872 - protein, 348 aa, Zea mays
MENGGAKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGKTDATEWALNYIKEKAPELLSVMACSEVFDSSKGGAEKMCHEMGVPFLGKVPMDPQLCKAAEEGRSCFADQKCSASAPALRNIVKKLIKAE

SEQ ID NO: 45873 - protein, 490 aa, Silicibacter sp. TM1040
MLDATTDLKSLLADPTLLEDRAYINGAFVAGEGTFEVTNPARGDVIANVADVSRMQARDAIAAAQGAQKEWAKWTGKERAGVLRKWFDLMMAHQEDLAVILTAEMGKPLAEARGEIAYGASFIEFFAEEAKRVYGETIPGHQRDKRITVIKQPIGVAASITPWNFPNAMITRKAGPALAAGCAFVARPASETPLSATALAVLAERAGIPAGVFNVIPASDASGIGKEFCENPIVRKLTFTGSTNVGRILLRQAADQVMKCSMELGGNAPFIVFDDADLDAAVEGAIMCKFRNNGQTCVCANRIYVQSGIYDAFAAKLKEKVEAMKVGDGLEDGTHFGPLISEAAVKKVEDHIADAMDKGAEVILGGAPSELGGTFFEPTIVTGATPDMAFAQDETFGPLAPLFKFETEDEVIEMANDTIFGLASYFYAKDLSRVYKVAEALEYGIVGINTGIISTELAPFGGVKQSGLGREGSHHGIEDYLEMKYLCMSV

SEQ ID NO: 45874 - protein, 331 aa, Photobacterium sp. SKA34
MTIKVGINGFGRIGRFVFRAAQERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMIVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGETQTSVFDAKAGIALTDNFVKVVSWYDNEIGYSNKVLDLIAHISK

SEQ ID NO: 45875 - protein, 309 aa, Photorhabdus luminescens subsp. laumondii TTO1
MRHFIIDTDTASDDAVALFMALREPSVFIEGITIVAGNCAVAQCRKNALVSIEKAGTYIPPVYEGMSKPLFREHYASYHIHGKDGMGNMNLPESSLIVEDKHAVDAIIDIVKKFPGEIEIITLGPLTNIAMAVLKEPNLYKSVKVIYIMGGSGLKSGNITPLAEFNLYSDAEAAHIVLNSGLPLIFCGWELGMEEAFINEFDMDKLNSLGDLGQFAVSCNRTLIEFNAGRTNRKGFDLPDPITMAIALYPNEMIEDKLAVYGYVEYQSARSYGHLVIDSTDLLNHPHNMSVVTKIKGEVFKNKLFTLLS

SEQ ID NO: 45876 - protein, 441 aa, Oenococcus oeni
MAQEKKKMGVIELTVITAINMMGSGIIMLPTNLAQIGTMSIVSWVVTAAGAMCLAYAFSRAGMYTSKEGGMGGYAEYSYGKAGSFMANYTYGVSLVIANAAIAISAVGYATNLFGWHLSPVEVVLGTIITLWLATVLNFGGPRITGRISTFTVWGVIIPVVAISLVGWFYFSGHQYVASWNPHHFSFFTGVSKSISITLWAFLGLESASANMDSVENPKKNVPIAVLGGTIGAAIMYIVSTNVMAGIVPMAKLAVSNAPFGLAFTQMFTPTVGKVVMALMVLSCFGSLLGWQFTIAEVFRSSAIEGYFPKFFGKVIKNGTQIIGMVIITVLQSLLALMTISPSLSKQFTILVNLAVVTNIIPYILSMGALKTMQIQEKVPTRGRRFTNTVAVIAAIYSLYALYTAGSIALVGGSIVTFAGWTLYGFVSHRFDVNKSLSDVN

SEQ ID NO: 45877 - protein, 237 aa, Zea mays
  misc_feature (172)..(172): Xaa can be any naturally occurring amino acid
  misc_feature (198)..(198): Xaa can be any naturally occurring amino acid
  misc_feature (206)..(206): Xaa can be any naturally occurring amino acid
  misc_feature (219)..(219): Xaa can be any naturally occurring amino acid
MGDSRRHEPWVILQPDGWLRRPALGLNSLMQIPDKIQSSLKVQFGRFLNKDGAARRMSAEISSEKAKQSCSAAASAEVRLDRHLQAWWDNPSWTDEPPEIKVNVPEGSLCNLNLRFKAGLPPDAVYNIIIDPENKRVFKNIKEVISRKVLLDEGSRQVVEVEQAAIWKFLWXKFRQGRAGFMRKFEGCWTIEPLFVDXELCLPLNXTFIGGYESCTGGXGRVGSAIYFGQLIEPALY

SEQ ID NO: 45878 - protein, 257 aa, Triticum aestivum
APVGAGETAVGVGTVGSSEAIMLAGLAFKRRWQNRRKAEGKPYDKPNIVTGANVQVCWEKFARYFEVELKEVKLSEGCYVMDPDKAVEMVDENTIFVAAILGSTLTGEFEDVKRLNDLLAAKNKRTRWDTPIHVDAASGGFIAPFLYPELEWDFRLPLVKSINVSGHKYGLVYPGVGWVIWRNKEDLPDELIFHINYLGADQPTFTLNFSKGSSQIIAQYYQFLRLGFEGYKNVMENCMESARTLREGLLRTGRFDV

SEQ ID NO: 45879 - protein, 330 aa, Bacillus subtilis
  misc_feature (4)..(4): Xaa can be any naturally occurring amino acid
  misc_feature (63)..(63): Xaa can be any naturally occurring amino acid
  misc_feature (75)..(75): Xaa can be any naturally occurring amino acid
  misc_feature (89)..(89): Xaa can be any naturally occurring amino acid
  misc_feature (127)..(127): Xaa can be any naturally occurring amino acid
  misc_feature (155)..(155): Xaa can be any naturally occurring amino acid
  misc_feature (210)..(210): Xaa can be any naturally occurring amino acid
  misc_feature (250)..(250): Xaa can be any naturally occurring amino acid
  misc_feature (255)..(255): Xaa can be any naturally occurring amino acid
  misc_feature (279)..(279): Xaa can be any naturally occurring amino acid
  misc_feature (316)..(316): Xaa can be any naturally occurring amino acid
  misc_feature (321)..(321): Xaa can be any naturally occurring amino acid
SNAXKELIKEHQKDINPALQLHDWVEYYRPFAANGQSANYIPALGKVNDSQLGICVLEPDGTXIHAGDWNVSFTXQSISKVISFIAACXSRGIPYVLDRVDVEPTGDAFNSIIRLEINKPGKPFNPXINAGALTIASILPGESAYEKLEFLYSVXETLIGKRPRIHEEVFRSEWETAHRNRALAYYLKETNFLEAEVEETLEVYLKQCAXESTTEDIALIGLILAHDGYHPIRHEQVIPKDVAKLAKALXLTCGXYNASGKYAAFVGVPAKSGVSGGIXALVPPSARREQPFQSGCGIGIYGPAIDEYGNSLTGGXLLKHXAQEWELSIF

SEQ ID NO: 45880 - protein, 267 aa, Physcomitrella patens subsp. patens
MGANGKRFRKRNAPEAGEQSDDDEEIRSTLEEVKFLQKQRERRNGVVANQLGQSLGGLNPKVADKGEGEGEKEEQVLQDTFAQETAVTIEDPNMLKYIEQEMAKKRGRELGVVEEESKPPEDDLYVIPEHLKVRRRNAEESSTQWTTGIAEVQLPIEYKLKNIEETEAAKKQLQDKRPFVGRGRTQSSIPASYSADYFQRGREYAEKLRSEHPEPFKDKGRGGGAGRGDPIGSNSEKLDLGNRRQAATDEIMLERFRKRERSRLMRR

SEQ ID NO: 45881 - protein, 254 aa, Bacillus subtilis subsp. subtilis str. 168
MGYLHDAFSLKGKTALVTGPGTGIGQGIAKALAGAGADIIGTSHTSSLSETQQLVEQEGRIFTSFTLDMSKPEAIKDSAAELFENRQIDILVNNAGIIHREKAEDFPEENWQHVLNVNLNSLFILTQLAGRHMLKRGHGKIINIASLLSFQGGILVPAYTASKHAVAGLTKSFANEWAASGIQVNAIAPGYISTANTKPIRDDEKRNEDILKRIPAGRWGQADDIGGTAVFLASRASDYVNGHILAVDGGWLSR

SEQ ID NO: 45882 - protein, 452 aa, Staphylococcus epidermidis ATCC 12228
MAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTAGETKDPEKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 45883 - protein, 585 aa, Staphylococcus epidermidis ATCC 12228
MRKTKIVCTIGPASESEEMLEKLMNAGMNVARLNFSHGSHEEHKARIDTIRKVAKRLNKTIGLLLDTKGPEIRTHNMKDGLIVLEKGKEVIVSMNEVEGTPEKFSVTYENLINDVNIGSYILLDDGLVELQVKEINKDKGEVKCDILNTGELKNKKGVNLPGVKVNLPGITDKDADDIRFGIKENVDFIAASFVRRPSDVLDIRQILEEEKAEITIFPKIENQEGIDNIEEILEVSDGLMVARGDMGVEIPPESVPMVQKDLIRKCNKLGKPVITATQMLDSMQRNPRATRAEASDVANAIYDGTDAVMLSGETAAGQYPEEAVKTMRNIAVSAEAAQDYKKLLSDRTKLVETSLVNAIGVSVAHTALNLNVKAIVAATESGSTARTISKYRPHSDIIAVTPSEKTARQCAIVWGVNPVVKEGRKTTDALLNNAVATAVETGRVSNGDLIIITAGVPTGEKGTTNMMKIHLVGDEIAKGQGVGRGSVVGHAIVADSASDLEGKDLSDKVIITNSVDETLVPYVEKAIGLITEENGITSPSAIIGLEKGIPTVVGVEQATKEIKNDMLVTLDASQGKVFEGYANVL

SEQ ID NO: 45884 - protein, 387 aa, Solibacter usitatus Ellin6076
MYIKKQRLLTPGPTPLYPPALHAMMASDMHHRTEDFRKVYRACLADLKEVMGTSNDVLMFAGSGTGAMDASVSNLFSKGDKVIVCVAGKFGERWADIVKAYGLDARVITVPYGQAVQAEQVEAALKAESGAKGVFVQASETSTGAAHDVEAMGRAVAKTDAIFVVDAITGLGTMPLDIDKWGLDVVIGGSQKAFMIPPGLAFMSISPKAWKLGESGNLPHYYFNLKKEKKSGDAGESSWTPATSLILALGEALKYVKQIGMGNLIANAQMLAHATRLAAGKLGLELFSAASPGSSVTAITAPKGLDSGVIVKEFRSRFGSIIANGQGSMKGQIFRIAHLGYFDFADLFAMLAGLEIILNANGHPVQYGAGVAAAQEVYAQATVPALK

SEQ ID NO: 45885 - protein, 409 aa, Staphylococcus epidermidis ATCC 12228
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPIALDTTDTQEIIKTVKLIAPNYGGINLEDISAPRCFEIEETLKKETNIPIFHDDQHGTAIVTMAGLINALKIVDKELTNIKVVLNGSGAAGIAIVKLLHAYGVNNMIMCDSKGAIYSGRNFGMNDTKTYVAKWTNKDKVEGSLEEVIKDADVFIGVSVADILTQDMVKTMADDPIIFAMANPNPEINPNEAKQAGAKVVGTGRSDFPNQINNVLAFPGLFRGALDVEATHINEDMKKAAVEAIVHLIDENELHPDYCIPGPFDKRVAPSVAKNVAKAAMESGVARIKIDTQEIFDKTMKLTDLK

SEQ ID NO: 45886 - protein, 331 aa, Vitis vinifera
MVDRYWIAFFAVFVYLVRVFEASVGDADPLYRDCVEQCEKTGCVGERCFPHCKFPSDEPLYLRWKQWDCQSDCRYYCMLDREKEREALGNGPVKYHGKWPFKRVYGIQEPASVALSALNLAMQFHGWLSFFILLNYKLPLKPNKKAYYEYTCLWHIYGLLSMNSWFWSAVFHSRDVDLTEKLDYSSAVALLGFSLILAILRSFNVRVEAARVMVSAPLLAFVTTHILYLNFYKFDYGWNMKVCVVMGVAQLLIWAIWAGVTRHPSRWKLWTVVVGGGLAMLLEIYDFPPYEGFVDAHALWHATTIPLTYIWWSFIKDDAEFQTANLLKKVK

SEQ ID NO: 45887 - protein, 210 aa, Zea mays
  misc_feature (7)..(7): Xaa can be any naturally occurring amino acid
SVIFPYXPIPAHRRRDQARTRLAEIFATIIKSRKASGQSEEDMLQCFIDSKYKNGRQTTESEVTGLLIAALFAGQHTSSITSTWTGAYLLKFQQYFAEAVEEQKEVMKRHGDKIDHDILAEMDVLYRCIKEALRLHPPLIMLLRQSHSDFSVTTREGKEFDIPKGHIVATSPAFANRLPHIFKNPDSYDPDRFAAGREEDKVAGAFSYIS

SEQ ID NO: 45888 - protein, 100 aa, Triticum aestivum
  misc_feature (84)..(84): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKXGVPCLEVQQGLGFVFR

SEQ ID NO: 45889 - protein, 333 aa, Oryza sativa Japonica Group
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLREPSRQGLQVLICLGRCWLPLEHSAAVA

SEQ ID NO: 45890 - protein, 154 aa, Vitis vinifera
  misc_feature (8)..(8): Xaa can be any naturally occurring amino acid
  misc_feature (98)..(98): Xaa can be any naturally occurring amino acid
MDAASSSXANDMMVMDYGDEPHVLAVDDNLIDRKLIEKLLKNFSCRVTTAENGLRALEYLGLGDNQQTSHKASVSKVNLIITDYCMPGMTGYELLKRXKQQSSILKEVPVVIMSSENIPTRINKCLEEGAQMFMLKPLKQSDVKKLRCYLKHRS

SEQ ID NO: 45891 - protein, 640 aa, Vibrio vulnificus CMCP6
MITFSDIQLLRGGSPLLDQASATIHPGDKIGLVGKNGCGKSTLFALIKDELSIDAGSFSSPQHWELAWVAQETPALERSAIEYVIDGDREYRQLERQLAEAEAQEQGTRIAELHGKIETIGGYSIRARASELLDGLGFSQEQMHWNLTQFSGGWRMRLNLAQALLCRSDLLLLDEPTNHLDLDAVMWLERWLQSYPGTLMLISHDRDFLDPIVNRIVHIENQKLNEYTGNYSSFENQRAQKLILQQSMFEKQQKQMAHMQSYIDRFRYKASKARQAQSRIKALEKLEKVLPAQFDNPFSFEFREPAALPNPIMMMDDVSAGYGDNLILDKIRLNLVPGSRIGLLGRNGAGKSTLIKLLSGELKAQGGDLTYSQGVKIGYFAQHQLETLHPEETPLQHMMQIAPDKTEQELRNYLGSFGFHGDKALEKVAPFSGGEKARLVLALIVWQKPNLLLLDEPTNHLDLDMRQALTLALQTFEGAMVIVSHDRYLIRATTDDLYLVHDRQVAPFDGDLNDYYKWLTEQQKAERREAAAEMPAKDSSNSAAAKKEQKRREADFRKLTAPIRKKLTQLEAKMDKLGEALAEAEQQLSDNSLYDAENKAKLTQVLALQAQSKSALEEIEMEWMAEQEVLEQMEQEFNSQ

SEQ ID NO: 45892 - protein, 600 aa, Vibrio vulnificus CMCP6
MALTSDFLQTSVVFLSAAVVAVPLAQRSGLGSVLGYLLAGVAIGPWGLGLISDVDAILHFAELGVVLLLFLIGLELNPKKLWQMRGPILGLGGAQVVITTLLIASIIQWFSVSWNTALVIGMGLALSSTAIALKVLEEQGLARTETGQSGFAVLLFQDIAVIPMLALLPLLAGSGMSGDWLSSLLTFSAVVGLLVGGHFLLRPLFRYVVLTGVRELFTVTALLVVLGIAMLMQQLGLSMALGTFLAGVLLAESEYRHELEIAIEPFKGLLLGLFFIAVGMAVNLGLLVVHPIEVISAVLGLVALKGAVLYLLGRVSRMRAKARSRMAAILSQGGEFAFVIFTAASKEGLLNPSEVSFLLVVVSLSMVTTPLLLNIQKWWYARTLNQESDVLAPDVVDTEPRVIIAGFGRFGQIVGRLLYANKIKVTVLESDASQIQLLRKYGYKVFYGDATQLDLLRAAGAAKAEALVICTDSPDQVMSIVELCQQHFPNLKVLARARSRVEAYQLLSHGVSTYSRETFLGALDLGRQTLVEIGMHPYQAKRAEAHFRKLDNAMLKELLPQHNQDKKLAQRAKEARKELEEIFAHEMENDHQSRNFWDER

SEQ ID NO: 45893 - protein, 335 aa, Vibrio angustum S14
MKTLVVEKPYTFKYEETNIQKPELNTVTLRVLAVGICGTDIHAYTGNQPFFTYPRVLGHEVCGEITEVGENVTQWKKGDRVALIPYVSCQVCSSCQSGRPNCCENISVIGVHENGGFCEYLNVPASQLLSVTDVEPSTAALIEPFAISAHAVRRANVQKGQDILVVGAGPIGLGAAAIAKSDGANVIVADTSEERRKHIEKVVGVKAITPDEEAVRECFSGALALTVIDATGNANAMNNAVNLIRNGGTIVYVGLHKGNLEISDPDFHKKETTLMGSRNATLEDFEKVARLMASKDISAEMMLTHSFMFSELAEIYQEQVIDNKKLLKAVVLMSE

SEQ ID NO: 45894 - protein, 310 aa, Vibrio angustum S14
MADITISVIGECMVELQKSGELYNPNFGGDTLNTALYLARLVNRKNISINYVTGLGEDIFSHKMVKAWQAENINTDLVHTSATKNAGLYVIDTDSDGERSFHYWRSDSAARYWLLDVSVPDLVSKLSQSQWIYLSGISLAILPKQALEILFDVLHQCHRQGTKIAFDNNYRANLWSSREEAQSAYRRILKMTDLAFLTFDDEQALFGDASESQSIERAQAMGIDEIVIKRGSNACFVVKDDQLHEVPARHISNIIDTTAAGDSFSAGYMASRFIECDVLKAAAMGHLLAGTVIQYPGAIIPLDVMPQLNN

SEQ ID NO: 45895 - protein, 781 aa, Oryza sativa
PTLDAISPGQELAGDDRLVSSNGKFALGFFNTGSNKSSSNSTPNIYLGIWFNTVPKFTPVWVANGENPVADLASCKLLVSSDGNLAIVATTHAKNSSMVWSSKANIPTNTTHAVLLDDGNLVLRSTSTTNASSTILWQSFDHPTDTVLQGGKIGWNNATGVNRRLVSRKNTVDQAPGMYSFELLGHNGPTSMVSTFNSSNPYWSSGDWNGRYFSNIPETVGQTWLSLNFTSNEQEKYIEYAIADPTVLSRTILDVSGQLKALVWFEGSRDWQTIFTAPKSQCDVYAFCGPFTVCNDITFPSCTCMKGFSVQSPEDWELDDRTGGCVRNTPLLCNSNKTAAGTADKFYPMTSVQLPDKAQSIGAATSADECAAACLSSCSCTAYSYGEGGCSVWHDKLLNVRQQGNGVLYLRLSAKEVLESRRNNRWGVILGASIGASTAALGLIFLLMIWIRKGKRYNLTMDNVQGGMGIIAFRYVDLQHATKNFSEKLGAGSFGSVFKGSLSDSTIIAVKRLDGARQGEKQFRAEVSSIGIIQHVNLVKLIGFCCEGDRRLLVYEHMPKSSLDAHLFPSSGAVLSWTIRYQIALGVARGLAYLHSSCRDCIIHCDIKPENILLDSSFTPKVADFGMAKFLGRDFSHVVTTMRGTIGYLAPEWISGTAITSKVDVYSYGMVLLEIISGSRNSSKQSSRDGVHEACFPVQVARNLLNRDIDSLVDANLHGEVKLEQVERVCKVACWCIQDNEFDRPTMSEVLQFLEGLSEVETPPMPRLLHTLAGGLDSKIM

SEQ ID NO: 45896 - protein, 478 aa, Lactobacillus acidophilus
MSEGEIVQVIGPVVDVKFPIDKNLPDINNALRVIKSEDESIVLEVTLELGDGVLRTIAMESTDGLRRGMKVEDTGAPISVPVGEDTLGRVFNVLGQPIDGGPALPKDHPREGIHKEAPKYENLTTSRKNLETGIKVIDLLEPYVRGGKVGLFGGAGVGKTTIIQKIIHNIAQEHGGISVFTGVGERTREGNDLYFEMKASGVLSKTAMVFGQMNEPPGARMRVALTGLTLAEYFRDVEGQDVLLFIDNIFRFTQAGSEVSALLGRMPSAVGYQPTITRMGQLQERITSTKKGSITSIQAVYVPADDYTDPAPSTTFAYLDATTNLERSLVEQGIYPAVDPLESSSSALDPEEVGQEHYEVATRVQHVLQRYHELQDIISVLGMDELSDEEKLIVARARKVQFFLSQNFFVAEQFTGVPGSYVPIKETIKGFKLILDGHLDDLPEDAFRGVGPIEDVLKKAQEMGVTPSDPEAKALLEK

SEQ ID NO: 45897 - protein, 128 aa, Photobacterium sp. SKA34
MKNKSDAYWQEKLSEMAYQVCRQQATEPPYSGKLLHNHKTGIYSCTCCGSSLFSSDSKYDSGCGWPSFDAPLNDDCISYIEDNSHGMKRIEIRCKSCDSHLGHVFNDGPQTTGERYCVNSISLIFTDE

SEQ ID NO: 45898 - protein, 386 aa, Escherichia coli K12
MTNNPLIPQSKLPQLGTTIFTQMSALAQQHQAINLSQGFPDFDGPRYLQERLAHHVAQGANQYAPMTGVQALREAIAQKTERLYGYQPDADSDITVTAGATEALYAAITALVRNGDEVICFDPSYDSYAPAIALSGGIVKRMALQPPHFRVDWQEFAALLSERTRLVILNTPHNPSATVWQQADFAALWQAIAGHEIFVISDEVYEHINFSQQGHASVLAHPQLRERAVAVSSFGKTYHMTGWKVGYCVAPAPISAEIRKVHQYLTFSVNTPAQLALADMLRAEPEHYLALPDFYRQKRDILVNALNESRLEILPCEGTYFLLVDYSAVSTLDDVEFCQWLTQEHGVAAIPLSVFCADPFPHKLIRLCFAKKESTLLAAAERLRQL

SEQ ID NO: 45899 - protein, 291 aa, Triticum aestivum
  misc_feature (57)..(57): Xaa can be any naturally occurring amino acid
  misc_feature (60)..(60): Xaa can be any naturally occurring amino acid
  misc_feature (69)..(69): Xaa can be any naturally occurring amino acid
  misc_feature (112)..(112): Xaa can be any naturally occurring amino acid
  misc_feature (149)..(149): Xaa can be any naturally occurring amino acid
  misc_feature (164)..(164): Xaa can be any naturally occurring amino acid
  misc_feature (175)..(175): Xaa can be any naturally occurring amino acid
MEGKEEDVRLGANKYSERQPIGTAAQGSEDKDYKEPPPAPLFEPGELKSWSFYRAGXAEXMATFLFLYXTILTVMGYSGAASKCATVGIQGIAWSFGGMIFALVYCTAGISXGGHINPAVTFGLFLARKLSLTRAVFYIIMQCLGAICXGAGVVKGFQQGPVHXATAGGANVVAXGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAVYHQVVIRAIPFKTKS

SEQ ID NO: 45900 - protein, 241 aa, Prototheca wickerhamii
DCISRWCVGKEVQLCRRKPPLPVGLAVHARMEAAPGTLRRTDSEVQSVQSVQLAGMVTGMWNTLKDNAAASVREAKPWAELFERNTFAKPKSGEALTRLRKNFSYFRVNYGIVGVGTTALVMLLNPWSLVVLAGLALVWMYAYIIHPAPIPFNGRELSDREKFAVLAGSSLVTIFFLTSVGTTLFYALGLSAVIIGLHGVLKVPDDLFLDDVPAAQTTGLLSFFQGPVGPPTRPPTVVTVV

SEQ ID NO: 45901 - protein, 500 aa, Streptomyces cinnamonensis
MTKTVNHWIGGKAVEGASGNHGPVTDPATGAVTTQVAFASVDEVDAAVGAAREAFATWGTSSLAKRTAILFKFRALLDANRDAIAELIVAEHGKVHSDALGEVARGLEIVDLACGITVQLKGELSTEVASRVDVSSIRQPLGVVAGITPFNFPAMVPMWMFPLAIACGNTFVLKPSEKDPSASMKIAELLSEAGLPDGVFNVVHGDKVAVDRLLEHPDVAAVSFVGSTPIARHIHATASANGKRVQALGGAKNHMLVLPDADLDAAADAAVSAAYGSAGERCMAISAVVAVGSIADELVAKIKERAEKIKIGPGNDPTSEMGPLITAAHRDKVASYVTGAAAEGCEVVLDGTGYTVEGYEDGHWIGLSLLDRVPTTAKAYRDEIFGPVLCVLRVDTYDEGVALMNASPFGNGTAIFTRDGGAARRFQLEIEAGMVGVNVPIPVPVGYHSFGGWKDSLFGDHHIYGNDGTHFYTRGKVVTTRWPDPSDAPAGVDLGFPRNH

SEQ ID NO: 45902 - protein, 827 aa, Rhodobacter capsulatus
MIPLTSELVAIGKTATDKADAIAQAVDLLTAAGKIDPRYGQSMMGREAVANTFLGNGIAIPHGLPQDRDLIHDTAIAVVQLPAGVEWAPGDTARLVVAIAAKSDEHLQVLSNLTDVLGDEAEAERLATTLDAAVIVARLTGAAAPVAAPAETPADFAQGIDVVVTGAHGLHARPATTLVDLAKGFAAEIRIRNGAKVANGKSLISLLNLGAAQGAALRISAEGADATAALAAIAAAFEAGLEDEEDTGAAAPEAATPGLTGAGASMASYEGRTLVGISSSPGYALAPVFRFARDEVVFDTDAADAAFETDRLDTALQTAWHELEELHDEVWKTSGPARAAIFRAHQEFLHDPEMVAEAKALIGQGRSAGFAWHRVFSDRADMLGAMKDAVLSGRAIDLRDAGQRVLQHLGRVRTGETHLPTAPCILLADDLTPSDTARLDPALVRGLATAQGGPTSHTSIIARALDIPAVAGVGPRLLDLATGTPVLLDGGAGVIVVAPTEADKARAETAMAALTAQRELEARERYKPALTVDGARVEVVANISDVAEAIASVEAGAEGVGLLRTEFLFVNREAPPGEDEQLAIYAAMLSALNGLPIIIRTLDVGGDKEIPYLRMPVEQNPFLGERGIRFCLSHEDLFRTQLRAIYRASAGGQVRIMFPMIAMIEELETARRIAEEVRLEVGAAPVEIGIMIEIPSAVMMAPELAKRVDFFSIGTNDLTQYALAMDRMHPVLAKQADGLHPAVLRLIDSTVRAAEAARIWVGACGGIAGDPVGAAVLSGLGVRELSVSIPAVAGIKAQLRHSAMAENRDLARRALACTTAAEVRGLK

SEQ ID NO: 45903 - protein, 459 aa, Photorhabdus luminescens subsp. laumondii TTO1
MAGQSQRSTLKRGLKNRHIQLIALGGSVGTGLFLGIAQTIKMAGPSVILGYAIAGFIAFLIMRQLGEMVVEEPVAGSFSHFAYKYWGDFPGFLSGWNYWAMFTLVGMAELTAVGMYIHYWWPDIPTWVSATIFFVLINTVNLINVRLYGETEFWFSIIKVTAIICMIVFGSYLLVSGNGGPQASITNLWQHGGFMPNGISSLIMAMAVIMFSFGGLELVGITAAEAENPRISIPKATNQVVYRILIFYIGSLTVLLSLYPWGNVVEGESPFVMIFHNLDSFWVANILNIVVLTAALSVYNSGVYCNSRMLYGLAKQGNAPEMLTKVNESGVPIRAIVMSALATSIGVLINYVMPGKAFELLMALVVTTLVINWVMICMAHLKFRAEKVKQGIAPSFKAFWYPFGNYLCLVFLAFILVIILMMDSIRISVILMPFWVGVLWLGFLMSHSRRDKMKTEELG

SEQ ID NO: 45904 - protein, 422 aa, Frankia sp. EAN1pec
MALLVAKFGGSSVADADRIKRVADRIVQTRRAGNDVVVVVSAMGDTTDDLLDLAEQVSPLPPARELDMLLTAGERISMALLAMAITKLGAEARSFTGSQAGVITDSVHGRARIIDVTPGRIRTALDEGAIAIVAGFQGVSQDTKDITTLGRGGSDTTAVALAAALGADACEIYTDVDGVFTADPRIVPDARRIERISYEEMMEMAACGAKVLMLRCVEYARRYSVPVHVRSSFSSKPGTWVTETPEAQLVEQAIIRGVAHDSSEAKVTVKGCPDKPGVAAAVFRAVADADVNLDMIVQVGSVAGSGRTDISFTLPMADGRTALGALEKVREQIGFERTLYDDHIGKLSLIGAGMKSHPGVSARFFGALADSGVNVEIISTSEIRISVVVRDTDLPVAVRAVHAAFELGNPDESAVVYAGTGR

SEQ ID NO: 45905 - protein, 432 aa, Cryptococcus neoformans var. neoformans
MGGCMSTPEAPKKTAETKQVPSSSTSSRPPQASTSATATAAGAGTSAANGTANGIKGDTTATNRVGTSGGQGLAAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDAGLDAVIPSEILYNIESLWHDPVIPSVMDRSSEFYLMDSATYFFANIRKIAGPDYVPDEADVLRARTKTTGISETRFNMGQLSIHMFDVGGQRSERKKWIHCFEAVTSIIFCVALSEYDQVLLEESGQNRMQESLVLFESVINSRWFLRTSVILFLNKIDLFKQKLPKVPLVQYFPEYTGGADINKAAKYILWRFTQTNRARLSVYPHLTQATDTSNIRLVFAAVKETILQNALRDSGIL

SEQ ID NO: 45906 - protein, 431 aa, Synechococcus elongatus PCC 7942
MIHEVFMPALSSTMTEGKIVEWVKAPGDRVEKGETVLIVESDKADMDVESFYEGYLATIIVPAGGNAPVGEAIALIAETEAEIEVAKQQAAGAGSAAATPATPAATAAPEPVAVSPEPVAAPTATRSDRLVASPRAKKLAKSLGVDLASLTGSGPHGRIVAADVEAAAGVTAKPAIATPVAPAVVTAPVAAPVATAPAAPAPTPAIAPGQFVPYSTFQQAVVRNMEASLNVPVFRVGYTITTDAIDSLAKQLKPKGVTITVLLAKAVAATLAKHPLLNARATETGVQYNEAINVAIAVAMDDGGLLTPVLGRADQTDLYSLARNWKDLVARSRTKQLKPEEYTTGTFTLSNLGMFGVDRFDAILPPGTGAILAIGASKPTLVATADGLFGVKRQMQVNLTCDHRHIYGAHAAAFLKDLADLIENRPESLTL

SEQ ID NO: 45907 - protein, 461 aa, Escherichia coli W3110
MAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYDGDRTPVSET

SEQ ID NO: 45908 - protein, 916 aa, Streptomyces avermitilis MA-4680
MSENKDPQVADVAESGVAGVKFVYDFTEGNKDLKDLLGGKGANLAEMTNLGLPVPPGFTITTEACKTYLDSGEEPAALRDEVSAHLDALEAKMGKKLGQADDPLLVSVRSGAKFSMPGMMDTVLNIGLSDKSVQGLAKQAGDDRFAWDSYRRLIQMFGKTVLGVDGELFEDALEAAKAAKKVTIDTDLEAADLKRLVTKFKKIVKTEAGRDFPQDAREQMDLAIHAVFDSWNTDRAKLYRRQERIPHDLGTAVNVCSMVFGNLGPDSGTGVAFTRDPASGHQGVYGDYLQNAQGEDVVAGIRNTVPLAELEQIDKKSYDQLMQIMATLENHYKDLCDIEFTIERGQLWMLQTRVGKRTAGAAFRIATQLVDQGLIDEAEALQRVNGAQLAQLMFPRFDDQAKVEQIGRGIAASPGAAVGKAVFDSYTAIKWSRSGEKVILIRRETNPDDLDGMIAAEGILTSRGGKTSHAAVVARGMGKTCVCGAEELEVDTKRRRMTAPGGVVVEEGDVVSIDGSSGKVYLGEVPVVPSPVVEYFEGRMHAGADDADELVAAVHRIMAFADRKRRLRVRANADNAEDALRARRFGAQGIGLCRTEHMFLGDRRELVERLILADTDAEREESLKELLPLQKKDFIELFEAMDGLPVTVRLLDPPLHEFLPDITELSVRVALAESRKDSNENDLRLLQAVHRLHEQNPMLGLRGVRLGLVIPGLFTMQVRAIAEAAAERKAAKGDPRAEIMIPLVGTVQELEIVRDEADQVIAEVQAATGTELKLAIGTMIELPRAALTAGQIAEAAEFFSFGTNDLTQTVWGFSRDDVEASFFTAYLEKGIFGVSPFETIDKDGVGKLVRDAAVAGRATRPDLKLGVCGEHGGDPESVHFFHEVGLDYVSCSPFRIPVARLEAGRAASQSAGSDHR

SEQ ID NO: 45909 - protein, 476 aa, Phaeosphaeria nodorum
MFSHLLKPAARSAGLLGHVNRRYLATVHTNTAREIPKPSRKPTPISLENATFTIKNGPIFSGKSFGAKANISGEAVFTTSLVGYPESMTDPSYRGQILVFTQPLIGNYGVPSSARDEHGLLRYFESPNIQASGIVVQDYALKHSHWTAVESLAQWCAREGVPAISGVDTREVVTYLREQGSSLARITVGEEYDADEDEAYIDPEAINLVRRVSTKAPFHVSSSLGDMHVALIDCGVKENILRSLVSRGASVTCFPFDYPIHKVAHHFDGVFISNGPGDPTHCTSTVYNLRKLFETSQLPVMGICMGHQLIALAAGAKTIKLKYGNRAHNIPALDLTTGKCHITSQNHGYAVDPTTLTSEWKEYFTNLNDQSNEGLIHASRPIFSAQFHPEAKGGPMDSSYLFDKYIQNVQRYKDHQSSFSEKSNKPSPLLVDLLSKERVGVHPAQPDFEMHVPGRVEQVDVGGPVAPPYQPITAAA

SEQ ID NO: 45910 - protein, 337 aa, Daucus carota
MAPIKIGINGFGRIGRLVARVALQRDDVELVAVNDPFISTDYMTYMFKYDSVHGAWKHHELKVKDEKTLLFGEKPVAVFGCRNPEEIPWASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYDQIKAAIKEESEGKLKGILGYTEDDVVSTDFVGDSRSSIFDAKAGIALNDNFVKLVSWYDNEWGYSTRVVDLIVHMASVQ

SEQ ID NO: 45911 - protein, 430 aa, Synechococcus elongatus PCC 6301
MKNVLAIILGGGAGSRLYPLTKQRAKPAVPLAGKYRLIDIPVSNCINADINKIYVLTQFNSASLNRHLSQTYNLSSGFGNGFVEVLAAQITPENPNWFQGTADAVRQYLWLIKEWDVDEYLILSGDHLYRMDYSQFIQRHRDTNADITLSVLPIDEKRASDFGLMKLDGSGRVVEFSEKPKGDELRAMQVDTTILGLDPVAAAAQPFIASMGIYVFKRDVLIDLLSHHPEQTDFGKEVIPAAATRYNTQAFLFNDYWEDIGTIASFYEANLALTQQPSPPFSFYDEQAPIYTRARYLPPTKLLDCQVTQSIIGEGCILKQCTVQNSVLGIRSRIEADCVIQDALLMGADFYETSELRHQNRANGKVPMGIGSGSTIRRAIVDKNAHIGQNVQIVNKDHVEEADREDLGFMIRSGIVVVVKGAVIPDNTVI

SEQ ID NO: 45912 - protein, 400 aa, Pseudomonas syringae pv. tomato str. DC3000
MTTACLMSTYQPLALSFTRGLGTRLWDQSGREYLDAVAGVAVTNVGHSHPMLVDAIRDQAGLLLHTSNLYSIDWQQRLAQKLTRLAGMDRVFFNNSGAEANETALKLARLHGWHKYIEQPLVVVMENAFHGRTLGTLAASDGPAVRLSYSDLPGDYIKVPFGDLLAFDKVCVTHGHRIAAVLVEPIQGEGGAQVAPAGYLKALRERCTRRDWLLMLDEIQTGMGRTGKWFAFQHEGIVPDVMTLAKGLGNGVPIGACLARGKAAELFTPGSHGSTFGGNPLACRVGCTVIDIIEQQALVENAGVRGQHLLGRLQEVLGGHPQVMQVRGRGLMIGIELREAIPELTRIAAEQHGLLINVTRGKVIRLLPPLVLEAAEVEQIVQGLAASLDSASYRALERSA

SEQ ID NO: 45913 - protein, 405 aa, Bacillus clausii KSM-K16
MKIIIQKFGGTSVKTDESRLQAVRHVQKAVNDGYKVVVVVSAMGRKGDPYATDTLLSLVSKSRITKREQDLLVSCGETISAVVFSDLLNAHGVQATAMNGAKAGFRTNEEFGNAKIKEMKCEHLLKKLETEDVVVVAGFQGQSKSGDVTTLGRGASDTSATALGAALHAEWVDIFTDVEGVMTADPRIVSDARALEAMSYNEICNMAYQGAKVIHPRAVEIAMQAKIPIRIRSTYSDNEGTLVTALGASHSMDVNERMITGIAHVANVTQIKVAAKEGQLDLQENVFKSMAQAKISVDFINISPSGVTYTVSDEAADKAKQVLEHLGYTPELRRGCAKVSAVGAGMSGVPGVAAKIVSALSGENVQILQSADSHTTIWVLVKNEDMKKAVNALHKMFQLSEATTV

SEQ ID NO: 45914 - protein, 247 aa, Trifolium repens
NIAVGTPAEATHPDTLKAGLAELISTFIFVFAGSGSGIAYNKLTDNGAASPAGLISASIAHAFALFVAVSVGANISGGHVNPAVTFGAFVGGNITLFRGIVYIIAQLIGSVLASLLLVFVTASSVPAFALSEGVGIGPALVLEIVMTFGLVYTVYATAVDPKKGNIGIIAPIAIGFIVGANILVGGAFTGASMNPAVSFGPAVVSWSWSNHWIYWAGPLIGGGIAGIIYEVLFISHTGHEQLPTTDY

SEQ ID NO: 45915 - protein, 197 aa, Listeria monocytogenes str. 1/2a F6854
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKG

SEQ ID NO: 45916 - protein, 326 aa, Pediococcus pentosaceus ATCC 25745
MSEHYSDPKLKIFALNSNKPLAEKIAKAVGVELGKTSVDRFRDGEIRINIEESIRGDEVYIVQSTSAPVNDNLMEMLIMIDALKRASAKTINIVIPYYGYARQDRKARSREPITAKLVANMIERAGATRIIALDLHAAQIQGFFDIPLDHLMGAPLLADHFIERGLDQDTVVVSPDHGGVTRARKLAEFLKAPIAIIDKRRPRANVAEVMNIIGEVKGKRCIMIDDMIDTAGTITLGAQALMDAGATEVYASCTHPVLSGPAIERIQNSPIKELIVTDSIQLPEEKKIDKITSISVGPLIGEAIRLIHENKPVSPLFNNRFSIEKE

SEQ ID NO: 45917 - protein, 263 aa, Physcomitrella patens subsp. patens
MRREARWDSIKEPALASYLYSTILSHRTLERALAFHLGNKLSSSTLLSTQLFSLLNDTFMEDADIRRAIRDDIEAVKERDPACVSYTHCLLNFKGFLSCQAHRVAHRLWNQGRHSLALAIQSRVSEVFQVDIHPAARIGSGVLFDHATGVVVGETAVIGNNVSILHHVTLGGTGAVGGDRHPKIGDGVLIGAGATILGNITIGAGAKIGAGSIVLIDVPPHTTAVGNPARLIGGKQKPTKLKEIPGETMDHTFFMKDWSDYVI

SEQ ID NO: 45918 - protein, 414 aa, Bacillus clausii KSM-K16
MIKKETLDNGVRIIAEANEAIRSVAIGIWVKTGSRNESNEENGISHFIEHMLFKGTKTRSAKQIAEAFDRIGGQVNAFTAKEYTCYYAKVLDEHAALALDVLQDMFFDSIFDKTEIEREKKVVLEEIKMVEDTPDDLVHDLLSQAVFGRSSLANPILGTEDTLQTFSRQQISDYMKRFYAGERVVVSVCGHFDDALLEQIRQTFSRVKRAPEPFAVPTATFSPTVKYRQKDSEQAHLCLAYPGLEIGSNRSFGLILLNNALGGSMSSRLFQTIREEQGLCYSVFSYHSSYEQIGTLTIYAGTQMAQLPKLTEALAEVTKAVRAEGLSKKELENGKEQLKGSIMLGLESTSSRMTRNGKNELLLQEHKTLDELIADINAVSLEMVNDLASQLLRDTPAVSLVASSETMPSTIFSN

SEQ ID NO: 45919 - protein, 240 aa, Bacillus cereus G9241
MASMKKALIIETKSNAADLVTNMDREIEQFLIGKIKETFPHHHILGEEGYGDEVTSSDGVVWLIDPIDGTMNFVHQKRNFAISIGIYENGIGKIGLIYDPVHDELYHALKGAGAFCNEVPIPLLQKGTVEQGIVAINAIWLTDNPLLNMKSMMALVKKARGTRSYGCAALEMVYVATGRIDAYVTPRLSPWDFGGGQIIVEEVGGKVTTFSGAPLSIVEKSSVLVAKPGVYEEVLSFISK

SEQ ID NO: 45920 - protein, 412 aa, Escherichia coli K12
MKALTYHGPHHVQVENVPDPGVEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLHFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLSFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 45921 - protein, 706 aa, Magnaporthe grisea 70-15
MAKYVDAAKQDLREDVTWQKAGRLSRRGIKEFPEASVQYLLDKAPIIGWLPKYNPRWLINDAIAGLTLGLMLIPQGLAYAKIAEIPVEYGLMSSWLPASIYAIMGTTKDLSTGPTSLIGLLTSEGVHEFGEEYTPSQVASAMALWMGVFGMVLGFLKLGWLLEFISLPILSGFITAVAITIALNQMPSLLGISGVGSGTAQQIHDVFAFLPRASLMTCVIGFTGILMMTILEKMGKRWSDKNKIIWFCSITRAFLTLVLFTGVSYAVNGKKANAKQYMFEVVQVKAQGLEQPGMPPSDLIMKTATRSIALFIAAAVEHSAIARAFGVKNDYIPDQSQELCYFGVTNFVNSFFHAMGVGGAMSRTSVNSQCHVKSPLSGLMTTAVVLISIYFLVGTLYWIPKATLAAIIITAVWPLIHPPSDFYRYWKTSLADFISSMIALWVSLFYSTEMGIGLAVGFNVLYCILRQTFTRVTASGIPAPSDISDRDLPHPDSPQARDVHVFRFNDSFFFPNSYMCSTAILDSIQTYHAPAYHGAQGPEVRERNWSVVAEKRIQRLRRRAGVTDPDALPPIGLVVLDFGRVNHVDSTACSHLKNLAKEISRYGGKHVELRFVGMTEYVRERFVRYGWKVDDAPAWAGPAPDKDATLLFPTVAAAVLAPRRNDAPEVVQHDFDEKRSSSEDLEKGMAMHAETADRSSSQERKTEARP

SEQ ID NO: 45922 - protein, 89 aa, Glycine max
TRPAESLRGIMIEIEYLPISSVEKSKQILEEFIDIWKEVVSKKSLAGQFMHTEPNYAEYGLSDNYTSQHTAVQYAAALAQLIQSAQLRN

SEQ ID NO: 45923 - protein, 457 aa, Photobacterium sp. SKA34
MPQNWQKSSHGNQKSDDKELKIQFNYRMEITMKYSLENTKIGIIGLGYVGLPLAVEFGKKQQTLGFDINVKRVAQLLDGNDFTLECTSEELSEATLLEYSANIEDLKKCNVYIVTVPTPIDEYKQPDLTPLVKASETLGKVLKVNDVVIYESTVYPGATEEVCIPVLESVSGLTFNKDFYAGYSPERINPGDKEHRVTTIKKVTSGSTPEIAEYVDAIYRQIIVAGTHKASSIKVAEAAKVIENTQRDLNIALINELAVIFNKLGIDTEEVLKAAGTKWNFLPFRPGLVGGHCIGVDPYYLTHKAQAIGYHPEVILAGRRINDSMGSYVVSQLVKAMLQKSILVKGADILIMGLTFKENCPDLRNTRVVDIISELSEYNTNVDIYDPWICPKEAKNEYDVDVLTDKPNKQYDAVIVAVAHDKFKAMTIEEYQALTKKESVIYDLKYVLDTSVSDIRL

SEQ ID NO: 45924 - protein, 340 aa, Photobacterium sp. SKA34
MTKYEQINKELLASPKTWLITGVAGFIGSNLLEKLLKLNQTVVGLDNFATGHQHNLDEVKSLVTELQWDRFTFIEGDIRDYKTCQLAVKDVDYVLHEAALGSVPRSINDPLTTDSVNIGGFLNMLTASKEEQVKSFTYAASSSTYGDHPALPKVEENIGNPLSPYAVTKYVNELYAGVFARTYGFKTIGLRYFNVFGKRQEPNGAYAAVIPKWTSAMINNEEVFINGDGETSRDFCFIENTVQMNILAATASEEAKDSVYNVAVGDRTTLNDLYRSIQSALAENNISHTIEPTYRDFRAGDVRHSQADITKATNQLGYQPEYRIFAGISKAMPWYKKFLG

SEQ ID NO: 45925 - protein, 377 aa, Thermoplasma acidophilum
MQYINESATVSASNNVEKLRKQGLKIYNFGIGEPDFTTPEGIIDYAFEMAKQGKTHYTPSAGIMELREKIASKLKTRNRIDANAENVLVTPTKFGINLAMMVILNPGDEVIIPDPYYVSYPDIVKLAGGKPVPVRTTDDYDIDLDEMRKFVTPRTRAIILNNPNNPTGKVLSEKEIRDLVDFALENDIYIVSDEIYEDLIYEGSLYSPASMGKEAFEHTITLNGFSKGYAMTGWRIGYFVATEEIVEAANIIQQQTITCASSISQYAALRALDDNESPARMRSEFRKRRDLAYGILSESTDMKVHKPEGAFYMFPGYSKDIPSEKIAEMLLNQEHVVVTPGSAFGDRGRHHFRISFATSEDIIKEGLERLVKFMHTL

SEQ ID NO: 45926 - protein, 241 aa, Oryza sativa
  misc_feature (73)..(73): Xaa can be any naturally occurring amino acid
MAFWTQTRFFRSVGHTGEGVSEHYTSSGKRREKSKREMDHHQHHEQQQQRMVEMRMGMAMGEAYVGGGEVVAXREAAAQALGAVVQLHFDKTLEKKRAADAQKQELWRLFLAFFLFLAILLSAVAQSPPSRLQCRHLWAPAGLLSLAHLAFYAAVAHHLRCLNGFRYQRRCHKLTLALAADRLRMLKSGGDVVAAADVEVPYQEPPESYLAKFKRSWAIHFAFLITTFAFSVAAAVAILCF

SEQ ID NO: 45927 - protein, 157 aa, Brucella melitensis 16M
MEFLMSKHEADAPHLLIVEARFYDDLADALLDGAKAALDEAGATYDVVTVPGALEIPATISFALDGADNGGTEYDGFVALGTVIRGETYHFDIVSNESCRALTDLSVEESIAIGNGILTVENEEQAWVRARREDKDKGGFAARAALTMIGLRKKFGA

SEQ ID NO: 45928 - protein, 481 aa, Silicibacter sp. TM1040
MKRTRNVKIVATLGPASETYETIRALHEAGADVFRLNMSHGSHDEIAVKHKIIRQVEEDLDSTIAILADLQGPKLRVGVFANGAEELEEGANFRLDLDPAEGDLSRVCLPHPEIFQALEPGASLLVNDGKIRLKVEDCGEDYANCVVTTGGTISNRKGVNVPDVILPLAALSEKDRADLEFVCELGVDWLALSFVQRAKDVFEARALADGRAAILSKIEKPAAVDNFAEILDASDGIMVARGDLGVELPVSHVPPIQKRLVRKSRAAAKPVIVATQMLESMIESPMPTRAEVSDVATAIYEGTDAIMLSAESAAGQYPIEAVQTMDKVATEVEQDPTYRDIIAASRSSKGDTIADGIVAAAREIAEKTEIKAICCFTQSGTTALLTARERPYVPILALTPLAKTARRLCLTWGCNCVVTPKVDRFKGAVVSAARAARSGGFASETDQVVVTAGVPFNVPGTTNILRIAPCDERLIYNTDPE

SEQ ID NO: 45929 - protein, 297 aa, Oryza sativa Japonica Group
MADRVHPMPAPPPPSSSPPLEHAAAATETTPLHPSFRGARPPSPGTYIIQIPKDQVLRVPPPDRARRYKKLAARPARRRRLRHACCAAFCAALLLLLLAAAFVGAVYLVFRPRAPSFSVASLSIRGLDALAVSSLTPQIDAAVRADNGANKKTGIDYRGGGEVTVSYAGERLAAGPWPAFHQAPRNVTVFSTALAGGGVSFPEEQRKRLAAEQAAGAVPLTVEAIVPVEVREGSPDVDGGREDEVRGDGEQAGGGGAAGEQGVQGQGPAALVVVVIAGGGGAAAADGWMGSTLTATA

SEQ ID NO: 45930 - protein, 258 aa, Agrobacterium tumefaciens str. C58
MADQNMPKSAEQDTAAIVEKIAPKAGERALDHFRSLSSLPVETKGHLDLVTEADKDVEAFLIGSLREAFPDDGIMGEESGEIPGAPGGVWVIDPIDGTFNFVRGGQNWAISIGLYENRRPSFGVIYAPVRDLILVGGKTVPTRLNGQPIKPLPALDMSRASTGFSRFISDDLKISFRFCGAATLSMIEVVMGETDGYVSLGDSTWDVMAALPILGHLGISNTIDWDRIDLSSKLRFACGSEEFLSKVRPLIEKVSAAA

SEQ ID NO: 45931 - protein, 146 aa, Pseudomonas syringae pv. tomato str. DC3000
MKTVAQLLKLKDLHNQHVHTIGPNQMVLDALRLMADKNIGALPVVENGTVVGVVSERDYARKVVLKGRSSVGTPVSEIMSSKVITVDSQQTVETCMGIMTDSHLRHLPVVEDGQLLGLLSIGDLVKEAIAEQASLIQQLEQYIRGE

SEQ ID NO: 45932 - protein, 393 aa, Bacillus subtilis subsp. subtilis str. 168
MKLAKRVSALTPSTTLAITAKAKELKAAGHDVIGLGAGEPDFNTPQHIIDAAVRSMNEGHTKYTPSGGLAELKNSIAEKFKRDQNIEYKPSQIIVCTGAKHALYTLFQVILDEEDEVIIPTPYWVSYPEQVKLAGGKPVYVEGLEENHFKISPEQLKNAITEKTKAIVINSPSNPTGVMYTEEELSALGEVCLEHDILIVSDEIYEKLTYGGKKHVSIAQLSDRLKEQTVIINGVSKSHSMTGWRIGYAAGSEDIIKAMTNLASHSTSNPTSIAQYGAIAAYNGPSEPLEEMREAFEHRLNTIYAKLIEIPGFSCVKPEGAFYLFPNAKEAAQSCGFKDVDEFVKALLEEEKVAIVPGSGFGSPENVRLSYATSLDLLEEAIERIKRFVEKHS

SEQ ID NO: 45933 - protein, 280 aa, Pseudomonas syringae pv. tomato str. DC3000
MRSFDFKQLDVFSDQPLLGNPLAVVLGAEGLTDEQMAAFARWTNLSETTFLLKPTDPRADYRVRIFTTLEELPFAGHPTLGSCHAWLESGGVARGEEIIQECGIGLVRIRREGSGLAFTAPPLLRSGAVDPELIEQIRLGMKLGAGEILDARWVDNGPGWVALRLADRASVLRLQPDYAQLSGLKLGVVAPWDPVVDGDEAQFEVRAFVPGDGMAEDPVTGSLNAGIARWFLEEGLAPARYVVSQGTALGRKGRVSIQRLGDDIWVGGSTVTCIEGRVSL

SEQ ID NO: 45934 - protein, 600 aa, Solanum demissum
MAGQRNNYGKRMQSESDYSRSDGSKRRTPTDEKESNSIGPEDTVFRYLCPTGKIGSIIGVGGDIAKQLRTETNSKIRISETIPGCEERVVTIYSGSEETNVSEDTGDLISPAQDALFRVHDRVLAEDLRMDEDLEDHQQITVRMLVPSDQIGCVIGKGGQVIQNLRSETGAQIRVLSSEHLPPCALNSDELLQITGEGAVVKKALYQVAARLHDNPSRSQHQLLSSPSIFRSGAGLVNPHAGTQVMGVTSLMGPYASYKSDGRSRSSSVKEFAVRLVCPTENVGAVIGKGGGIIKQLRQESGASIKVDSAAAEGDDCIIFVSAKEAFEDQSPTIDATMRLQPRSSEKTEKESGDAILTTRLLVPSSRVGCLIGKGGSIINEMRNSTRASIRVLSKENLPKVASEDDEMVQITGDANVAANALLQVLMRLRANTFEMEGSFPAFSPGLSYVPMSASMPDGSRYGNRDNRSRRHSHSSYSGGHDYNDLSPSDSYGGSQVGGGGNYAPYGVYSSGRPSSAGFPVIEQKFKSGFCISGGTYTSYSENISGGKKALSRVLPTAFCPLEGFMKLTVMNYWGSMSTCVIPSALFHYLSMEFSLLCAV

SEQ ID NO: 45935 - protein, 319 aa, Xanthomonas oryzae pv. oryzae KACC10331
MALYDNILDTIGHTPVVKLQRLAPDNVRLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANTAYHRNTTAAEILRDFAGHRLDHFVTGWGTGGTLTGVGEILRVARPEVRITASEPAGAALLQGQDWKPHKIQGWTPDFVPEVLNRDVAHEVLSVEDTDAITVARRLAAEEGIFTGISGGATVATALQVAEGATPGAVILAMLPDTGERYFSTPLFADVNEGSDDDWLAGLP

SEQ ID NO: 45936 - protein, 1351 aa, Oryza sativa
  misc_feature (169)..(169): Xaa can be any naturally occurring amino acid
  misc_feature (489)..(489): Xaa can be any naturally occurring amino acid
  misc_feature (862)..(862): Xaa can be any naturally occurring amino acid
  misc_feature (1002)..(1002): Xaa can be any naturally occurring amino acid
  misc_feature (1016)..(1016): Xaa can be any naturally occurring amino acid
  misc_feature (1200)..(1200): Xaa can be any naturally occurring amino acid
MSQLEVVEMEDKKKQQQQREEAEAEASVVPSSLRAAATRSLSSLSSSLRWDHRGDGEEEAELTWAAIERLPTLDRMRTSVLSSEAVDVRRLGAAERRVLVERLVADIQRDNLRLLRKQRRRMERVGVRQPTVEVRWRNVRVEADCQVVSGKPLPTLLNTVLSTARGVEXRRHARIPILNDVTGILKPSRLTLLLGPPGCGKTTLLLALAGKLDKNLKVTGEVEYNGTNLNTFVPEKTSAYISQYDLHVPEMTVRETLDFSARFQGVGTRAEIMKEVIRREKEAGITPDPDIDTYMKAISVEGLERSMQTDYIMKIMGLDICADIIVGDIMRRGISGGEKKRLTTGEMIVGPSRALFMDEISTGLDSSTTFQIVSCLQQVAHISESTILVSLLQPAPETYDLFNDIILMAEGKIAYHGSKSCIMNFFESCGFKCLERKRAADFLQEVLSKKDQQQYWSHTEETYNFVTVDHFCEKFKASQVGQNLVEELXFDKSEGHNNALSLNIYSLTKWDLLKACFAREILLMRRNAFIYITKTVQLGLLAVITGTVFLRTHMGVDRAHADYYMGSLFYALLLLLVNGFPELAMAVTRLPVFYKQRDYYFYPAWAYAIPAFILKIPVSLVESITWTSISYYLIGYTPEASRFFRQLLILFLVHTGSLSLFRCVASYCQTMVVGSVGGTMSFLVILLFGGFIIPRPSMPNWLKWGFWISPLSYAEIGLTVNEFLAPRWLKTTTSGVTLGRRVIMDRGLDFSSYFYWISVGALVGFILLLNVGYAIGLTIMKPPGTSRAIISRDKFATFDRRSKDMSKDMDNRMPKLQVGNALAPNKTGTMVLPFTPLTISFQDVNYYVDTPVEMREQGYKEXKLQLLHNITGAFQPGVLSALMGVTGTGKTTLLDVLAGRKTGGVIEGDIRVGGYPKIQQTFARISGYCEQTNVHSPQITVEESVAYSAWLRLPTEVDSKTRREFVNEVIQTIELDDIRDALVGLPGVSGLSTEQRKRLTIXAVELVSNPSVIFMXLDARAAAIVMHKVKNVADTGRTVVCTIHQPSIEIFEAFDELLLMKRGGELIYAGPLGFHSCNVIHYFETIPGVPKIKDNYNPSTWMLEVTCASMEAQLGVEFAQIYRESTMCKDKDALVKSLSKPALGTSDLHFPTRFPQRFGEQLKACIWKQCLSYWRSPSYNLVRIVFITISCIVFGALFWXQGDINHINDQQGLFTILGCMYGTTLFTGINNCQSVIPFISIERSVVYRERFAGMYSPWAYSLAQVAMEIPYVLVQILLIMFIAYPMIGYAWTAAKFFWFMYTIACTLLYFLYFGMMIVSLTPNIQVASILASMFYTLQNLMSGFIVPAPQI

SEQ ID NO: 45937 - protein, 121 aa, Synechococcus elongatus PCC 6301
MAQWQCVRQCGACCHLDPRDRPDLEQYLQPEEMALYLSMVGSDGWCIHFDHDSRLCSIYDDRPRFCRVQPETFESMFGVPKEDLNDFAIACCEEQIEGVYGDRSLEQIRFRQAVGLVLEDL

SEQ ID NO: 45938 - protein, 520 aa, Acidovorax sp. JS42
MTQPLTPFDYLTKILTARVYDVAVESDLQPARALSRRLHNKVLLKREDQQPVFSFKLRGAYNKMAQLSPEQLARGVICASAGNHAQGVAMSASKLGTRAVIVMPTTTPQLKIDAVKTLGGEVVLSGESYSDAYEHAAQLQKEEGLTFVHPFDDPDVIAGQGTIAMEILRQVQQLGGKLDAVFVAIGGGGLIAGVSNYIKAVCPGIKVIGVQMNDSDAMAQSVKAHQRVTLPDVGLFSDGTAVKLVGEETFRVAQNLVDDYVIVDTDAVCAAIKDIFVDTRSIVEPAGALAVAAIKQYVAKHKTKGETYAAILCGANMNFDRLRFVAERAEVGEEREALFAVTIPEERGSFKRFCEVVGALPGGPRNVTEFNYRISHERRAHVFVGLSTTGRGESEKIARNFHKHGFEALDLTHDELAKEHLRHLVGGHSALARDERLMRFTFPERPGALFKFLSLMQPTWNISLFHYRNQGADYGRILVGMQVPADDAAQFDAFLQTLGYPYVEETQNPAYRLFLQANGA

SEQ ID NO: 45939 - protein, 419 aa, Oryza sativa
MFSSLRRASCNVAMNAKSTHWWTNVKMAPPDPILGVTDAFKRDKNPNKINLGVGAYRDDNGKPYVLECVKKAEKQLAEQNLDKEYTQITGVSDFCEAAVRLLLGDDSPAIKNKLYGVAQTISGTGGLRVGFEFLRKYSPYAKTVWMPTPTWGNHGPIANDSTFEVKYYRYYKPSNRGFDFEGCLEDLNKIPEKNVILLQSCAHNPTGVDPTQEQWKEISHVIKKRQLFPFLDTAYQGFASGDIDRDAFAPRLFARDGHEFIVAQSFSKNMGLYGERVGTVSFVVNDKQDLERILSQLRVTIRRLYSNPPRHGAQVAARVLTQPDLRALWLKEVKLMADRIITMRSTLVDNLKKEGSKHNWQHITDQIGMFCFTGLQEKQVERLIKDFSVYLTKDGRISIAGVSSKNNAYLAHAIHEVTK

SEQ ID NO: 45940 - protein, 176 aa, Myxococcus xanthus DK 1622
MGGVMGVDAMTFYRLARRLKKRGVPLLPAVLRKAIYYLHSSYIPEDAEIGEGTQLGYGGIGVVIHKAARIGRNCLISQQVTIGGRSGMEGAPVIGDYVRMGAGAKILGNIHIGDFAVIGANAVVVKDVAPGTVVAGVPARVIRQDPDPLGTYQREMGELPPRVSLVSVPSSSRLRQ

SEQ ID NO: 45941 - protein, 518 aa, Xanthomonas oryzae pv. oryzae KACC10331
MPESEDGYAAMPSLVRDVCVNFRGFYREAIMKERQRRTKILATLGPSTDAPGVLDTLFKAGVNVVRLNFSHGDPSGQAKRAAEVRAAAARVGAEVGILADLPGPKIRIERFAEGKIKLTMGDRFDLVADANAPAGDQHQVGVSYLGLPQDVTAGDVLLLDDGLMQLQVTDVQGARIVTTVLNDGVLSDRKGLNKQGGGLSLGALTERDKELIGIVAKIGVDFIAVSFCRNAQDMQDARQIAKQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPINFDSRGLTPREAARAAIRLLVENERMGPGDRVVFTSGEHMETHGATNTLRLLEVGDDGRATGLGEL

SEQ ID NO: 45942 - protein, 336 aa, Vibrio vulnificus CMCP6
MNILVTGGSGYIGSHTCIQMIEAGMTPIILDNLYNSKLLVLDRIEQVTGVRPTFYQGDIRDSEILQHVFAQHDIQGVIHFAGLKAVGESVEKPLMYYDNNVSGTLNLVREMDKAGVKSLIFSSSATVYGDPASVPIRENFPTSATNPYGRSKLMVEECLTDFHKANPDWSITLLRYFNPVGAHESGLLGEDPQGIPNNLLPFVAQVAVGRREKLGVFGDDYPTPDGTGVRDYIHVIDLADGHLAALNKVGQQAGLHIFNLGTGQGNSVLEMVAAFEKAAQRPIPYEIKPRRAGDIAECWADPAYAEQVLGWKATRSLETMVVDTWRWQSNNPNGYE

SEQ ID NO: 45943 - protein, 241 aa, Synechococcus elongatus PCC 6301
MLLNTRKPVMDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 45944 - protein, 391 aa, Xanthomonas oryzae pv. oryzae KACC10331
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVEVAPGQVVLLENCRMNVGEGKDDQTLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHHVGKSLNEPDLIPTANQIVADAKTRGAEIPLPTDVVVAKQFLPDAEASVKALDAVDADDLILDIGPQTAQRYAELIASAGTVVWNGPVGVFEFESFSHGTETLARAIASSKAFSIAGGGDTLAAVDKYDIAKDVTYISTGGGAFLEFLEGKTLPAVAALQARGQ

SEQ ID NO: 45945 - protein, 198 aa, Glycine max
MFAEENGLKGDPRLQAISQAIRVVPHFPKHGIMFQDITTLLLDHKAFKDTVDIFVDRYRDMHISVVAGIEARGFMFGPSIALGIGAKFVPLRKPRKLPGEVISEKYALEYGTDCLELHVGAAQPGERAIIIDDLVATGGTLSAGVKLLERVGAEVVECACVIGVPDVKGQCRSIGKPLYVLVEPRKADKCQAQADKCY

SEQ ID NO: 45946 - protein, 256 aa, Vibrio vulnificus CMCP6
MRRPVVMGNWKLNGSKTMVAELLTGLNAELEGVEGVDVAVAPPALYIDLAERLIAEGGNKIILGAQNTDINNSGAFTGDMSPAMLKDFGATHIIIGHSERREYHNESDEFVAKKFAFLKENGLKPVFCIGETEAQNEAGETEAVCARQINAVIDAYGVEALNGAIIAYEPIWAIGTGKAATAEDAQRIHASIRAMIAAKDAAVAEQVIIQYGGSVKPENAEAYFAQPDIDGALVGGASLDAKSFAAIAKAAAKMKA

SEQ ID NO: 45947 - protein, 469 aa, Frankia sp. CcI3
MSLSTIDRVDPRTPQARLARFFDPDTLSLFAVGDPSGVVAGQGLVGGNEVVAFATDPTVQGGAMGRDGCARIVHAIESAVRMNCPVVGIWHSGGARLQEGVASLDGVGRIFAATVRASGRIPQLSLVLGAAAGGAAYGPALTDIVIMGPGAKVFVTGPDVVRSVTGEECTADSLGGPDVHSRRSGVVHVTCDSEDEAVERTRAVAVLLADQRDIGPVTGRELGELLPDNPRRAYDVRPLVKAVLDDEDEAVELHPRWAPNIVTVLGRLGGRTIGVVANNPLRRGGCLDATSAEKASRFVRMCDSFGVPLVVLVDVPGYLPGVGQEWEGVVRRGAKLLYAFSECTVPRVTVVTRKAYGGAYIAMNASSLGATAVYAWPTAQVAVMGAEAAVGILHRRKLAEVPAQRRPSVLAELTEEHIRTVGGIDRAVELGVVDAVVTPAATRGAVASALADALTRSRPDKNVHGNIPL

SEQ ID NO: 45948 - protein, 522 aa, Metarhizium anisopliae
MPSLGFLKKKRTRDSNPDPSTSTPTSPVAATSPSKPFDSSTLQQRTSGSQAKTAPGTAPAPSQGSAATAAPASQQQQMNPANAQGGTFVTPLPMQTNQADSQSLPSINNLIHQPQNGASTNNYSSFNPAALGAQISHPPSASPGTDPGHMQQQQQQAYPQPAMQPQQQAGHLPDQQQQQYQQQQHEQRVHHQHQGSVTRVTKGKYSLGDFDILRTLGTGSFGRVHLVQSKHNQRFYAIKVLKKAQVVKMKQVEHTNDERRMLSDVKHPFLITLWGTFQDWKNLYMVMDFVEGGELFSLLRKSGRFPNPVAKFYAAEATLALEYLHSKNIIYRDLKPENLLLDRHGHLKITDFGFAKRVPDKTWTLCGTPDYLAPEVVSNKGYNKSVDWWSLGILIYEMLCGYTPFWDSGSPMRIYENILKGKVKYPAYINTDAQNLLERLITSDLTKRLGNLYGGSQDVKNHPWFSEVTWDRLARKDIDAPYTPPVKAGTGDASQFDRYPEDPEKYGGIGGSDEYGHMFTDF

SEQ ID NO: 45949 - protein, 303 aa, Populus tremula
DVYFWEAKGQTPLYPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 45950 - protein, 341 aa, Physcomitrella patens subsp. patens
MHQDNWNNLSLGSRTLTDLGVRELRNANNRLKIFSGTANPQLSQEIACYMGLNLGQIKIKRFADGEIYVQLEESVRGCDVFLVQPTCPPANENVMELLIMIDACRRASAKTITAVIPYFGYARADRKTQGRESIAAKLAANLITEAGANRVLTCDLHSGQSMGYFDIPVDHVYGQPVILDYLASKMISSDDLVVVSPDVGGVARARAFAKKLSDAPLAIVDKRRHGHNVSEVMNLIGDVKGKVAVMVDDMIDTAGTIANSAALLHAEGAKEVYACCTHAVFSPPAIERLSGGLFQEVIITNTIPVQEGNYFPQLTVLSVANLLGETIWRVYDDCSVSSIFR

SEQ ID NO: 45951 - protein, 131 aa, Vibrio parahaemolyticus RIMD 2210633
MIKQVGNTQINPLHRLTCHCGKVELELTLPNGIEKPRRCDCSMCRRRGAIVASVPLSGIRIVQGDDVLKLYQFNTHTAKHFFCSECGIYTHHQRRSDPSEYGYNVGCLEGVNPYELGDIEVMDGVNHPSDR

SEQ ID NO: 45952 - protein, 303 aa, Populus tremula
DVYFWEAKGQTPLYPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECGHVGWGVAVLVGVPSKDDEFKTHPMNLLNERTLKGAFFGNYKPRTDLPGVVEKYMNKELEVEKFITHS

SEQ ID NO: 45953 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 45954 - protein, 304 aa, Physcomitrella patens subsp. patens
MLLCDRCDRGYHMYCLSPILPTVPLDDWFCPKCSQSSHVQGIAEFPKVQKKIVDFFRIQKPSPFTAELKCVETRKRRRPSGGSLCLQKKSRRLLPYVPCAEPQRRLEQMASLATALTSIGVEFTDSLSYGLAPRSANRAENEKGGMQVMSKEDKATLDLCKKMCSHGEWPPLMVTHDSRQGFVVEADGNIKDLTIIAEYTGEVDYMRCREHDSGNSIMGLLFSDDPAKELVICPDRCGNIARFVSGINNHSPEGRKKQNVRCVRYNIDGEARAILVAIRDIPKGERLYYDYNAYQTEYPTKHFV

SEQ ID NO: 45955 - protein, 562 aa, Xanthomonas citri
MSLNGGAGASRAGGRSDHRGGVRQHERRRSQDLQAQSGICERAQRDLPHQPQHPHPGRMTQTNGFDALHAHAQRLRGAAIPALLAAEPERPTQYARQVGPLYFNFARQKYDRAALDALFAIARERDLSGAFQRLFRGEQVNVTEQRAALHTALRGDLTDAPVASEAYATAEEVRQRMGSLIQQLEATDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHVLNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHTALMANVLAQTEALANGQDSSDPHRSYPGGRPSTVILLDALTPQALGALISMYEHSVYVQSVMWGINAFDQFGVELGKQLASQLLPALKGESVDVADPVTRELLNKLRG

SEQ ID NO: 45956 - protein, 95 aa, Glycine max
MLRAGGSRLVAPGLRRLLGPDAGERAAPGLAAAGARAYHERVVDHYNNPRNVGSFDKDDPNVGTGLVGAPACGDVMKLQIRVDEGTGKIVDACFK

SEQ ID NO: 45957 - protein, 332 aa, Brassica napus
MHNDWLQTVQTEPDAISMSFIPITSLLNGVPGSGFLSHAINLYLRYKPPITELHQFLEFQLPRQWAPVFSELPLGPQRKQQSCASLQFSFFGPKLYVNTTPVDVGKRPITGMRLYLEGRRSNRLAIHLQHLSSLPKIFHLEDDPNKSMRQASHDRRYYEKVNWKNYSHVCTAPVEADDDLSVVTGAQLHVESHGFKNVLFLRLCFSKVMGATSVKNSEWDEAVGFAPKSGLISTLISHHFTAAAQKPPPRPADVNINSAIYPGGPPVPVQAPKLLKFVDTSEMTRGPQESPGYWVVSGARLLVEKGKISLKVKYSLLTAIMEDEVIEESYGG

SEQ ID NO: 45958 - protein, 417 aa, Photorhabdus luminescens subsp. laumondii TTO1
MESKVVIPAEGKKITVDAKGKLVVPNNPVIPYIEGDGIGVDVTPAMLKVVDAAVQKAYQGERKISWMEIYTGEKSTHVYGKDVWLPDETLDLIREYRVAIKGPLTTPVGGGIRSLNVALRQQLDLYVCLRPVRYYQGTPSPVKQPELTDMVIFRENAEDIYAGIEWKAGSVEADKVIKFLQEEMGVNKIRFPQQCGIGVKPCSEEGTKRLVRAAIEYAIDNDRESVTLVHKGNIMKFTEGAFKDWGYQLAREEFGGELLDGGPWVKIKNPKNGKEIIVKDVIADAFLQQILLRPAEYDVIACMNLNGDYISDALAAQVGGIGIAPGANIGDECALFEATHGTAPKYAGQDKVNPGSVILSAEMMLRHMGWTEAADLIVKGMEGAIAAKTVTYDFERLMEGAKLLKCSEFGDAIIQHM

SEQ ID NO: 45959 - protein, 314 aa, Silicibacter sp. TM1040
MMPWLLSVLGLVILLLAGDALVRGAVNLSLRVGIPALIVSLTIVAFGTSAPELLIAIQAVHENADGIALGNVVGSNTANILLVLGLPALMRALHTSECNTRKNYIFMIAASVLFIALAFVGTFTWVSGVVLLLALFGVLFTAFREAQAHRAAGEDDELEEIDEADPDMPYWRIGIYLVLGLIGLPLGAELLVENATIIARMYGLSETVIGLTLVALGTSLPELATTLVAALRRQADVALGNVIGSNMFNLLAIIGLTTFVGPITVDPAFLRFDLWVMLASSLLIIPFVFFRQDITRIWGIILTGLYVVYVWSLL

SEQ ID NO: 45960 - protein, 574 aa, Staphylococcus carnosus
MAKQIKGIAASDGVAIAKAYLLVEPDLSFDNESVTDTDAEVAKFNGALNKSKVELTKIRNNAEKQLGADKAAIFDAHLLVLEDPELIQPIEDKIKNESVNAAQALTDVSNQFITIFESMDNEYIAERAKADIRDVSKRVLAHILGVELPNPSIVDESVVIIGNDLTPSDTAQLNKEYVQGFVTNIGGRTSHSAIMSRSLEIPAVVGTKSITEEVEAGDTIVVDGMTGDVLINPSDEVIAEYQEKRENFFKDKQELQKLRDAESVTADGHHVELAANIGTPNDLPGVIENGAEGIGLYRTEFLYMGRDQMPTEEEQFEAYKAVLEAMKGKRVVVRTLDIGGDKELPYLDLPEEMNPFLGYRAIRLCLDQPEIFRPQLRALLRASVFGKLNIMFPMVATIQEFRDAKAFLKKNVLTLKMKAMKVADDIELGIMVEIPSTAALADIFAKEVDFFSIGTNDLIQYTMAADRMSERVSYLYQPYISNFSFLVKQVIEASHAEGKWTGMCGEMAGDQTAIPLLLGLGLDEFSMSATSILKARVLIRSLNESEMKELSERAVQCATSEEVVDLVEEYTKNA

SEQ ID NO: 45961 - protein, 181 aa, Oryza sativa Japonica Group
MLTAAMHMLDSSTSSSPWLPPDLMPPPPSAATLHRHFRGAAAAASTSRRIAKRRPRPSRRLPTTYISADPANFRRMVHQVTGADDLPPPPPPSLSPTTTELLRHAAPAGSPGPAGALMLPTLDTSAFLLGRRAEPTAAAAPCDVSVALVGGAGNSYSNNSSSSSSGNCGGGFPTLDSWDLL

SEQ ID NO: 45962 - protein, 413 aa, Oryza sativa Japonica Group
LSKESSILPASYVNRVETRTYPSYTTLVRKLCTCIFPAMLCKIIESGPRVTIIAATSSVGTFIVLSLIVATALYISLKSRYNEEIHLKVEMFLKTYGTSKPTRYTFSEVKKIARRFKDKLGHGAFGTVYKGELPNGVPVAVKMLENSVGEGQEFINEVATIGRIHHANIVRLLGFCSEGTRRALIYELMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTDPTVESQNEFYFPEWIYERVINGQDLVLTMETTQGEKEMVRQLAIVALALWCIQWNPKDRPSMTKVVNMLTGRLQNLQVPPKPFISSQNQLVI

SEQ ID NO: 45963 - protein, 141 aa, Physcomitrella patens subsp. patens
MGDAGEYSSGPDRHELEASLMRRRPDKGPLDEDQIWRTIAGISGIMAVGLGAFGTHMFKPVNPANKVVWETANLYHLVHSVALLAVPLTKRPRVFGSLLTFGLVAFSGSCYFAAYYENRSLSLPAPFGGFGFMGAWASLLF

SEQ ID NO: 45964 - protein, 447 aa, Arabidopsis thaliana
MATHAALAVSRIPVTQRLQSKSAIHSFPAQCSSKRLEVAEFSGLRMSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 45965 - protein, 893 aa, Prosthecobacter debontii
HSEPRFEGPDGSLLGFRDQERAFRLGLLLAASSRCMCDVVLGVQKREGEDHEPFETVIEAYKHEVYHKDIIDSDLTANDQQELVKRFKALVKERTGKVFPNDPWDQLRGAAGAVFGSWMNDRAIVYRRKYGIPAEWGTAVNVQAMVYGNTGDDSGSGVAFTRNPANGVNEFYGEFLINAQGEDVVAGVRTPEPVLKLKDAMPKPYAELLKVRSILEKHFKDVQDVEFTIQQGKLFMLQTRNGKRTAAAALKFSIDMVKEKLIDWETAVLRNPADQLDQLLAPIFDLADVKKAKAIATGLPAGPGAASGKVYLNADRAVIAEQKGEKVLLVRNETSPEDLRGMIAAEGILTAKGGVSSHAALVARQMGKVCICGASALEIDYDKKTVTVAGQVFKEGDYLSIDGTSGTVYAGQLKTADSEIITGTIGGDKAAQETEKFKFKSFNQLMKWCSQATRLQVRTNADNPEQTQNAIAFGAQGIGLTRTEHMFFEGDRIDAVREMILAETEAARRAALAKILPYQREDFIGIFEALKGLPATIRLLDPPLHEFVPHDDKSQADLAKKLGITTEKVTARVNALHEFNPMLGHRGCRLGIAYPEITETQARAIFEAAAEVQKKGIKVKPEVMIPLVGFKKELDLQVAIVHQVAAQVQAEKKVKLSYSVGTMIEVPRGALTADEVAQTAEFFSFGTNDLTQTALGISRDDMGNFLLPYTENEIFKKNPFASLDQTGVGQLVKIAIEKGRSTRPDIKLGICGEHGGDPDSVKFFHSVGLSYVSCSPFRVPVARLAAAQAAIEEKRAAAKAGAAEKNVRGSSKSAPAAKQTKQPTTTTRNNNMAKKAAKKAPAKKAAPAKKAAPAKKAAPAKKAPAKKAAPAKKAAPAKKAPAKKAAKKVAKKK

SEQ ID NO: 45966 - protein, 111 aa, Physcomitrella patens subsp. patens
MASLLWHKVAGVSGMTALAAGTYGAHGFKPADPVYKTVYQTGNIYHLVHSSALLAAPLSKRPNLFGGLCSFGIVTFSGTCYLVALKEDRSLSKPAPVGGFAFIAAWASLLF

SEQ ID NO: 45967 - protein, 160 aa, Nostoc punctiforme PCC 73102
MTKIRIGNGYDIHQLVSDRVLILGGIQIPHELGLLGHSDADVLTHAIMDAMLGALSLGDIGHYFPPSDPKWAGADSLVLLNQVHQLIRDRGWQVGNIDSVVVAERPKLKPHIHNMRDKLAAILELESNQIGIKATTNEKLGPVGREEGICAYAVVLLLKE

SEQ ID NO: 45968 - protein, 262 aa, Escherichia coli
AISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGRGFHEEPQVLHYDSRETNVVLKPGMTFTIEPMVNAGKKEIRTMKDGWTVKTKDRSLSAQYEHTIVVTDNGCEILTLRKDDTIPAIISHD

SEQ ID NO: 45969 - protein, 261 aa, Escherichia coli
AISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGRGFHEEPQVLHYDSRETNVVLKPGMTFTIEPMVNAGKKEIRTMKDGWTVKTKDRSLSAQYEHTIVVTDNGCEILTLRKDDTIPAIISH

SEQ ID NO: 45970 - protein, 318 aa, Prosthecobacter debontii
MPVFSFASLPWRSYKLPPHVLGGAVVFQNSVLNPHSCTAMGNIYNNIVETVGKTPLVKLNKVTEGLDATIALKCEFFNPLGSVKDRIGMAMIEDAEARGILNKDTVIVEPTSGNTGIALAFVAAAKGYKLVLTMPETMSLERRTLLALLGADLVLTPGPQGMKGAIAKAEEILKETPNAWMPQQFENPANPAIHMKTTAEEIWADTDGQVDIFVAAVGTGGTLTGTCEVIKPRKPSFQAIAVEPEASPVINQTLAGEPVQPGPHKIQGTGAGFVPKNLHLKDKRPYPADHRVHQDQQCRRFRHGSPPSLKKKGFLVGI

SEQ ID NO: 45971 - protein, 329 aa, Kluyveromyces marxianus
MVSIAINGFGRIGRLVLRIALERKNIDVVAINDPFISVDYAAYMFKYDSTHGKYKGEVSHDGSNLIINGKKVAVFQEKDPATLPWGKLGVDIAVDSTGVFKELDSAQKHIDAGAKKVVITAPSKTAPMFVVGVNEDKYNGEKIVSNASCTTNCLAPIAKIINDEFGIEEGLMTTVHSITATQKTVDGPSHKDWRGGRTASGNIIPSSTGAAKAVGKVLPELQGKLTGMAFRVPTTDVSVVDLTVKLVKAATYDEIKAAVKKVSEGKLKDVVGYTEDAVVSSDFLGDTHSTIFDAAAGIQLSPKFVKLVAWYDNEYGYSTRVVDLVEHVA

SEQ ID NO: 45972 - protein, 331 aa, Kluyveromyces marxianus
MVRIAINGFGRIGRLVLRIALSRKNIEVVAINDPFITVDYAAYMFKYDSTHGRFDGEVSHDGKALIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 45973 - protein, 491 aa, Acidovorax sp. JS42
MSFDLVLFGGTGDLAWRKLLPALFQAFRHGSLPPQGRIIGVARDALSDGDYRALIARRFADVEGEKRPSDEEFERFAALLQYQRMDLSQPEDYALLAQRLRERHADTVVMYLATAPALFTTVCEQLGAAGLATPATRVVLEKPLGHDLASNRAINAAVRSVFDERQIFRIDHYLGKPSVQNLLALRFGNALFEPLWRRETVASIEITMAEQLGVEQRGAFYDQTGALRDMVQNHALQLLCAIAMEPPINAHADAIRDEKLKVLRSLSTWTPATLLRDVVRGQYSTGTTACEGVRAYADEDGVAPGSTTETFVALRTEIANWRWAGVPFYIRTGKRLAAREAHIAINFRPTPHAIYRTPLGAANRLVIHLQPRDGVALHLFAAGQEKRGTRISEAQALAPVQLDLDFDQRFGSQRVGAYERLLLDVIAGRLNLFVRADEQEAAWHWVEPIMQAWAEQDARGEGPRPYAAGSWGPSAASALVAREGHTWMEEC

SEQ ID NO: 45974 - protein, 139 aa, Oryza sativa
  misc_feature (35)..(35): Xaa can be any naturally occurring amino acid
  misc_feature (66)..(66): Xaa can be any naturally occurring amino acid
  misc_feature (74)..(74): Xaa can be any naturally occurring amino acid
  misc_feature (94)..(94): Xaa can be any naturally occurring amino acid
MAERELIDRDKLVLIDLQFHGFHGVKSEEKTLGHXFVVDVPWLQCLSVAGETDSISDTVSYTDIYXIAKDVVEXPSRNLLEAVAHRIASNALLXKFPQISTIRVKVGKPHVAVRGIVDYLGVEILRHRKDVGGDRQELH

SEQ ID NO: 45975 - protein, 438 aa, Vibrio angustum S14
MSSTSNKMGLMGLTTIVTVNMMGSGIILLPSSLAATGGIALLAWAVTALGALAIAYAFAKCGMYCTDDGGMSAYAEKAHGKSSFFIASYTYYVCLVISAVAIAVSCVGYLEYFIPWLKETPFQTFIGVVAILIITMFANVRGAKITGQISTVTVWGIIIPVLGLSIIGWFWFDTKIFAEAWNPNNISVGSAIYAGMALTLWAFLGIESAGANSGTVENPKRNVPLACMLATVFSAATYIASTTVIQGIIPNDILAKSDSPFGLVFAQMFSPFVGEIITAMAIMACVGSLLGWQFTNAQVSKVAADMRLFPKIFSDVNKHDAPFKGMMIMLALELLLAVMTISPTLLKQFNVLVNLAVFINMVPYILALTALGIIMRQSQVNQKEYNTGILIGSVAVIYSIYGAYSTGEEAVFYGTVITLFGYFFYGFIASRDAVPNKI

SEQ ID NO: 45976 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKDLEVEKFITHS

SEQ ID NO: 45977 - protein, 425 aa, Vibrio vulnificus CMCP6
MSDDNSQQMTPEEVLRQQALDYHALPTAGKIAVALTKPAETAKDLALAYSPGVAEPVREIAQNPDNVYKYTSKGNMVAVISNGTAILGLGNLGPLASKPVMEGKALLFKRFAGLDSIDIEVKHRTIDEFVDTVANIADTFGGINLEDIKAPDCFEIEKRLIERCDVPVFHDDQHGTAIVTAAGMLNAIELQGKKLNECIIVCLGAGAAAVACMELLIKCGAMREKIYMLDRKGVIHTRRDDLNEYKQLFANNTDKRTLEDVISGADLFLGVSGPNLMPAEALKLMADKPVVFACSNPDPEIKPELAHEVRSDLIMGTGRSDYPNQVNNVLCFPFIFRGALDVRASEINDEMKLAAVEAIRQLAKEPVPEAVLKAAGVESLSFGPQYIIPKPMDSRLLPRVAKAVAQAAVDTGVARIPMPENYMAE

SEQ ID NO: 45978 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNEGTLKGTFFGNYKPRTDLPGVVEKYMNKELEVEKFITHS

SEQ ID NO: 45979 - protein, 429 aa, Pseudomonas syringae pv. tomato str. DC3000
MRDELNKGLIDFLKASPTPFHATATLVQHFEAAGFQRLDERDTWAIETGGRYYVTRNDSSIVAIRMGRQSPLTGGIRMVGAHTDSPCLRVKPQPELQRQGFWQLGVEVYGGALLAPWFDRDLSLAGRVTFRRDGKVESQLIDFKLPIAVIPNLAIHLNRTANEGWTINPQNELPPILAQVAGDERADFRALLTDQLAREHGLNADVVLDYELSFYDTQSAAVVGLNGDFLAGARLDNLLSCFAGMQALLNTESDETALLVCTDHEEVGSSSACGADGAMLEQIVQRLLPSSEDYVRTIQKSLLISADNAHGIHPNYADKHDANHGPKLNAGPVIKVNSNQRYATNSETAGFFRHLCMAEEVPVQSFVVRSDMGCGSTIGPITASHLGIRTVDIGLPTFAMHSIRELAGSHDLAHLVKVLGAFYASHELP

SEQ ID NO: 45980 - protein, 407 aa, Arabidopsis thaliana
MAGVIHVSSTQIPVAFMSATKQSFRRASVIRCAANTPKKRYTIAVLPGDGVGNEVIPVAVDVLCLAGSLEGIDFSFEELPIGGVALDLVGVPLPKETLIRAKQSDALLLGAVGWPKWDNNPKHLKPITALLQLRAALQVFANLRPITVLPQLVDSTYLRKDTAQGVDLLIIRELTGGIYNAHPRGFTTNEQGDEVGFCTESYSASEVDHIARVAFDIAKQRRGKLCSVDKATILEGSMLWRKRVTAIASEYPEVEVSHLLIDTAAMDLVRHPRQFDTILTGVMFGDILSDLAAMIPGSVGLLPSAALGDSGPGIFEPVHGSAPKHYGKDTVNPIAAVLSAAMLLRYGLKEENAAKRIEEAVSDVLDRGFRTRDIHTPGTTLVGCKRMGEEILRSLDAKVSASTGNLV

SEQ ID NO: 45981 - protein, 676 aa, Rhodopirellula baltica SH 1
MRVAATEQTQLPAVFLPVSTTSRESVSDDQSADNGSYVVVARRYRPRDFTQLVGQDHVARALQGAIETSRVGHAYLFTGARGVGKTSTARIFAKALNHPDGPTANPDSESDVAQAIDSGEDVDVIEIDGASNRGIDEIRSLRANVGVRPSRSRYKIYIIDEVHMLTGAAFNALLKTLEEPPEHVKFIFCTTDPEKIPITVLSRCQRFDFAPVESDKIVQRLREIVEAEDNTVEDEALELLARRAAGSMRDSQSLLEQVLSFSDGHLTADHVHTMLGTADDQRLHRLAEAMADRDASAALSQIDEAIAAGVDAGRLAEQMLGYFRDLMAVAVGCEASLMRYAAASMHGSLGELAGRWGLQTVLAIVGLVDETLVRIRHSVHARVLLEATVIQVCHLPDLQAISDLTAAASGAGGGKSAGEKKKRVAVASSSPSSAAMPTSAVPSSSTSPAAGSDAKVRVDSPAAPSGDHRAATSATASVAAGVPSGTPPVNSGSTAATSSQPAPQSQAVPSGGVATAVATPPQSEGAENSAAANESTTSTDGYPLISGDEATSSWSQVLQEMDPMTATLAKAAERVDSPEPGVLRMIFPGNSGLAFSRCQMPEHKEEILRTLSRVTGRRATLQFEATAVKKIEPVAAAKPKNKNRMQRMREIQANPLVQSCVELLGAEIVRVDTPRG

SEQ ID NO: 45982 - protein, 419 aa, Brassica napus
MAAEKWVYMVTAQTPTNIAVIKYWGKRDEVRILPVNDSISVTLDPDHLCTVTTVAVSPSFDRDRMWLNGKEISLSGSRYQNCLREIRGRAGDVEDKEKGVKIDKKDWEKLHLHIASHNNFPTAAGLASSAAGFACLVFSLAKLMNVDEDASHLSAIARQGSGSACRSLFGGFVKWEMGSKDDGSDSVAVQLADEKHWNDLVIIIAVVSSRQKETSSTSGMRESVETSLLLQHRAKEVVPKRTLQMEEAIKNRDFASFTQLSCADSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGENSVENLQPPPEIRDNIGSQDQKGEVSYFICTRPGRGPVVLPDQTQALLDPETGLPK

SEQ ID NO: 45983 - protein, 201 aa, Glycine max
NSTFFRFDSRSSSLFSSSMATLIPPPPPPPPPPAAAADPKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSL

SEQ ID NO: 45984 - protein, 538 aa, Acidovorax sp. JS42
MNFDDPRTRCDHTTAWQRLRAHYESAGRSFDLRAAFAQDAQRFERFSQDAPHVFADLSKNLIDAPTEALLLQLARECGVVAYRDAMFEGRPINNTEQRAVMHWLLRKPAPGHAGQAQAAIDTVAPEIASALHDVHATLEDMLALAERVRADDGITDIVNIGIGGSDLGPAMVVKALDDLRHPGKRLHFISNVDGMELGSLLRQLRPESTLFLIASKTFTTAETMSNAQAARAWFLDQGGSEDARARLPLARHFYALTTNLEAAAQFGITTTLGFWDWVGGRYSLWSAIGLPIAIAVGAPHFRALLAGAHAMDEHFRTAPLESNLPVRLALLDLWYRNFHGFSSRSMAPYSHGLRRLPAYLQQLEMESNGKGVDAHGQPLPYATSPVVWGEPGTNGQHAFFQMIHQGPDTVPVEFIALREPGRDLPDQHPRLVANALAQARALMMGRPEEADGHRRFSGNRPSTFLLLERLDPASLGALIALYEHRVFTSGALWGINSFDQWGVELGKGIAKDLEPRLATGDVQGLDPSSAGLLRRLAT

SEQ ID NO: 45985 - protein, 359 aa, Brassica napus
MEKYELVKDIGAGNFGVARLMKVKDSKELVAMKYIERGPKIDENVAREIINHRSLRHPNIIRFKEVVLTPTHLAIAMEYAAGGELFERICGAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKHLLSRIFVANSLKRITIAEIKKHPWFTKNLPRELTETAQAAYFKKENPTFSAQTAEEIMKIVDDAKTPPPVSRSIGGFGWGGEGDLEGKEEEEVDEEEVEEEEDEEDEYDKTVKEVHASGEVRIS

SEQ ID NO: 45986 - protein, 348 aa, Neisseria gonorrhoeae FA 1090
MKMQAVVVNKNVAGDVEVVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGTHVVAIDINDDKLAFAKETGADLVVNAAKEDAAKVIQEKTGGAHAAVVTAVSAAAFNSAVNCVRAGGRVVAVGLPPESMDLSIPRLVLDGIEVVGSLVGTRKDLEEAFQFGAEGLVVPKVQLRALDEAPAIFQEMREGKITGRMVIDMKKECGCDHHH

SEQ ID NO: 45987 - protein, 181 aa, Glycine max
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 45988 - protein, 233 aa, Papaver somniferum
MAGSGSEEVKILGGWPSPFVMRPRIALNIKSVKYYLLEETFGSKSELLLKSNPIYKKMPVLIHGDKPICESMIIVQYIDDVWASAGHSIIPSDPYDASIARFWATYIDDKFFPSLMGIAKSKDAEEKKAAIEQAIAAFGILEEAYQKTSKGKDFFGGEKIGYVDIAFGCYVGWIRVTEKMNGIKLFDEEKVPGLTKWAEKFCADETVKSVMPETDALMEFAKKIFGSKPPPSN

SEQ ID NO: 45989 - protein, 358 aa, Arabidopsis thaliana
MEAKGAAQWSSILVPSVQEMVKEKTITTVPPRYVRSDQDKTEVDDDFDVKIEIPIIDMKRLCSSTTMDSEVEKLDFACKEWGFFQLVNHGIDSSFLDKVKSEIQDFFNLPMEEKKKFWQRPDEIEGFGQAFVVSEDQKLDWADLFFHTVQPVELRKPHLFPKLPLPFRDTLEMYSSEVQSVAKILIAKMARALEIKPEELEKLFDDVDSVQSMRMNYYPPCPQPDQVIGLTPHSDSVGLTVLMQVNDVEGLQIKKDGKWVPVKPLPNAFIVNIGDVLEIITNGTYRSIEHRGVVNSEKERLSIATFHNVGMYKEVGPAKSLVERQKVARFKRLTMKEYNDGLFSRTLDGKAYLDALRI

SEQ ID NO: 45990 - protein, 263 aa, Vibrio vulnificus CMCP6
MTQPSLNPLVIKLGGAALSCSQTLSQLFGAIASYQQKEQRQIVIVHGGGYLVDELMEKLQLPTVKKNGLRVTPYDQIPLIAGALAGTANKLLQGQAMADGLNAIGLSLADGGLCQVEELDPELGAVGKATPGDSSLLQTILNAGALPIISSIGLTAQGQLMNVNADQAAVAVAGALDAQLVLLSDVSGVLDGKGHLIKSLNQQEADALIAGKVITDGMIVKVQAALEAANDLGRAIEVATWRYPENLEKLFAGESIGTQFLPA

SEQ ID NO: 45991 - protein, 494 aa, Zea mays
  misc_feature (130)..(130): Xaa can be any naturally occurring amino acid
  misc_feature (157)..(157): Xaa can be any naturally occurring amino acid
MARKMLIDGEVAAVADGGHYDYDLFVIGAGSGGVRGSRTAASFGAKVAICELPFHPISSEWLGGHGGTCVIRGCVPKKILVYGASFRGEFEDSKNFGWEINGDINFNWKTLLGNKTKEIVRLNGVYQRIXSAGVTMIEGAGSLVDAHTVEVSQPDGXKQRYTAKHILIATGSRAQRVNIPGKDLAITSDEALSLEELPKRAVILGGGYIAVEFASIWRGMGAEVDLFYRRDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGQQVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNL

SEQ ID NO: 45992 - protein, 295 aa, Geobacter sulfurreducens PCA
MQGEKVAQKSCNREQVEELHRLKEQIELQEALFNIKHKIVVLSGKGGVGKSSVAVNLAVALSLSGKKTGLLDVDLHGPSIPTLLGIEGRLPATAARIEPVPYSDTLKVMSVGLLLRDQAEAVVWRGPAKHGVIKQFLAAVEWGNLDYLIVDCPPGTGDEPLSVIQLLEGAEGAVIVTTPQDVALTDVRKSVTFCRQMKLPVIGVVENMSGFVCPHCGEGVDIFKSGGGKLMADEMSVPFLGRIPLDPAMVRAGDEGEPLVEHRADSPTAKAFAEIVATVAARCDTAVNAAREGGQ

SEQ ID NO: 45993 - protein, 254 aa, Bacillus cereus G9241
MKEKVVIITGGSSGMGKGMATRFAKEGARVVITGRTKEKLEETKLEIEQFPGQILPVQMDVRNTDDIQKMIEQIDEKFGRIDILINNAAGNFICPAEDLSVNGWNSVINIVLNGTFYCSQAVGKYWIEKGIKGNIINMVATYAWDAGPGVIHSAAAKAGVLAMTKTLAVEWGRKYGIRINAIAPGPIERTGGADKLWISEEMAKRTIQSVPLGRLGTPEEIAGLAYYLCSDEAAYINGTCMTMDGGQHLHQYPF

SEQ ID NO: 45994 - protein, 233 aa, Papaver somniferum
MAGSGSEEVKILGGWPSPFVMRPRIALNIKSVKYYLLEETFGSKSELLLKSNPIYKKIPVMIHGDKPICESMIIVQYIDDVWASAGHSIIPSDPYDASIARFWATYIDDKFFPSLMGIAKSKDAEEKKAAIEQAIAAFGILEEAYQKTSKGKDFFGEEKIGYIDIAFGCYIGWIRVTEKMNGIKLFDETKVPGLTKWAEKFCADETVKSVMPETDALMEFAKKIFGSKPPPSN

SEQ ID NO: 45995 - protein, 104 aa, Triticum aestivum
  misc_feature (38)..(38): Xaa can be any naturally occurring amino acid
PSRKRQREKMMKDPLKSHKPEAPVSGPGFGGKIGTTKXGSLLTQYLMKEGGLIKETWMDEDPREAILKYADAAKNDPKFIAPAYAQTQPETVFAESDSDGEEKK

SEQ ID NO: 45996 - protein, 1003 aa, Physcomitrella patens subsp. patens
QVPARAAAAAVVARKIATLPPHERVLLSGVPDSISTARPRAETVQELEEVFYENKFDPVRHLLEQIPAENVNQSYFDTQVGQRLLQLDVITESLSKQVIEHHEEMVKGMKLVMELERDLQIAAIIVKNGRRHLSKAMAEVSKDLVVAANVNKKQTLLDIVPILERVHHALNIKSCLDSVVDEGDFSKALHMCSECLLLLEECPELAAVQEMNQSIEEWLQRTITKVDALLMEVCRTFQAEKYKVVINAYTLLDDVTSLADKVQSFFAQNVVTETYDVLKNLLFEVCNLFLIAVLLPYRDLCMRLPEAKFRIFLCKTLEVLFDLMCSYHTMMTWHQKPELFAIPMSPTSVHASRLLSRSGSRRRFIPDHAEAYENNTTASADLDSQILEENGTSDDLAKREELVIVTVARALERGRKTVWELAARRVAALLSNDAVCRTSPHQFLQSLDWVNKFILAGEAFCGAEAVSLRTKLTKQSEQYFGAYHCQNLEILRMIVEKELWQPLSSLALKTVNLAGLTGYGASLVRASVSGESPGAHQGSNSLNSGIEKIGFAVWLQKGNPFAEKALHDSAITKVVDGDAVKVNGNGKVGLVANGSVTVEDDEDEENKDLLADFIDEDSQLPGCLYNNFRKNITAVHSKRDQSSNADKTFECSFFRYMDKYARLMQIMQPIAADVFKGLGQLFELYFFSIFKTFGQREAFGGSRGQESYLLTPRLRATLLRISQGLEEQRLKRSTSAGSQSQTPHTSAVPALTNAAGIESDASPNHVFGAAEIMMERIVATESLISLSQMLKKSRPLLQAMLAQDSSASVEFFYTRTVDAVPDLRDHVFKAVARMLLNISGQRIANVKWELKDLGMEHNGYVDCLLGAYKQYSTKLGYGGVEEEMHELLLEYGVDTLAETIVEGFSRVRRCNNEGRALMSLDLQVLINGLQHLAPPRLRSNLQIVETYIKAFYLPETEYLHWVKTHPEYTKSQAIGLINLVGAANNWKRKTRVDLVDRIEAGDL

SEQ ID NO: 45997 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVAELINPKDHDKPVQQVIIEMTDGGVDRSIECTGNVQAMISAFECVHDGWDVAVLVGVPSKDDEFKTHPMNLLNERTLKGTFFGNYKPRTDLPGVVEKYMNKDLEVEKFITHS

SEQ ID NO: 45998 - protein, 382 aa, Vibrio parahaemolyticus RIMD 2210633
MTLEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKQAPLEEVCLLGCGVTTGMGAVLNTAKVEKGDTVAIFGLGGIGLSAIIGARMAGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLEDVNKAFDLMHEGKSIRTVIHMDK

SEQ ID NO: 45999 - protein, 205 aa, Coccidioides immitis RS
MANPRVEELPDEEVPKTTVEDAGESSESEAEAAEEPTIPGGAAITVHSRNEKKARKAIGKLGLKHVPGITRVTLRRPKNILFVINQPDVYRSPSSNTWIIFGEAKIEDLNSQAQASAAQQLSAAEAAGNGEHAGHEHIDLGKGKAPETEKKEEEEEEEGEVDETGLEAKDIELVMAQANVSRSKAIKALKENDNDIVNSIMALSV

SEQ ID NO: 46000 - protein, 442 aa, Chlamydia trachomatis D/UW-3/CX
MEEITTEFNTLMTELPDVQLTAVVGRIIEVVGMLIKAVVPDVRVGEVCLVKRHGMEPLVTEVVGFTQNFVFLSPLGELTGVSPSSEVMATGLPLHIRAGEGLLGRVLNGLGNPIDTETKGPLENVDAIYPIFKAPPDPLHRAKLRTILSTGVRCIDGMLTVAKGQRIGIFAGAGVGKSSLLGMIARNAEEADINVIALIGERGREVREFIENDLGEEGMKRSVIVVSTSDQSSQLRLNAAYVGTAIAEYFRDQGKTVVLMMDSVTRFARALREVGLAAGEPPARAGYTPSVFSTLPKLLERAGASDKGTITAFYTVLVAGDDMNEPVADEVKSILDGHIVLSNALAQAYHYPAIDVLASISRLLTAIVPEEQRRIIGRAREVLAKYKANEMLIRIGEYRRGSDREVDFAIDHIDKLNRFLKQDIHEKTNYEEAAQQLRAIFR

SEQ ID NO: 46001 - protein, 511 aa, Oryza sativa
MAATAAYLPLRAQAQVGLAPLRPSGSAAAGARLPGRTARRRLAARGGPEAAGIRAEAVPGGGGVARRAAMVPPYNVLITGSTKGIGYALAKEFLKAGDNVVICSRSAERVESAVTDLKKEFGEQHVWGIVCDVREGKDVKALVDFARDKMKYIDIWNHKKAGFSPYLCVPLAQINNAGSNAYSYKPLVETSDEALMFAAYGATKRSVVHLTKSLQAELQMNEVNNVMVHNLSPGMVTTDLLMSGATTKQAKFFINILAEPANVVADYLVPNIRAIPTNQSMKPTYIRFLTGLKAYSRIFSRIAFGARRNKIMSNSQPAQEDDCMSSILVSRLIRAMQPTRSYLRWSDDLHKMFVEAVAYHGGPYEAKPTAVKETMQAMGVTSLTTHNIKSHLQKYRESFSSGVGSLHDHDLLRTTSPSKEALDLASEMVRDNDAAMAEIEMLNDLLLDHDIEMVETSFSVDDLQMMERELMSEIKLIEHNFEISESALDEYMDDLANYAFDLTGPANSSSP

SEQ ID NO: 46002 - protein, 509 aa, Nicotiana tabacum
MEGTNLTTYAAVFLDTLFLLFLSKLLRQRKLNLPPGPKPWPIIGNLNLIGNLPHRSIHELSLKYGPVMQLQFGSFPVVVGSSVEMAKIFLKSMDINFVGRPKTAAGKYTTYNYSDITWSPYGPYWRQARRMCLTELFSTKRLDSYEYIRAEELHSLLHNLNKISGKPIVLKDYSTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMVDVLLQLADDPKLEVKLERHGVKAFTQDMLAGGTESSAVTVEWAISELLKKPEIFKKATEELDRVIGQNRWVQEKDIPNLPYIEAIVKETMRLHPVAPMLVPRECREDIKVAGYDVQKGTRVLVSVWTIGRDPTLWDEPEVFKPERFHERSIDVKGHDYELLPFGAGRRMCPGYSLGLKVIQASLANLLHGFNWSLPDNMTPEDLNMDEIFGLSTPKKFPLATVIEPRLSPKLYSV

SEQ ID NO: 46003 - protein, 510 aa, Camellia sinensis
MALDTVFLLRELSFATLVILITHIFMRSILSKPLRMLPPGPTGLPLIGAIPHLGSMPHVALAKMAKIYGPIVYLKMGTCGMVVASTPDSARAFLKTLDLNFSNRPPNAGATHLAYGAQDMVFADYGPRWKLLRKLSNLHMLGGKALENWAQVRSSELGHMLKAMYDLSCRGEPVVVAEMLCYAMANMIGQVILSRRVFETKGSESNEFKDMVVELMTTAGYFNIGDFIPSIAWMDLQGIERGMKRLHKKFDVLITKMIEEHKASAYQRKETPDFLDVFMAQQKNPGEEKAQHDTIMHYSGPYSLPGTDTSSSIIEWALAEMLKDPKILNRAHDEMDRVIGRNRRLQESDLPKLPYLQAICKETFRMHPSTPLNLPRVAAQTCRVNGYYIPKNTRLSVNIWAIGRDPDVWERPLEFIPDRFLSGKNAKTDPRGNDFELIPFGAGRRICAGTRMGIVLVEYILGSLVHSFDWKLADDGVELNMDESFGLALQKAAPLSAMVSPRLPPNAYAA

SEQ ID NO: 46004 - protein, 793 aa, Escherichia coli W3110
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQAGLVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVAHAVRSWSVIRCIHRVRLSPEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 46005 - protein, 311 aa, Prochlorococcus marinus str. MIT 9211
MIWSVDSIPNQEGRIVLVTGANSGLGFDTARFLLNKGAGVILGCRTMQKAELARQKLLEQTPSANIELLEIDLGDLNQVDRAADQIAIKYKKLDLLINNAGVMAPPFTLSKQGLELQFAVNHLSHMALTLKLLPLMSKQDGARVVTVSSGAQYMGKINWNDLQGNNHYDRWASYSQSKLANVMFALELHKRLKKSNCNVASLSSHPGLARTNLQIASVAANGSWQEGFAYKLMGPMFQSSAMGSLPQLLAATDPNAKSGEQYGPRFNFRGYPKLCRVAPLALNMELREKLWELSLKLIRNFIQINSFKEIL

SEQ ID NO: 46006 - protein, 440 aa, Vitis vinifera
MVSGENGEEERRRRIRGLLGLGFCVQGFRCFPWTAINFFLKDGLNAAPSTLQLLQSSANLPMVGKPLYGVVSDAIYIGGQHRIPYIAIGAVLQAVSWLAIAILPSSNISIFTITLYLLLSNLGASIVEVANDAIVAEIGRQPTSSSKKKQASSSGELQSFVWMASSMGGVLGNLLGGVTIDRFSSQAMFLTFGILLAIQFLITITFSESSLHLPKSPSNVGIRKQLSELTFALKKPEIAYSISWFAASYAIIPALTGTMFFYQTQYLKIDSSVLGISKVFGQAAMLLWSIIYNQYLKSVPPRKLISAIQVTMAMFMLSDILFMKGIYRNMGMPDSVYVVIFSGLLEVLYFFKILPFSVLIAQLCPRGCEGSLMAFLMSAIALAFIVSGYLGVALASYVGVTADDFSGMPQGLLIQAACTLVPLFWSSCIPEEKARTEKKD

SEQ ID NO: 46007 - protein, 262 aa, Acidovorax sp. JS42
MSAKPRDSTMPPVSPYPLENPYMPTTSHAPVAGSLPPAPDAKVAMGWMHTARFLTTAAQLHHLPAIEVPEIAFVGRSNAGKSTCINTLTQQGQLAFASKKPGRTQHINLFALGKQGATDAVLADLPGYGYAAVSRSDKLRWQQVMLSYLVSRESLTAIVLLCDPRLGLTELDEALLNAVRPRVEAGLKFLVLLTKADKLTRAEQAKALSITRLQAGGGEVRMFSALKKQGVDEVAQLLWQWAHPVQKEDAAVEALPPSEDQN

SEQ ID NO: 46008 - protein, 608 aa, Lactobacillus johnsonii NCC 533
MDLSIFIVSLAALVIPIVMARFRINAIPTAVAEIVTGIILGKSLLDTIKITSSVSLLSNLGVILLMFLSGMEINFDLFKKKDLPESKQSKINPARIAVIAFTAITITAFALAYILKLIGLFNDVMLAMIIFMTVALGVVIATLKEKEILSRPIGQTILLTAVLGEVIPLLLLTIYASINGGNAGRLWLIVLLFLAAIILLRRFKQPYRWFNKISKATTQLDIRLAFFLIFTLVTVAERVGAENILGAFLAGMVMKLLEPSEATMDKLTSIGYGFFIPIFFITTGVKLDLKSLLANPNALMLIPVLVLFLLLAKLPIFLVYTRNFNKRNSLAGTFLIMTTITIVLPTLEVARKLNAITETQSDAFILAAVVVCILGPILFNSLFRLTKEDKIKQRVVMMGTNVMTVPVAQELHDNWYDVLLVTHKKENYDTYKSKVANLKLINSLEESCLEKAGVFDCDILVAGFIEDDLNRKIARLAKEHGVQRVIASQERPKPETIKKLVSEKIEIYNIFNVQTSVLRALIESPSILRILTDTKNGLFEVTVRNHKYAGQKLMNLDFIEQMTVSRIWRNGKWLVPHGNTIIEVGDHLIFTAKGEDAERIREELGRRN

SEQ ID NO: 46009 - protein, 363 aa, Synechococcus elongatus PCC 6301
MLRAGIVGLPNVGKSTLFNALVANAKAQAANFPFCTIEPNVGVVAVPDTRLAALTEISSSEQTVPTRIEFVDIAGLVKGASQGEGLGNQFLSHIRQVDAIVQVVRCFDDDDIIHVAGSVDPARDIEIINLELALADLGQIERRIERLRKQARTNKEAAAELAVLERLQPHLDAGKSARQFELTEEEEALIAPLDLLTRKPLIYGANVSEGELATGNAYVEQVRSLAAAENAQVVIISAQVEAELVELPEEERADYLGSLGVEEGGLQSLIRATYALLGLRTYFTTGPKETRAWTIRAGMTAPQAAGVIHSDFERGFIRAETVAYADLVATGSMTAAKEKGLVRSEGKEYIVQEGDVMLFRFNV

SEQ ID NO: 46010 - protein, 193 aa, Chlamydomonas reinhardtii
MADDLDDWETADIESTLSKPAPAPAKPAQTFETKGEAIRAKINGPDMSQFEDEDANFSAPVEHSVPAPQPKKKEEKKFREERINPDDVPLDDPVLEKLRQQKLVEQADYEAARELFGGVSTLKPLESYMPKTLKEFEDFAAELVSRHVVEHGESKHYKAFIKALIKAAVEPLGSEEVKDLETCLAGVRADKIK

SEQ ID NO: 46011 - protein, 322 aa, Agrobacterium tumefaciens
MDKKVELIATGDVDKLRVSGCPPQEPGPGELRIRHDAIGVNYIDIYQRIGLYPLPLPAVLGVEGAGVIEAIGPDVDNIHVGDRVAYTGIPGAYSATRLLPAWRTIKLPDDISTRIAALSFLRGLTAHMLLTRTYSVKQGETLLIHAAAGGLGFVLTRWAKSLGCIVIGTTGSSEKADVARANGVDHVIVGREADVVSEIGRLTKGKGVDFAIDGIGGEMLRKTLGCVRRFGTVASIGQAAGPIPPVSVEELGPIRSLSLARPSVMAYAAEQETYHLAAKAVIAAIREGIMPEPGGEYPLSEAAQAQSDLESGRTAGSLMLVP

SEQ ID NO: 46012 - protein, 238 aa, Vibrio angustum S14
MIKKASLVLLSLLAGVPLTAQAADWGYGKSNEHWAESYPMCGLGKNQSPINITSALQTNLAPLRIEYDGKITDITNNGHTVEALVSGDNKLIVDGDTYTLKQIHFHTPSENLINGKQYPLEAHFVNVDDKGNIAVIAVMFENGLRENNALNSLLKDIPTKGNTIDFTDDLSPNNLLPREREYYQFNGSLTTPPCTEGVRWFVLETPQYSSKDQTEKLHQVMGNNNRPVQPINARIIVE

SEQ ID NO: 46013 - protein, 473 aa, Cunninghamella elegans
MNNFIFKRLNVKEFYEAETKKLVENGHEFHLRLERTGYVIHTCNPQAIKEILLKGDKFPKYDYNTSNNEDGSFFHEFVGFENVLMTNGSTWKKHRMIVNPAFKTALPSRLFGDCTRDLFKLWDNEYANEPFDSDIHNITERLTLQIIGKAAFDFDFNAILDEKSIWKQTYDGINKAASDPLFILFPILEEKFLWLFPKRQQSFKLLNEWKKMLLSIIEKKREAIQNNVDHGVEEAEKDLLTLMIESEHRGEGALSNEELLSDLIIFFIAGHDTTAFALSAAIYYLAKHPDIQEKARQEAISVLCPNGEVDEDIFPTTEDTKHFVYINQIMKETLRINGSVLFLLSPRLVTQDVNLSGVFIPKGSQINVNIHEVHHNPNVWHDPETFDPDRWASNGEAEQLAGKGMAWVPFSNGNRQCIGMNFSLLEQRVILGSLLRKYEWTLPEDSIHQDYMVNKFNLIPKPIDLKIRFKRRY

SEQ ID NO: 46014 - protein, 203 aa, Arabidopsis thaliana
FTASNFSLAFPYIAAPEEERMENLLLSGLKEACPNNVGVSNIVFSDSCFVEDGTIQKLSDLQSFKDHLLARRETRKEGETDLVVLCSEGSESNSQSGQSRSERESILELVSSVEQSGSKYTALYVSDPYWYTSYKTLQRFLAETAKGNSTPEIATGCDELCKFKSSLLEGILVGIVFLLILISGLCCMAGIDTPTRFETPQDS

SEQ ID NO: 46015 - protein, 255 aa, Rhodopseudomonas palustris CGA009
MNLFDLSGKVAVITGSSRGIGKAIAERMAEHGAKVVISSRKQDACDAVAKSINDTYGAGTALALAANISSKDDLKRLAQEATQTFGKIDALVCNAASNPYYGPQAGINDDQFRKILDNNIVANHWLISEVVPQMIARKDGSITIVSSIGGLKGSTVIGAYCISKAADMQLARNLACEYGEHNIRVNCIAPGLIKTDFARALWENPETLKASTARSPLQRIGEPDEIAGAAIFLASKAGTFTTGQTIVIDGGATIS

SEQ ID NO: 46016 - protein, 169 aa, Borrelia turicatae
MSTLIQRTLCIIKPDGVRRGLIGNVISRFERTGLKIVAAKMILVNREMAETHYLYDDIAVRHGEFVWQSLINFIISSPVFVFVVEGVEAVEVVRKFCGSTEPKMASPGTIRGDFAYHSFNYANEKEFSVYNVIHASANVDDALREVSLWFKENEILTYKRDDEFEHYYG

SEQ ID NO: 46017 - protein, 125 aa, Zea mays
MQVTPVHALGRGISPMQGLVMEVILTFSLLFVTYAMILDPRSQVRAIGPLLTGLIVGANSLAGGNFTGASMNPARSFGPALATGDWTNHWVYWIGPLLGGPLAGFVYESLFLVQKMHEPLLNGEV

SEQ ID NO: 46018 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHGKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 46019 - protein, 309 aa, Vibrio parahaemolyticus RIMD 2210633
MNPISRVAIIGECMVELKKHDGVLQQGFGGDTLNTAVYLSRLTKQHGVETSYVTGLGHDPFSREMLTAWREEGINTDMVYLSEDKLPGIYAIETAEDGERSFFYWRNDAAAKYWLRERALLSLVKDLCQHQMIYLSGISLAIISDDCRQMLIELLTMCRKEGVKIAFDNNFRPKLWPNIEQARDFYSKILSVTDMAFLTFDDEVMLWGDKHEDEAISRTKNFGVKEIIVKRGADDCFVVTQDQQHTVAALKVDAVVDTTAAGDSFSAGYLAKRILGGDVAESALAGHKVAGTVIQHRGAIIPSQAMPTI

SEQ ID NO: 46020 - protein, 335 aa, Gibberella zeae PH-1
MPNSMALTPYGSNGSTDLTMAVLGCGTMGVAILSGILNSLAEMQGPKPLQTLTSSPGDEVPDRLPSRFVASVATPAGAKRVKGALWEHSSILKVVHNDNIGAVQQSEVVILACKPWMVKEILTEPGISKALHGKLLISVCAGITVEDIEIALHGAVPCKDPEEDGRCRIVRAMCNTAAVIRESMTVIASPNSPLDHATESLVTWIFKRIGDVVYLPTRHMDASTALCASGPAFFALVLEAAIDGAVAMGIPRPDAQRMATQSMRGTAGLVQNGEHPALLREKVCTSGGCTIGGVLVLEEGKVRGTVSRAVREAAVVAGQIGKGADGVNGTRFHYE

SEQ ID NO: 46021 - protein, 180 aa, Gibberella zeae PH-1
MAMSCRYAAQSCARQLRSARTARAPAQLVRIPATSRRWNSTEAAPVNPKIEAIVDQISQLTLLETADLVSSLKNKLNIPDMPIGGFAAAPAAAPAAVEEAEEAAPAAAEKTLFTLKLQGFDAPSKAKVIKEVKNMLGLSLVDSKKFVESAPKMMKENVPKEDAEKIINTMKELGATVVME

SEQ ID NO: 46022 - protein, 276 aa, Silicibacter sp. TM1040
MTQKIAIQGELGSYSHEACRNKRPDMEVLPCRGFEDAINAVRSGEAELAMLPVENTTYGRVADIHRLLPHSGLKIIDEAFVRVHINLLGVPGATLDDIKEAHSHLVLLPQCATFLRQHQIQGRVSPDNARAAREVAERGEITHAALASELAGEIYGLNVLARHIEDQGNNTTRFLTMAREADTSRRGDNGMITSFVFQVRNIPAALYKAMGGFATNGVNMTKLESYMVNGSFTATQFYADIDGHPEDENVRLAMDELSYFTTDVEILGVYPADRKR

SEQ ID NO: 46023 - protein, 172 aa, Prochlorococcus marinus str. MIT 9211
MMSNYLSQLISQHKDFPKKGIVFKDVLPLLQHPNELEGLIQGMSTGQIFESSDAIVSIDARGFIFGTAISMKLSKPMIVARKPGKLPGELITHSYELEYGQNSLSIQKKAIENYQSFVIVDDLLATGGTAMCVSEMLKEAGKDITGLSVVVELGQLNARAYLPFPVESQIIF

SEQ ID NO: 46024 - protein, 364 aa, Pseudomonas syringae pv. tomato str. DC3000
MNNKKLRIAAIAGDGIGLEVLPEGVRVVQAAAARHGLELQFEYFEWASCDYYLEHGKMMPDDWFDQLKSFDAIFFGAVGWPDKVPDHISLWGSLLKFRREFDQYANIRPVRLFPGVPCPLANRKPGDIDFVVVRENTEGEYSSLGGIMFENTDNEFVLQESVFTRRGVDRILKFAFEMARKRERKHVTSATKSNGMAISMPYWDKRTEAMASHYPEISWDKQHIDILCARFVLQPERFDVVVASNLFGDILSDLGPACAGTIGIAPSANLNPERRFPSLFEPVHGSAPDIFGKNIANPIAMIWSGALMLEFLGQGDKRFTAAHDEIIMAIEQAIASGEVTPDLGGQRSTQEVGAAIAGRVGAAR

SEQ ID NO: 46025 - protein, 253 aa, Orobanche ramosa
GDAFLVLSPYYLAFNRDLRWRTGVQLLPVMCQSSNNFQITKEALEEAYQKAQESNIKIKGLILTNPSNPLGTTLDRPTLRSLVTFINDKKIHLVCDEIYAATVFRAPNFVSISEIIEEIKCDRDLIHIVYSLSKDLGLPGFRIGIMYSYNDKVVNCGRKMSSFGLVSSQTQHLLATMLSDDDFTDKFMFENTKRLANRHGMFTNGLQEMGIRCLESNAGLFCWMDLRHLLKEPTFESEMGLWRVIINEVKLNV

SEQ ID NO: 46026 - protein, 344 aa, Cryptococcus neoformans var. neoformans JEC21
MGKEKVAVVGSGNWGSAISRIAGINTKKHPDVFDDTRVSVWVYEEEFEGKKLTEIINSEHENRKYLPGVKLEDNVVAVPDLKEAVKDATALVFVTPHQFLGKVLDTLEGNVRKDAKAITLIKGVEVQGDDIHIFADVIEQRLGIPCSALSGANIANEVARDTFSETTIGYRNKEDGELWLKLFQTPKFKVQLIDDVAGVSLCGALKNIVAVAAGFIDGLGYGSNSKAAIMRIGLLEMKHFCQEFFVDVKEESFLQESAGVSDVITSCLSGRNYKVAAAFVGANKSFDQLEAEMLNGQKLQGIHTAKDVHNFLSAKNRSRAYPLFDKVYQISWEGVPVEQLTEGL

SEQ ID NO: 46027 - protein, 497 aa, Orobanche minor
MKMELKNGGTNCQLLSKIATNNEHGENSPYFDGWKAYDNNPFHTTKNPNGVIQMGLAENQLSSELVEKWTKNNPKSSICSPEGIDAFKDMAIFQDYHGLPEFRNAVAKFMGKSRGGKVKFDPERIVMAGGATGANELLMFCLADPKDAFLIPTPYYPGFDRDLKWRTHVQLLPIVCESSNKFRITKEALEEAYMNAQKAKIKVKGLIITNPSNPLGTTMDKATLTALVTFINKKQIHLVCDEVYAGTVHSPNFTSISEVVQDMEDHCNHELIHVVYSLSKDMGLPGFRVGIVYSYNDTVVNIGRKMSSFGLVSSQTQHLLASMLSDEGFIDELILESKRRLASRHDLFTKGLEQVGIRCLESNAGLFCWMDLRTLLEEPTFEEEMKLWRVIINDVKLNVSPGSSFHCHEPGWFRVCFANMDDLTMEVALRRIRMFVEKGKEDSTEVIIVRKEKKAWQRRLGRLSLSTLMYDENILTTSQFSSPHMMSPHSPLVLART

SEQ ID NO: 46028 - protein, 444 aa, Zea mays
  misc_feature (410)..(410): Xaa can be any naturally occurring amino acid
MYGPPSRGGGGAGAAGEQPRVYQVWHGSNEFFLQGRFIFGPDVRSLFLTIFLILAPVVVFCIFVARHLINDFPDHWGVSVMVIVIVFTIYDLTLLLLTSGRDPGIVPRNTHPPEPEAIDMNNDAGNGQTPQQLRLPRTKDVIVNGTIVKVKYCDTCMLYRPPRCSHCSICNNCVERFDHHCPWVGQCIGLRNYRFFYMFVFSTTLLCLYVFGFCWVYIIKIRDAEQSSIWKAMLKTPASIVLIIYCFICVWFVGGLSVFHFYLMSTNQTTYENFRYRYDRRANPYNIGILNNFMEIFCTAVPPSKNNFRARVPVEQGLQQSRAPARGFMSLNMDKPVGDFELSRKPVSWDEPRSAADIRDLEVGLGGLLDEKEGRIAHASPDLSRDALPELVEGRAGMHSRRSSWGHRSXGTSESVDSIAVQMGTGDSHWGSISSAHGTTSGAH

SEQ ID NO: 46029 - protein, 230 aa, Lactobacillus johnsonii NCC 533
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKDTAEKYGDEQVHIWRRSYDVLPPAIDDDNEYSQAHDRRYANLDPHIVPKAENLHVTLDRVMPFWEDHIAPDLLDGKNVIIAAHGNSLRALTKYIENISDDDIMDLEMKTGEPVVYTFDDKLDVVNKEKLDD

SEQ ID NO: 46030 - protein, 311 aa, Orobanche minor
MTTFPVINMEKLNGEERSATMEMIKDACENWGFFEVMNHGIAPEFMDSVERLTKEHYKKCMEKRFEEMVASKGNIEALQSEINDLDWESTFFLTHLPVSNISEIPHLQDEYRKVMKEFAVQLEKLAEQLLDLLCENLGLEKGYLKKAFYGSKGPTFGTKVSNYPPCPKPDLIKGLRAHTDAGGIILLFQDDKVSGLQLLKDGKWVDVPPMRHSIVINIGDQLEVITNGKYKSVMHRVIAQTDGTGRMSLASFYNPGSDAVIYPAPSLVEKAENNELYPEFVFEDYMKLYAGLKFHAKEPRFEAFKKIEKSS

SEQ ID NO: 46031 - protein, 369 aa, Pseudomonas syringae pv. tomato str. DC3000
MAFDRIEDIIEDYRQGKMVLLVDDEDRENEGDLLLAADCCTAQAISFMAREARGLICLTLTDEHCKSLGLEQMVPSNGSVFATAFTVSIEATTGVTTGISAADRARTVQAAVNPGAVPDDLVQPGHIFPLRARDGGVLTRAGHTEAGCDLARMAGFTPASVIVEVMNDDGTMARRPDLELFAEKHGIRIGTIADLIHYRLSTEHTIVRIGERELPTVHGTFRLFSYEDRIEGGVHMAMVMGDIRREDPTLVRVHVVDPLRDLVGAEYTGPANWTLWAALQRVAEEGCGVVVVLANHESSQALLERIPQLTQPPRQYTRSQSRIYSEVGTGAQILQDLGIGKLRHLGPPLKYAGLTGYDLEVIESIPFPG

SEQ ID NO: 46032 - protein, 715 aa, Synechococcus elongatus PCC 6301
MHFSHVVVVLIEILVVILCSRLLGSLVHRFGQPLVVGEIAAGILLGPSFLGAIAPKLELAIFPQASGSYLELLAQVGLIFFMFLIGLELNPQYLRGRLRLALWVSNLSVLLPFGLGIGLAIGLQRFYPAILVQGVGLLPVSLFLGVALSITAFPVLARILTERNLQRTPLGSLALTCAAIDDLTAWCLLAIAIAVTRTNSMVAAIPTIVLAMLYCGGMLTMGRRWLGNVISRWYARSGELSQVLLATIYMGVLVSALLTELIGIHFIFGAFLLGVILPKNQALTRDLALRTEDFVLTILLPVFFAYSGLRTDLSRLNQPALWFIGGLILVVAIAGKVGGAYLAARWGNMSVREAQTLGWLMNTRGLTELVVLNIGLSLGVISSELFTLLVIMALVTTVMTTPLLNRLYPQRRILSLPQPQLPNSDSAYQVLVPLANPQTQRQLLSVAADLALSDRGMGVIYPTNLLEINNDYGFDDMPVEVEAELQNLHQGMARLLGELRLPPAVVLPIIRSSGNVGRDLCQLADQAQADLILAGWHRSTVGDSRLGGRVGYLLNHAPTDVAIYVNKDSHSSRRRLLVPYGGSSHDDLSLELALRLLLGHPQRQLRLLQFEAIAGAELSAEARDLLDSLSPQLRDRIRYECLWQQDPLDFLIEATAEADLTVVGTSPSWGLARKTLGFYPDRLVEACQSSLIVTRRYTAISRHLSPQTLSLATTQ

SEQ ID NO: 46033 - protein, 222 aa, Vibrio vulnificus CMCP6
MKDFLIAPSILSADFARLGEDVEKVLAAGADVVHFDVMDNHYVPNLTFGAPVCKALRDYGITAPIDVHLMVKPVDRIIPDFAKAGASMITFHIEASEHVDRTLQLIKEHGCKAGVVLNPATPLAHLEFIMDKVDLILLMSVNPGFGGQSFIPHTLDKLRAVRKMIDATGRDIRLEIDGGVKVDNIREIAEAGADMFVAGSAIFGQPDYKAVIDEMRAELAKA

SEQ ID NO: 46034 - protein, 226 aa, Zea mays
MAASLLHAAASSPLAGPYPAARAAFRPLASSPFLRLARSSPDRRARLDFPLRALSGGARLSTGVAALRPRRFVAALAGEEPMSSELGDDKEKETEKIEIEPEEAQEVWREMLKQFKAEAIRMQALTTQAYDVYSKRAREVLLEASEKLRIQADKAQKDLTIIAAEVGEEGQEYLQLAAKNSPDSIKDITETINAVGNLNGPSEYKDYHVGISFGTFPTVGGFLNFC

SEQ ID NO: 46035 - protein, 315 aa, Pseudomonas syringae pv. tomato str. DC3000
MRALAALSRFVGNTFAYWVLLFAILAFMFPQVFIGLKGWIVPLLGLVMFGMGLTLKLEDFSEVARNPWRVALGVVAHFVIMPGVAWLLCQVFQLPPEIAVGVILVGCCPSGTSSNVMAWLAKGDLALAVAIAAVTTLLAPLLTPTLIWLLASAWLPVSFLDMFWSILQLVMLPILLGVVAQRLLGARVRYAVDVLPLVSVVSIVMIVCAVVAASQAKIAESGLLIMAVVILHNTFGFLLGYFTGKVFKLPLAQRKSLALEVGMQNSGLGAALASAHFSPLAAVPSALFSVWHNISGALLSTYFRKMPEEENTSAR

SEQ ID NO: 46036 - protein, 181 aa, Borrelia turicatae
MWEILMKDKTEYYDKFIMKVPNFPKEGILFYDITNVLLKAEAYKSLIEDAHAFYLSRNIDYIAAIESRGYLIGAPLALKMGLPLLLIRKEGKLPRQVLREEYNLEYGFSSIEIHKDDVKQHSNILLVDDILATGGTLKAAAMLLKKSGGVVSDIFCFIELVSMNGKDALREYSLNSLVKYF

SEQ ID NO: 46037 - protein, 578 aa, Triticum aestivum
MGGGNGIVDGFRRLFHRRTPSGSVLGSSNQSSAGEDSSDAEAAEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPGVGQNGLSPTSLSSRTYLKSASISASKCVVVNPNKQPEYDDAISEETEGAVDGLSEKVSKMHA

SEQ ID NO: 46038 - protein, 303 aa, Populus tremula
DVYFWEAKGQTPLFPRIYGHEAGGIVESVGPGVTDLQPGDHVLPVFTGECGDYRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 46039 - protein, 324 aa, Pseudomonas syringae pv. tomato str. DC3000
MSRIYADNAHSIGNTPLVQINRIAPRGVTILAKIEGRNPGYSVKCRIGANMIWDAEASGRLKPGMTIVEPTSGNTGIGLAFVAAARGYKLMLTMPASMSIERRKVLKALGAELVLTEPAKGMKGAIAKAEELLAGDPETFFMPAQFDNPANPAIHEKTTGPEIWADTDGTIDVLVAGVGTGGTITGISRYIKHTAGKPILSVAVEPDSSPIITQAMAGEEITPAPHKIQGIGAGFIPKNLDLSIVDRVERVTDDESKAMARRLMQEEGILCGISCGAAMAAAVRLAEKPEMQGKTIVVILPDSGERYLSSMLFSDLFTDQELSQ

SEQ ID NO: 46040 - protein, 512 aa, Borrelia turicatae
MNNNAVIVLDFGSQYSQLIARKIREMGVYTMVIAYSISAEEIKDMYPVGIILSGGPASVYLDEAPTVDIDIFNLGVPILGICYGMQLIIKLFGGVISKCDKQEFGNTELFIEDDQSNLFFGLSNKLKVMMSHGDNIEKVPSNFKQIAYTETCIASVFNEEQKIYGLQFHPEVTCSEVGNQILKNFVFKICQAHVNWNLSNSIDDFVEKIRLQVGDKKVILGLSGGTDSLVCALLINNAIKSNLICVFIDTGLLRKNEVREILELGRQYNLNIKYVDSSSIFLKNLENIDEPEEKRKIIGRTFVEIFEKVALEDKDVEFLAQGTIYSDVIESESRNNVFSSHIKSHHNVGGLPEKIRLKLLEPLRELFKDEVIQLGIQLGIEENSLYRHPFPGPGLAIRIIGKISQEKINILQGADSILIEELLANNLYYKIRQAFVVLLPVKSVGVMGDNRTYEYTAVIRCVNTLDFMTANWVELPYDFLRKVSSRIINEVRGINRVCYDISSKPPATIEWE

SEQ ID NO: 46041 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTGLINPKDHDKPVQQVIIEMTDGGVDRSIECTGNVQAMISAFECVHDGWGVAVLVGVPSKDDEFKAHPMNLLNERTLKGTFFGNYKPRTDLPGVVEKYMNKELEVEKFITHS

SEQ ID NO: 46042 - protein, 227 aa, Arabidopsis thaliana
MADSLLMEVNYRRPEKIPKLDEDCEGSESSSKQRVVKWGKAEDDEYLRQYLLFHYQFQKTQGFSIKWEQFDYNFRSRSMGKSPNEISERKSNAVLIREMTLTAIDKHNEAHGTKLVFVEHVEANYQLTSGLTCWLTFWATDMASSPPQSKIYQAHVWRRGQNFHTFIFRLKPTDEEIEAVEVQPPSPMLYELDKPPIVFSRPGPEDEALPGVPFVFNRTGAGLDPDW

SEQ ID NO: 46043 - protein, 107 aa, Arabidopsis thaliana
MFHSHGNASSVNDPRQPSAAKPYIPRPVAPEDLPVDYSGFIAVILGVSGVMFRYKICSWLAIIFCAQSLANMRNLENDLKQISMAMMFAIMGLVTNYLGPNRPATKK

SEQ ID NO: 46044 - protein, 359 aa, Coccidioides immitis RS
MHRTPFQAPPPAQSPPLHHPVPQHVSTVPMMRSPPPPTTQQPQQSSYGNPYQPAPAQGGSGTFAPNFGGFMTDPTTHMGFQVGKSAMMAGQEYMEQNLNRYVSIPALKHYFNVSNSYVIKKLGLVLFPWRHKPWSRQQGRLSSSTTGPNGQISQAQYTSIYLPPRDDINSPDMYIPAMALVTYILLSAVLAGFRGSFHPELLGSITTTALAVVIFEIICLKVAMYILSISNDSQLLDLVAYSGYKFVGIILTLVAAETLSPGRGTGGWVGWLVFTYTFLANSFFLLRSLKYVLLPDSSSDGPIRGGTMPTVARSQRNRRTQFLFIYSYIMQFLFMWVLSRLDPITSTSAPKIKPPTVPA

SEQ ID NO: 46045 - protein, 385 aa, Bacillus cereus G9241
MEQFINPRVKDIQISGIRQFSNMIQNYDNLISLTIGQPDFPTPSLVKEAAKRAITENYTSYTHNAGLLELRKAACNFVKDNYDLHYSPENETIVTIGASEAIDVAFRTILEPGTEVILPAPIYPGYEPIIRLCGATPIFIDVRETGFRLTAEALEKAITEKTRCVVLPYPSNPTGVTLSKEELQDIVDVLKDKNIFVLSDEIYSELVYEQTHTSIAHFPEMREKTIVINGLSKSHSMTGWRIGLLFAPRYLAGHILKVHQYNVTCATSIAQYAAIEALTAAKDAPKMMRHQYKKRRDYVYNRLIQMGLTVEKPTGAFYLFPYVGHLTSSSFDFALDLVKEAGLAVVPGTAFSEYGEGYLRLSYAYSIETLKEGCDRLEAFLQQKS

SEQ ID NO: 46046 - protein, 401 aa, Chlamydia trachomatis D/UW-3/CX
MYNVKKDFPIFKNQGDPYVYLDSAATTHKPQCVIDSIVDYYSSSYATVNRALYTASHDITFAHWQVRSKVGSWIGAQYDQEIIFTRGTTSSLNLLAIAANDSWLAGGTVVISEAEHHANLVSWELACQRSGATIKKVRVDDEGMVDCSHLEQLLKQGVQLVSLAHVSNVSGAVLPLPEIAHLVHRYEALFAVDGAQGVGKGPLNLSEWGVDFYAFSGHKLYAPTGIGVLYGKKELLESLPPVEGGGDMVIVYDFEELSYQEPPLRFEAGTPHIAGVLGLGAAIDYLQALPFSITDRLTELTHFLYEQLLTVPGIQIIGPKQGAARGSLCSISIPGVQASDLGFLLDGRGISVRSGHQCSQPAMVRWDLGHVLRASLGIYNEQQDILLFVEALKDILRAYRS

SEQ ID NO: 46047 - protein, 590 aa, Zea mays
TRPRPYTNQIRYNVSIVKTDTSTLPPIINADEIFIVISTTNVGTDSEDVSAMKAIKAKYQVKKNWMGDPCVAGTFRWDGLTCSYAISDPPKITALNMSFSGLTGDISSAFANLKAVQSLDLSHNNLTGSIPSSLSQLPSLTTLDLTGNQLSGPIPSSLLKRIQDGSLNLIYADNPDLCTNAGDSCQTAPQGKSKLVIYYVAVPMALIVVALAVLLCCLLRRRKTRGLADVSVKPRDKTPTSLASMAADEHRLSSLRLENRRFTYEDLEMITDSFKRVIGRGGFGYVYEGFLEDGTQVAVKMRSQSSNQGAKEFLTEAQILTRIHHKNLVSMVGYCKDGVYMALVYEYMSEGSLQEHIAGKRLTWGQRLRIALESAQGLEYLHRGCNPPLIHRDVKTSNILLNAKLEAKVADFGMSKALDRDTYASTNTLVGTPGYVDPEYLETMQPSTKSDVYSFGVVLLELVTGRPPILHSPQPTSVIQWARQHLARGDIEVVVDASMGGNHDVNSVWKAAEVALQCTEQASAQRPTMGDVVAQLLECLDLEKGRSANESFCDGDDSGSATASLSHSSAFVTGRIFGTVPMVETGPATR

SEQ ID NO: 46048 - protein, 403 aa, Chlamydia trachomatis D/UW-3/CX
MDKLSIRDLSLEGKKVLVRVDFNVPIKDGKILDDVRIHSAMPTIHYLLKQDAAVILVSHVGRPKGGVFEEAYSLAPIVPVLEGYLGHHVPLSPDCIGEVARQAVAQLSPGRVLLLENVRFHKGEEHSDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCASQISHVSTGGGASLEFLEKGSLPGTEILSPAQS

SEQ ID NO: 46049 - protein, 189 aa, Leifsonia xyli subsp. xyli str. CTCB07
MSNWNLPNVLTIVRILLAPLFVWMLLADAGRDGPLRWAAAALFVIAIATDGVDGAIARRNNLVTDLGKLLDPIADKVLTGGALIALSVLGELPWWVAIVILLREIGITVYRFVVIRQGVIAASRGGKIKTIVQSVAISSALFPLWTVFGEGMFWVNGILMTAAVVLTVVTGFDYLWQAYRGRAEKRAAA

SEQ ID NO: 46050 - protein, 318 aa, Arabidopsis thaliana
MDTEMETEQIYQVDVGNLLAFNPNHRFPSAPSSRGELVKEILTEGTKLVQEIANKLFNFPSTETNDGPIVQLPPPTTKLPREKHIPRPKPPTKWEEFALKKGIQKRKKEKVVWDEQTNQFKRRHGYDRVNDDNDVPIIEAKESDEPGVDPFAKRLDDKKKRVGKQEKNRLQNLKAAEKAGALPSHVQLAATSLPISGTKAQPKKIGKDELGDVAGLAATSTASGGKFDKKLPGEKPPKKQGKHHKYLPVVSGRGDVNAEKEQTNNVLSKIFSKHSHEILNVGKAINMYNVKKEKKKSGRSDKLKPKKDITKKPANKAK

SEQ ID NO: 46051 - protein, 152 aa, Escherichia coli
DLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 46052 - protein, 493 aa, Pseudomonas syringae pv. tomato str. DC3000
MSLTRFQMCIDGQWVDALSGKTFDSLNPALAEPWAQLPDAGEADVERAVQAAQKAFESQEWRGLTATARGKLLRRLGDLIAENKEHLAQLESRDNGKLIRETRGQVSYLPEFFHYTAGLADKLEGGTLPLDKPDLFAYTVHEPMGVVAGIIPWNSPLYLTAIKLAPALAAGNTIVLKPSEHASATVLELARLALEAGIAPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPLDESTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 46053 - protein, 173 aa, Thermococcus kodakarensis KOD1
MPVYEIEGKKPKIHPTAFVDETASIIGDVVLEEKTSVWPSAVLRGDIEQIYIGCCSNVQDNVSIHTSHGLPTKIGKYVTIGHNAVVHGATVDDYTIIGMGAIILDGAKIGKHVIIGAGALVPPGKEIPDYSLVVGVPGKVVRQLSEEEIEWTKKNAEIYMELAEKHLKRKKIE

SEQ ID NO: 46054 - protein, 320 aa, Brassica napus
MMLRAVIRRASSRVSSASSLGLGKSLQSSRVAASAQSFHSVSSTQTLALPLPRGSHARSFHYHRSCPGCPDCSRTVSSSFRGTTLQRWVRPFSSDTGDVVEAVVPHMGESITDGTLASFLKKPGDRVEADEAIAQIETDKVTIDIASPASGVIQEFLVKEGDTVEPGNKVAIISTSADAVSHVAPSEKTAEKPAAKPSPPAEEPKVESSKVAEKPKAPSPPPPPTKQSAKEPQLPPKDRERRVPMTRLRKRVATRLKDSQNTFALLTTFNEIDMTNLMKLRSQYKDAFFEKHGVKLGLMSGFIKAAVSALQAQPVVNAGI

SEQ ID NO: 46055 - protein, 379 aa, Pseudomonas syringae pv. tomato str. DC3000
MKAIVYNGPRDVSVKNVPDAKIEKPTDALVRVTTTNICGSDLHMYEGRTSFETGRIFGHENMGEVIEVGAGVDRVKVGDRVCLPFNIGCGFCENCEKGLTGYCLTANPGSAGAAYGFAEMGSHEGGQAELLRVPYADFNCLLLPEDAAEREDDYVMLSDIFPTGWHATELAGLLPGESVAIYGAGPVGLMAVHSAMIKGASQVFVVDNHPDRLALAAKMGATPINSLEQGAVDQILNLTDGRGTDRGCECVGYQCCDRHGHEANHVTMNNLVASTKATGGIGVVGVFVPQDPGAHSDLAKEGKMAFDFGSFWFKGQQIRTGQANVKAYNRRLAELIHHDRAKPSQIISHRLKLEEGPAAYQHFDARDDGWTKVVLKPNG

SEQ ID NO: 46056 - protein, 778 aa, Zea mays
  misc_feature (591)..(591): Xaa can be any naturally occurring amino acid
  misc_feature (697)..(697): Xaa can be any naturally occurring amino acid
LELGIANDVKVVIFNFGGQPAGWELKKEWLPDGWLCLVCGASDTQELPTKFTLSLHKDAYTPDLMAASDCMLGKIGYGTVSEALAYNLPFVFVRRDYFNEVRFLRNMLEHYQCGIEMIRRDLLTGHWKPYLQRAITLQPCYDGPINGGKVAAHILQDTAVGKKYISGKLSGARRLRDAIVLGYQLQRAPGRDVGIPYWYSHSEKEISVGPAPTSRPGNGSDESSFEDFEILHGDMQGLTDTMSFLKSLSGLVGNDLRSPEKQTRERAAASVLFDWEEEIYVARAPGRLDVMGGIADYSGSLVLQMPIREACHVAVQRSDPTKQKQWKHTQARQLANGGAVPVLQIVSFGSELSNRAPTFDMDLSDFMDGDKPISYDNVKEYFSRDPSQKWAAYVAGTIFVLMAELGVRFKDSMSILVSSSVPEGKGVSSSASVEVASMSAIAAAYGLNIAPRDLALLCQKVENRVVGAPCGVMDQMTSACGEANKLLAMVCQPAEVKELVNIPTHIRFWGLDSGIRHSVGGTDYGSVRVGTYMGRKMIKCAASNLLSELLLSCTSTQPGDSSPDEYEGHGVDLLKSEASMEYLCNLPPHRXYEAVFAKEIPETITGDAFLEKYGDHNDAVTEVDPKRSYCVKAPTRHPIYENFRVEAFKALLTAAKTDEQLSALGELMFQCHYSYNACGLGSDGTDRLVNLVQEIRXRKSSRAGGPSLFGAKITGGGSGGSVCVMGKNCLKSSEEILEIQKRYKAATGYLPTVFDGSSPGAGKFGYLKIRRRSTSPSD

SEQ ID NO: 46057 - protein, 260 aa, Klebsiella pneumoniae subsp. pneumoniae MGH 78578
MPSIIIKTADELARQRHAGQLLASVFDMLDTFIVPGVTTMAINDRVEDFIVNQLHARPASKGQYDFPYVLNTSINDVVCHGIPKATEHLRSGMIVNVDITLEKAGMIADSSKMYLIGDVSPLARRLVKTTYEGMWKGIEVVKPGATLGDIGHAIQRWVEEHGYSVVREYCGHGVGREMHEEPQVLHYGRPGEGAVLQEGMVFTIEPMVNQGDSRIKTKKDGWTVVTRDKKLSAQWEHTVAVTANGFEVLTLRDDEQSRIR

SEQ ID NO: 46058 - protein, 80 aa, Synechococcus elongatus PCC 6301
MSQEDIFSKVKDIVAEQLSVDVAEVKPESSFQNDLGADSLDTVELVMALEEAFDIEIPDEAAEGIATVQDAVDFIASKAA

SEQ ID NO: 46059 - protein, 498 aa, Lentinus tigrinus
AVGPVADLTVTNANIVPDGFERAAIVVNNVFPAPLITGNMGDNFQLNLVNQMTNHTMLKTTSIHWHGFFQKGTNWADGPAFINQCPIASGNSFLYDFQVPGQAGTFWYHSHLSTQYCDGLRGPFVVYDPNDPHANLYDVDDESTVITLADWYHVAAKLGPRFPKGADSTLINGLGRSTSTPTADLAVISVTKGKRYRFRLVSLSCDPNYTFSIDSHQLTVIEADGVSTQPVTVDSIQIFAAQRYSFVLNANQDVDNYWIRANPNFGTTGFADGVNSAILRYDDADPVEPVTNQTGTTLLLETDLHPLTSMPVPGNPTQGGADLNLNMAFNFDGTNFFINGESFTPPTVPVLLQIISGANTAQDLLPSGSVYSLPSNSSIEITFPATTAAPGAPHPFHLHGHVFAVVRSAGSTSYNYDDPVWRDVVSTGTPQAGDNVTIRFQTDNPGPWFLHCHIDFHLDAGFAVVMAEDIPNTVNANPVPQAWSNLCPTYDALEPSNE

SEQ ID NO: 46060 - protein, 609 aa, Cryptococcus neoformans var. neoformans JEC21
MTDPTPPALDSLSLADKAPAAEENPRDAAEQPKPAASPPAGTPVDDAQSSSASPSQRPPSIQANDKAPGTSSPAARPQAQHVPASAPTVPSANPVRPQPGARPGVARGMPAPMGMRAQAVRGAGGPQMQTKMLPSLQAKMDKIAASRQGPPPSSGMHDPNATSMGALLRSQALRAPGTSQAPPGPGPASGPFGLAARRAAAGGPPRPNLGMMGMGASAPSAVGRGPGLAGRRGPPGGLTLSGMKGAIKDDGNKFSDFQGVMDPSGSLRFSKKAVLHAKGVDFDDGQSFKINMDEIEVLGELGKGNYGSVHKVFHRPTGVTMAMKEIRLELDDSKLNGIIMELDILHRAVAPEIVEFYGAFTIESCVYYCMEYMDAGSLDSLTGGGVAAKDQTKEEEDDATERVPEDVLRRITARIVKGLRFLKDELQIIHRDVKPTNVLINGKGEVKMCDFGVSGQLEKSLAKTNIGCQSYMAPERIKSETANQNPTYTVSSDVWSVGLSIVELAKGCYPYPPETYANVFAQLQAIVHGTPPTLPPGYSDDANDFVAKCLEKDPNRRPTYAQLLEHPFLVADKGAEVDMVGWVEGALKRKAERGIASLNPIQTPAPLEP

SEQ ID NO: 46061 - protein, 476 aa, Pseudomonas syringae pv. tomato str. DC3000
MYPDVQLYIDGQWRASRDGRSIPVIDPATGQSLGSVAHAGIADLDEALSAAERGFATWRATSAYDRYKLMQKAADLVRERADSIARIMTQEQGKPLAEARMETLSAADVIDWLAEEGRRSYGRIVPSRGVSIEQKVIKEPVGPVAAFTPWNFPINQVVRKLSSALAAGCSIIVKAPEETPGSPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLQAFTEKFVGLTREIKVGNGLESGTTMGPVANDRRIPALVDLIEDAVSAGATVSAGGKAVEGQGYFFEPTVLSGLTPAMRIMNEEPFGPVALLVPFDTVEEAIVESNRVPFGLASYAFTTSMKTAQALSTYIEAGMLSINHQGIGLPEVPFGGIKDSGYGSEGGTEAIEAYLNTKLVTQYS

SEQ ID NO: 46062 - protein, 361 aa, Arabidopsis thaliana
MMMPELPEDLLVEILCRVPATSLKRLRSTCKLWNHLYNDKRFKSKHCHKAPRQSLILMWKNFGFSSISINLQRVSPIEVTGELNLIDHHSSLGMFRNSPLCQTSGLLLCVNVEKINTRLVVWNPCTGKTKWIQHRRMGYICNYALGSYQDKKSDNNSYKILSHGIYGGQEFEIYEINSNSWRILDVTVDSSLYIENVSLKGKTYWFATDGNDKPCDLFLICFDYTTERFERLCLPYQIPYFRNTSLSVVKEEKLSVLLQPSLTSKTQIWVTNKIGEAKVLSWIKFLTVDLKPEIKYGIKFLVDEENKVLVYEQNFVINGKNNMIYVVGEDNEVREVVFRVGLKPLFFYYVPSLTQIRQGND

SEQ ID NO: 46063 - protein, 550 aa, Vibrio vulnificus CMCP6
MLKTINPTQTQAWNALTAHFESAQDMDLKDLFAQDAARFDKFSARFGSDILVDYSKNLINEETLKHLFALAKETELSAAIKAMFSGEAINQTEGRAVLHTALRNRSNQPVLVDGEDVMPAVNAVLEKMKSFTDRVIGGEWKGYTGKAITDIVNIGIGGSDLGPYMVTEALAPYKNHLNLHFVSNVDGTHIVETLKKVDPETTLFLIASKTFTTQETMTNAHTARDWFLATAGDQAHVAKHFAALSTNAPAVSEFGIDTDNMFEFWDWVGGRYSLWSAIGLSIALAVGYDNFIELLEGAHEMDNHFVSTELESNIPVILALIGIWYNNFHGAESEAILPYDQYMHRFAAYFQQGNMESNGKYVDRNGNPVTYQTGPIIWGEPGTNGQHAFYQLIHQGTKLIPCDFIAPAVSHNPAGDHHQKLMSNFFAQTEALAFGKNEETVKAELVKAGKNAEEVAAIAPFKVFEGNRPTNSILVKQITPRTLGNLIAMYEHKIFVQGVIWNIFSFDQWGVELGKQLANQILPELADGSEISSHDSSTNGLINAFKAFKA

SEQ ID NO: 46064 - protein, 422 aa, Arabidopsis thaliana
MAFSSLLRSAASYTVAAPRPDFFSSPASDHSKVLSSLGFSRNLKPSRFSSGISSSLQNGNARSVQPIKATATEVPSAVRRSSSSGKTKVGINGFGRIGRLVLRIATSRDDIEVVAVNDPFIDAKYMAYMLKYDSTHGNFKGSINVIDDSTLEINGKKVNVVSKRDPSEIPWADLGADYVVESSGVFTTLSKAASHLKGGAKKVIISAPSADAPMFVVGVNEHTYQPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTSNVSVVDLTCRLEKGASYEDVKAAIKHASEGPLKGILGYTDEDVVSNDFVGDSRSSIFDANAGIGLSKSFVKLVSWYDNEWGYSNRVLDLIEHMALVAASH

SEQ ID NO: 46065 - protein, 315 aa, Vibrio vulnificus CMCP6
MLDWTDRHCRYFHRLMTKETLLYTEMITTGAIIHGKGDFLAYNQEEHPVALQLGGSNPQDLATCAKLAAERGYDEVNLNVGCPSDRVQNGRFGACLMAEPQLVADCVAAMKEVVDIPVTVKTRIGIDDQDSYEFLTDFVSIVSEKGGCEQFTIHARKAWLSGLSPKENREIPPLDYPRAYQLKKDFSHLTIAINGGVKSLEEAKEHLQHLDGVMIGREAYQSPYLLASVDQELFGSQSPIKKRRQIVEEMYPYIEQQLANGAYLGHMTRHMLGLFQNMPGARQWRRHISENAHKPGSGIEVLQQALAKIPQELDV

SEQ ID NO: 46066 - protein, 844 aa, Oryza sativa Indica Group
MSTRAPRSLLPLLFVVAAAAFFSRAATGADVIGQAGFITGNQTLVSSGGVFELGFFVPNGATDGRTYLGIWYASIPGQTVVWVANRQDPVVNVPAVARLSADGRLVIVDAKNTTVWSSPAPARNVTAAGATARLQDDGNLVVSSGSPGSVAWQSFDYPTDTLLPGMKLGVDVKNGITRNMTSWTSSSDPSPGSYTFKLVPGGLPEFFLFRGPTMIYGSGPWNGAELTGVPDLKSQDFAFTVVSSPDETYYSYSILNPSLLSRFVADATAGQVQRFVWINGAWSSFWYYPTDPCDGYAKCGAFGYCDTSTPTLCSCLPGFQPRSPQQWGLRDASGGCVLTANLTCGAGDGFWTVNRMKLPAATNATVYAGMTLDQCRQVCLGNCSCRAYAAANVSGGVSRGCVIWAVDLLDMRQYPGVVQDVYIRLAQSEVDALNAAANSEHPSNSAVIAVVIATISGVLLLGAVGGWWFWRNRLRRRRNETAAAAAGGGDDVLPFRVRNQQLDVKRECDEKDLDLPLLDLKAIVAATDDFAASNKIGEGGFGPVYMGKLEDGQEVAVKRLSRRSVQGVVEFKNEVKLIAKLQHRNLVRLLGCCIDDDERMLVYEYMHNQSLDTFIFDEGKRKLLRWSKRFEIIVGVARGLLYLHEDSRFRIIHRDLKASNVLLDRNMVPKISDFGIARMFGGDQTTAYTRKVIGTYGYMSPEYAMDGVFSMKSDVYSFGVLVLEIVSGRRNRGFYEAELDLNLLRYSWLLWKEGRSVDLLDQLLGGSFDYSEVLRCIQVALLCVEVQPRNRPLMSSVVMMLASENATLPEPNEPGVNIGRHASDTESSETLTVNGVTITEIECR

SEQ ID NO: 46067 - protein, 808 aa, Oryza sativa Indica Group
MRRRRALALLLVTMAFFSRPVIAVDRIGLTASIIGKSTLESAKGVFKLGFFTPPGGKGTYLGIWYANIQSNLTVVWVANRQHPVINAPGVVTLSANGLVIVDAQNTTVWSSPVPAGAITAGATARLHDDGNFAVSSDGSDSQSVVLWQSFDYPTDTLLPGMKLGEDRKKGITRNITSWSSPTDPSPGKYTFKLVLGGLPEFFLFDNSKTTPIYASGPWNGEILTGVPGLKSQQAKGDFTFTVLSSPEETYCNYSISNRNPSFLTRFFVDGTEGKLQRIWSSDDGKSWINNKISYPIDPCDNYGSCGAFGYCVYTEGQPQQCNCLPGFQSLSAQGSFQDTSKGCARITNLTCGDGDGFWRVNRMKLPDATKATVHAGMTLDQCRQECLRNCSCNAYAAADVSGGVNRGCVIWTVGLMDMRKYPEEFVQDLYIRLPQSQIDALNAPARRRRLIKNVVIAVVTTICGILGVVGCCCLWRNKMRWKRHSRIGKSSEAGDIPFRVRKNPASSPARDQWFDENNTSVEDDLDLPLFDLEMIFDATDRFAANNKIGEGGFGPVYLGRLEDGQEVAVKRLSRRSVQGVVEFKNEVKLIAKLQHRNLVRLLGCCIDDNERVLVYEYMHNKSLDTFIFDEGNRKLLSWNKRFEIILGIARGLLYLHEDSRFRIIHRDLKASNVLLDRNMVPKVSDFGIARMFEGDQTTAYTGKVIGTYGYMSPEYAMDGVFSMKSDVFSFGVLVLEIVAGRRNRGFCESELNLNLLRYAWMLWKEASENATLPQPNEPGVNIGKITSDTESSHGLTSNSVTITTIEAR

SEQ ID NO: 46068 - protein, 630 aa, Oryza sativa Indica Group
MASSSPLCCYLLLFVVVVVLTGSCRARDTVVPGRPLAANETLVSGGDANFVLGFFTPPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGSSKWSGGSRSTGRRYEGSSHHDDDLELPIFDLGTIAAATDGFSINNKLGEGGFGPVYKGKLEDGQEIAVKTLSKTSVQGLDEFKNEAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 46069 - protein, 578 aa, Vibrio vulnificus CMCP6
MTFSIENNKQVVLGEELGKLSDNERLKTQSNFLRGTIEQDLQDRITGGFTADNFQLIRFHGMYQQDDRDIRNERAKQKLEPLHNVMLRARMPGGIITPKQWLAIDKFATEHSLYGSIRLTTRQTFQFHGVLKPNIKLMHQTLNSIGIDSIATAGDVNRNVLCTTNPVESELHQEAYEWAKKISEHLLPKTKAYAEIWLDGEKVETTEDDEPILGKTYLPRKFKTTVVIPPQNDVDVHANDLNFVAIAEKGKLIGFNVLVGGGLAMTHGDTSTYPRRADDFGYIPLEKTLDVAAAVVTTQRDWGNRSNRKNAKTKYTLDRVGTDVFKAEVEKRAGIKFEVSRPYEFTERGDRIGWVEGIDGKHHLTLFIENGRLLDYPGKPLKTGVAEIAKIHKGDFRMTANQNLIVAGVSKSNKAKIEKLAREHGLMDEGVSEQRKNAMACVAFPTCPLAMAEAERFLPQFVTDVEGILDKHGLDKEDNIILRVTGCPNGCGRAMLAEIGLVGKAPGRYNLHLGGNRGGTRVPKMYKENITDKQILEEIDQLVGRWANERLPNECFGDFTVRVGIIEEVIISKRDFYA

SEQ ID NO: 46070 - protein, 161 aa, Brassica napus
  misc_feature (2)..(2): Xaa can be any naturally occurring amino acid
  misc_feature (20)..(20): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  misc_feature (33)..(33): Xaa can be any naturally occurring amino acid
  misc_feature (36)..(36): Xaa can be any naturally occurring amino acid
  misc_feature (38)..(38): Xaa can be any naturally occurring amino acid
  misc_feature (42)..(42): Xaa can be any naturally occurring amino acid
  misc_feature (48)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (60)..(63): Xaa can be any naturally occurring amino acid
  misc_feature (78)..(78): Xaa can be any naturally occurring amino acid
  misc_feature (80)..(80): Xaa can be any naturally occurring amino acid
  misc_feature (86)..(86): Xaa can be any naturally occurring amino acid
  misc_feature (92)..(95): Xaa can be any naturally occurring amino acid
  misc_feature (99)..(99): Xaa can be any naturally occurring amino acid
  misc_feature (104)..(105): Xaa can be any naturally occurring amino acid
  misc_feature (109)..(109): Xaa can be any naturally occurring amino acid
  misc_feature (121)..(121): Xaa can be any naturally occurring amino acid
  misc_feature (123)..(124): Xaa can be any naturally occurring amino acid
  misc_feature (127)..(127): Xaa can be any naturally occurring amino acid
  misc_feature (129)..(129): Xaa can be any naturally occurring amino acid
  misc_feature (131)..(134): Xaa can be any naturally occurring amino acid
  misc_feature (143)..(145): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (155)..(156): Xaa can be any naturally occurring amino acid
  misc_feature (160)..(160): Xaa can be any naturally occurring amino acid
MXSSMLFLRCVSPTSPGHAXMVAXFXGLKXSAXFPXTXLADXDITSIXXXXXRXSCMXVXXXXGKKKFETLSYLPDLXEXELTEEXEYLLRXXXXPCVXFELQXXFVYXEHVCTPGYDDGXYXXRWXVXLXXXXDSARVMKEXXXVKXGXPXAFXXIIGXD

SEQ ID NO: 46071 - protein, 303 aa, Populus tremula
DVNFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 46072 - protein, 589 aa, Pseudomonas syringae pv. tomato str. DC3000
MPTRTSRRTFVKGLAASSILSGLGLWRSPAWALPNPGQPDGLSGTEFDLTIGETQVNITGNARTAMTINGGIPGPLLRWREGDTVTLRVKNRLDETTSIHWHGIILPANMDGVPGLSFDGIAPDGMYVYRFKVRQHGTYWYHSHSGFQEQSGVYGPLVIDAKEPEPFTYEREHVVMLTDWADEDPARVMKKLKKQSDYYNNNKRTVGDFINDVGEKGWSATTAERWMWAQMKMNPTDLADVSGATYTYLMNGQAPNMNWTGLFKPGEQIRLRFINGSSMTYFDVRIPGLKMTVVASDGLHIKPVVVDELRIAVAETFDVIVEPADGAYTLFAQSMDRTGFARGTLTSRPGMQAEVPPLDPRPLLSMDDMGMAGMDHGSMNHSAKPAMDGMDHSKMDHDSMPGMDHGTMPMQEAPVMQSHPDSERNNPLVDMQAMSTSAKLNDPGIGLRDNGRKVLTYADLRSTFEDPDGREPSRTIELHLTGHMEKFAWSFDGVKFSDAKPLMLKYGERVRIVLVNDTMMTHPIHLHGMWSDLEDENGQFMVRKHTIDMPPGSRRSYRVTADALGRWAYHCHMLYHMEMGMFREVRVEE

SEQ ID NO: 46073 - protein, 481 aa, Leifsonia xyli subsp. xyli str. CTCB07
MIRNQYIDRQNILFVLNLFTPCFGSLWRRVEAMNSAVDLSFGSADLTFASSGDALVRRTILPSGVRILSEQVPGARSATLGYWVAVGSRDEQEHVPGSLGSTHFLEHLLFKGTRSRSALDIAVAFDSVGGEHNAMTAKEYTCYYAKVQDRDLDMAVEVIGDMLTSSALDPAEFENERAVILEELSMTEDDPSEVANERLFSAVLGDHPLGRPIGGRPESIRAASRDAVWNHYRANYRPQDLVVTAAGAVDHDQLVAGVQRALDAAGWDLAAAARPVARRATVPAAIQRAAAVVTVERPTEQVNLLVGVPGIVASDERRTAMSVLSSVLGGGTSSRLFQEIREKRGLAYAVYSFSASYSDAGVFGLYAGCAPAKARQVAELVLDELRRLADGGVTSEELSRTVGQLSGGTALALEDSDTRMSRLGRAEISLGEFADLDESLRRLRLVTAGDVRDLACDLVGREFSVSAVGNVTDDTFAGLVS

SEQ ID NO: 46074 - protein, 203 aa, Chlamydia trachomatis D/UW-3/CX
MTLVPYVVEDTGRGERAMDIYSRLLKDRIVMIGQEITEPLANTVIAQLLFLMSEDPTKDIQIFINSPGGYITAGLAIYDTIRFLGCDVNTYCIGQAASMGALLLSAGTKGKRYALPHSRMMIHQPSGGIIGTSADIQLQAAEILTLKKHLSNILAECTGQSVEKIIEDSERDFFMGAEEAIAYGLIDKVISSAKETKDKSIAS

SEQ ID NO: 46075 - protein, 372 aa, Leifsonia xyli subsp. xyli str. CTCB07
MALHELPDYPWDLMAPYAARAREHADGLVDLSIGSPVDATPALIRDALAAATDAHAYPQTAGTLALREAIVAWFERRRAVPGLSAENVLPTIGSKELVALLPFFLGLGHGDAVVHPRAAYPTYAIGAAIAGAAAVASDDPAEWPESTRLVWLNSPGNPDGHVLSVDQLRAAVVRARELGAYLASDECYAELGWEPPWDAQRVPSVLDPRVTGEDRRGVLAVYSLSKQSNLAGYRAAFVAGCPALVARLTTVRKHAGLMLPAPLQAAMVAALGDDEHVAAQRARYAARRAQLKPALEAAGFRVDRSEGGLYLWATEGRDAWETIGRLAGLGVLGGPGHFYGDHYPQHVRLSLTATDERIADAAARLRAFGYSL

SEQ ID NO: 46076 - protein, 67 aa, Glycine max
MTTSRRVADRKIAVFEKNITKRGSVPETVKKANDYPVGPIVLGFFVFVVVGSSLFQIIRTASNAGLF

SEQ ID NO: 46077 - protein, 320 aa, Coprinopsis cinerea okayama7#130
MGFTTLVTCDVYLGMFGWWAEVSQYRFIKPPSLLFTSYAYLTPRLMANWARFFSSFRNVIAFFKEAWFLGRPAWTVKDIPDLSGKVYIVTGGNSGLGADTVRALLKHRARVYIAARNEEKSLAFIEELFDETGHKAHFLKVDLADLGSVEAAASEFNRKEARLDVLFNNAGTLNLSIEAVTNGYDMAFHTNVLGPFYFTKLLLPHLLQTARLSDTKDHVRIVNLTSSAHHFAGSPPIDFSSLKDGPGRRKYTDLDHFYAQSKAAMVLFSNELARRYAEKGVISLAVNPGNFATSLTRGIQDYWRNTFSANPEILAVYLSP

SEQ ID NO: 46078 - protein, 488 aa, Listeria monocytogenes EGD-e
MADVRKLKNYIDGEWVESKTDKYEDVINPATGEVLCQVPISTRAELDQAAVIAEQAFEKWSQVAVPRRARVLFGFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLEALRTAAQNVKIGNGLDDGVFLGPVIREENQKRTIAYIEKGIEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 46079 - protein, 156 aa, Glycine max
  misc_feature (34)..(34): Xaa can be any naturally occurring amino acid
  misc_feature (111)..(111): Xaa can be any naturally occurring amino acid
MVMEKKMKVRSEREKTKVVIRHLSPSLTLSDFFXHIDSHFASRYNWFSFRPGNNSHKRQMHSRAYIDFKCPDDVFEFTEFFDGHVFVNERGAQYKVIVEYAPSQRVPKPSXQKDGREGTIFKDPDYLEFLKLIAKPQEHLPSAEIQLERKEAEQAG

SEQ ID NO: 46080 - protein, 132 aa, Glycine max
  misc_feature (127)..(127): Xaa can be any naturally occurring amino acid
HTVTALLNPKPWLAAWEVAKMEEARVLKNFPVKPKLKSKARTPKQTPESKYWSSFKTQQIPNLISVPSITFSPTPPHSFAAAHSASLTLFSSQTLCPAATISSLGDADACASFRCDARLLAGCDLFXLVQVF

SEQ ID NO: 46081 - protein, 285 aa, Brassica napus
  misc_feature (270)..(270): Xaa can be any naturally occurring amino acid
CRPRVRSDQDLARGVETLLRQSDPTSLTSLTSVVHQLEAKLGLDLSDKTNFIRDHINLLLHSPPPPASASSSTPHPPPPQYLQQLHSGVNVPAKGHFSLHPPSHFALHPSPYHSYDLNFQQPYPPYMPPQHHQRQGPSVSQSPKASAPAGTKRKGGPGGLNKVCRVSPELQVVVGEPALPRTEIVRQLWAYIRKNNLQDPSNKRKIICDDALRLVFETDCTDMFKMNKLLSKHILPLDPSKDSGQAKRAKAEVETKTETETKEPVSSTSXTVSLSEPLAKFFGTG

SEQ ID NO: 46082 - protein, 500 aa, Nostoc punctiforme PCC 73102
MLKKLFSFSDRYRILHQTWFAFFLTFVCWFNFAPFATTIGKELHLAPEQIKTLGICNLALTIPARLIIGMLLDRFGPRITYSILLMFAVVPCLATALAQDFNQLVISRLLMGIVGSGFVVGIRMVAEWFQPKEMGIAQGIYGGWGNFGAFGAEFALPILAISTSFFSGGASNWRLAIALVGIITAIYGVIYYNTVQDTPRGKVYKKPKKNGSLEVTSIKSFWAMMISNFGLIFALGLLAWRLEQKKIHFLTLSQMYLTWLVLAGLFAYQSYKAWQVNRELLTGKKTYPVSERFQFGQVALLEFTYITNFGSELAAVSMLPAFFEKTFGLEHVVAGMIAATYPFLNLVSRPSGGLISDKFGSRKWTMTIISVGIGVSYLMAHFINSNWPIPVAIAVTMFAAYFAQAGCGATYSIVPMIKKEATGQIAGNVGAYGNFGGVVYLTIFSLTDAPTLFSTMGIAALICAFMCAFFLKEPKGSFAPAYEGEASETATKSSVFLTEE

SEQ ID NO: 46083 - protein, 492 aa, Acidovorax sp. JS42
MGKTTGFMEYERIEEGYKPVGERLKHYKEFVIGLDDAQAKLQSARCMDCGTPFCHNGCPVNNIIPDFNDLVYHQDWKSAIAVLHSTNNFPEFTGRICPAPCEAACTLNINDDAVGIKSIEHAIIDRAWEHGWVQPQPAARKTGKKVAVVGAGPAGLAAAQQLARAGHDVTLFEKNDRVGGLLRYGIPDFKLDKAHIDRRVEQLVAEGVTIRTGVFIGAAKDGLGKGSKVTNWSKETITPEQLRKDFDAVLLTGGAEQSRDLPVPGRELDGIHFAMEFLPQQNKVNAGDKLKGQIRADGKHVIVIGGGDTGSDCVGTSNRHGAASVTQFELMPMPPSQENKPLVWPYWPYKLRTSSSHEEGCERAFAIATKEFIGDGKKVTGLKTVQVEFKDGKFIEVPGTEKEYQADLVLLAMGFVSPVAAVLDAFGVDKDARGNAQATTDFTGGYATSAPKVFAAGDMRRGQSLVVWAIREGRQAARAVDEFLMGESSLPR

SEQ ID NO: 46084 - protein, 736 aa, Cryphonectria parasitica
MAAAAPQEQQQQQQKEEDGELPPPSEAITQAGGGVSGAGPARSITTVSAAVLPYLEKIFNCHADTSQAWHRGQAETFIRCTQAGDPNGSAEGLPADLATKDELDFNDFLRYMTSDATSAVTPLNAQTGGDLSYPLSSYFISSSHNTYLTGNQLSSDASTDAYKNVLLRGCRCIEIDVWDGDESDSEASGYSSSDLEDHDPKKAAAARAKRKAKVDKAKAKIPKSVLQKLEQTSLGKKLEKYVEKKTEPKAPASPSTSSAAAAAAAPAPAPAAKDDSKVKVASQASSSPAPPLVEKLPALAAAVIEPRVLHGYTLTKEVSFREVCLAIKEYAFAVTDLPLIVSLEVHAGPEQQEIMVKIMNETWAGLLLDPPEKEADVLPSPSDLRRKILVKVKYAPPGQEVSAAAASDEDVSTPGQVAAPGSPEAKKKKKPSKIIHALSALGIYTKAVSFKSLHQPEATMPSHVFSLGEKSVREVHEKQGQDLFEHNRKYLMRAYPSGFRVGSSNLDPTPFWRKGIQIAALNWQHWDEGMMLNEGMFAGSGGYVLKPPGYRHDKPNAPAETAHVQHRTLDLEIKVLAAQNLPLPPETSVKSFNPYVKVELHVEAGGERHGHFPADGHECDLATAAAAKAAAARRSEDDEEVEGEYKARTKTAKATCDPDYKGEILEFKAIPGVVEELSFVRFIVRDDVKFRRDDLAAWACVRLDRLRMGYRFVRLMDAKGKESEGAILVKVMKKVY

SEQ ID NO: 46085 - protein, 276 aa, Triticum aestivum
MRPSRDLRLAVLLLLFSASVLLPAARAQQETEEEEEFSYSLDAENGPAHWGDIKEEWSACGKGNMQSPIDLASPRVSLVRGLGYLNHSYSPANATIVNRGHDIMLKFEGDAGSVSIGGTPYFLRQLHWHSPTEHSVNGRRYDMELHMFHESAQGKAAVIGVFYEIGAHDAFLHKLEPYLEMIADRKDREEKMGMMDPRGARGKASVYYRYVGSLTTPPCSEGVIWTIVKRVRTVSRHQLELLREAVHDDMEKNARPRQEVNSRDISMFRPFEQNRH

SEQ ID NO: 46086 - protein, 161 aa, Escherichia coli
LEMRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGRGEGIACEAVALLIKATK

SEQ ID NO: 46087 - protein, 255 aa, Agrobacterium tumefaciens
MEEIARKAGDLALAHFRSLSSLSVETKGHLDLVTKADKEVETFLIAQLREAFPADGIFGEEGGEIKGRSGRIWVIDPIDGTFNFVRGGQNWAISIGLYENKRPTFGVIFAPVRNLMFVGGKTVETKLNGMAVKPLPPLDMSRASTGFSYHPSASTADRLEVIRYISDDLNISFRFCGAATLSMVEVAMGETDGYVSLGDSTWDVMAALPILSNLGVADTIDWDRTDLSAKLRFACGSHDFLEKVKPLLDKVALAA

SEQ ID NO: 46088 - protein, 372 aa, Synechococcus elongatus PCC 6301
MDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAAGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 46089 - protein, 573 aa, Pseudomonas syringae pv. tomato str. DC3000
MRRRKRRLEKMTTTSRPLYISYAGPSLLEMPLLNKGSAFTPQERIEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMGNLLDFQLRLAQKSADVAGWTAGTETFPQLLDVVTHAGATVLIGVSGQRGLFTEQVVRELYKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLAAIERNFWLPGYRAYRRRSV

SEQ ID NO: 46090 - protein, 328 aa, Campylobacter jejuni RM1221
MKILISGGAGYIGSHTLRQFLKTDHEICVLDNLSKGSKIAIEDLQKIRAFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAGKRDKLFIFGDDYDTKDGTCIRDFIHVDDISSAHLATLDYLQENESNVFNVGYGHGFSVKEVIEAMKKVSGVDFKVELAPRRAGDPSVLISDASKIRNLTSWQPKYDDLELICKSAFDWEKQC

SEQ ID NO: 46091 - protein, 275 aa, Yersinia pestis CO92
MSTAYSEAYQQRFGGIARLYGQQALALFSQAHVCVIGIGGVGSWAAEALARTGIGAITLIDMDDVCVTNTNRQIHALRHNIGQAKTEVMAERILAINPECHVTCIDDFITADNVAELLNKNFSYVIDAIDSVRPKAALLSYCRRYKIPVVTTGGAGGQIDPTRIAVVDLAKTIQDPLAAKLRERLKSDFNVVKNSKGKLGIDCVFSSEPLVYPQADGSVCASRSTAEGPKKMDCTSGFGSATMVTATFGFVAVSHVLKKMMAKAARQHESAATAS

SEQ ID NO: 46092 - protein, 439 aa, Yersinia pestis CO92
MRPSLMCITSICITSLLKHATMIKAKKFRGHSQDANNSMKVFNPMDFRREFPALSDKLTYLDSAATALKPRAMIDATQQFYQQDSATVHRSQHQSALSLTVRFENTRQQVADFINSSTAENIIWTRGTTEAINLIAQSYARPRLQPEDEIIVSEAEHHANLIPWLMVAEQTGAKIVKLPLGLDHLPDLQQLPQLLNEKTRILALGQMSNVTGGSPDLAQAIRLAHQYDCVVVVDGAQGIVHYPADVQALDIDFYAFSSHKLYGPTGIGVLYGKTELLEEMPAWQGGGKMLTHASFGGFTPHEVPYRFEAGTPNIAGVIGLSAVLKWLEHIDLEEAEVYSQGLATMAENKLAQLPGFHSYRCQQSSLLAFTFDGVHHSDLVALLAEQGIALRAGQHCAQPLMAALGVNGSLRASFAPYNTPQDVEMLCSALGKALELLRD

SEQ ID NO: 46093 - protein, 325 aa, Listeria monocytogenes EGD-e
MNLKKHSERKFDLITVGRACIDLNAVEYNRPMEETMTFSKYVGGSPANIAIGTAKLGLKVGFIGKISDDQHGRFIEKYMRDLAINTDGMVKDTEGRKVGLAFTEIKSPDECSILMYRENVADLYLTPEEISEDYIKEARVLLISGTALAQSPSREAVLKAVSLARKNDVVVAFELDYRPYTWKNSEETAVYYSLVAEQADVIIGTRDEFDMMENQVGGKNEATKAYLFQHQAKIVVIKHGVEGSFAYTKAGETFQAQAYKTKVLKTFGAGDSYASAFLYGLFSDESIETALKYGSAAASIVVSKHSSSDAMPTADEIKALIAQAE

SEQ ID NO: 46094 - protein, 187 aa, Methanopyrus kandleri AV19
MLLEKSLEEAPVVNRNGYWYFIHPITDGVPELPPELLREVAYRIVRALDSTDFDKIVCVEAMGIHLGALLSDMLDRPLVIVRKREYGLDGEVEITQEKGYGVEKLYLNGVSEGDRVVVVDDVISTGGTLVGLINALDDVGAEIEDVVVVVARGGLDRVREETGVDVKYLVRVEVSEDGVSVVESRYR

SEQ ID NO: 46095 - protein, 334 aa, Chlamydia trachomatis D/UW-3/CX
MKETIAYLGMGMWGFSLANLLANNGHRVVGWARNPALIEQLSVQRRHPAAPHISIPQNLSFTSHMEEALDGATMIVEGVTSAGMRPVLTQLKALTELRVPLVITSKGIEQNTGLLLSEIALEIFGRPAAQHLGYLSGPSIASEVLRGCPCSVVISAYNPDTLKQIHRAFLTPTFRVYPNSDLKGVALGGALKNVIAIACGISDGFRFGDNAKSGLVTRGLHEIRKFATIMGCRPDTLNGLAGLGDLCTTSFSAFSRNTLFGKLLAEGLTPEQAKTKIGMVVEGVYTALSAHQIATHHRIDMPITTSVYRVLYENLDIQEGIAQLLQRDTKEEYL

SEQ ID NO: 46096 - protein, 464 aa, Neptuniibacter caesariensis
MVYGVLTFSPKRCIIARLFLLALANFEISLGNGVGFLAAKMALLALGINHKTASVEVRERVAFAPELLAEAMLAARETAGLQEIAILSTCNRTEVYCSSELQGSRALLEWLGGYHGLDPDELQQSSYAFWDEDAAKHMMRVASGLDSLVLGEPQILGQLKSAYSLSQDNGLVGAELGRLFQQTFSVAKQVRTDTAIGENPVSVAYAAVSLAQHIFSDMSRSKALLIGAGETIELVARHLGNAGVKDITVANRTLSRALSLAEEFSGKAILLGDIPEALADADIVIASTASQLPILGKGAVETALKKRKHRPIFMVDIAVPRDIEAQVAELDDVYLYTVDDLKEVIEENQRSRENAARQAESIIENGAHEFMRQLRTLDAVDLLTVFRGKAEALRDQELEKAFKQLNAGKPAEEVLNMLAKSLTNKMLHHPTIQMRKASAEGRTDMLDLVQELHQLGDYSKNDGK

SEQ ID NO: 46097 - protein, 380 aa, Zea mays
MGVDEAGRAAGRNLTLASIGFADVRVGAAVPGGAGYKDGLLVVGLPVPKDDGLDAAARVVRDLATRLPDVGAAARTFLRNREVAEFVSGALAGAMTKAVLAPLETIRTRMVVGVGSKHIFGSFVEIVEHNGWQGLWAGNTINMLRIIPTQAIELGTFECVKRSMASAQEKWKEEGCPKIQLGDLKIQLPFHLLSPIAIGGAAAGIASTLVCHPLEVLKDRMTVNREAYPSIAIAFSKIYRTDGIGGLYAGLCPTLVGMLPYSTCYYFMYETIKTNYCRAHKKKSLSRPELLVIGALSGLTASTISFPLEVARKRLMVGSLQGKCPPHMIAALAEVIQEEGAKGLFRGWAASSLKVMPTSGVTWMFYEAWKDLLLSSRLHA

SEQ ID NO: 46098 - protein, 523 aa, Cryptococcus neoformans var. neoformans JEC21
MEFLPLRTLPAPPRQQSTTNPHSRHFHSFRHPLFIKHPAAITHIHFCPTKPHRYAVTSSTRVLIYAPKTGKVVKTITRFKDTARSGEFRKDGKLVVAGGDDGVVQVFDVNSRAILRTMKEHNQPVRVTHFSPHLPQVLSASDDTTVKLWDLSTQACLSTFSSHTDYVRSSIFSPSDPSLILSASYDSTIRLHDVRLPEDEANVITMRHGGAPVEDILAFPSGGVAVSVGGPILRVWDLAMAGKCVRALSNHQKTVTSVAFDGTKGRVLTGGLDNMVKVYDVEDWKVVHTMRYPAPVLSLAVSPDDTHIAAGMTDGTLSVRRRDPKASELGASSAQETAIKGGAYEYFADMEAIFGTGHIKAKGKDLGPVVGPADEFRVETRRQKRLRDFDKYLKSFKYSAALDAGLHKNVKPTTTFALIQELVHRDALRIALSGRDDVTLEPILNFLAKNVTDPRFGEMAAQVVGVIIDIYTPILGQSPILDEMLGKIQTRVERELSFQRELMKLRGALDMTLSQAALGRVEA

SEQ ID NO: 46099 - protein, 541 aa, Pseudoalteromonas tunicata D2
MPHISIEQRLHNSLLDAAQDLQKLHLVELFQLQPTRAEIYQLNIAPIYLDYSKQRINQQALDSLVELAEHKQLSQARDAMFHGEKINHTEQRAVLHTALRNSQRLSSHAPDIAEEINQTKQRMLSFVDKILNQTLRGFTDKPITDVISIGIGGSFFGPKMLQSALVEYQTSNINVHYLANIDGAQIKQLLAKLNPATTLVIVASKSWTTIETQVNANAVMTWFKGKFPEQAAIEKHWVALTAKPELAQAYGIAPEYIFPLWDFVGGRYSVWSAIGLPLALSIGSKAFDELLAGAASMDEHFCQAPLNQNMPVLLALIGYWQQVYLGYNNLMVLPYSHGLKSLPAYLQQLDMESNGKSVNAIGDPIATSGPILWGAEGTNCQHSFMQLLHQGKQQAMIDFIVPAKGETLYPEHHKMMIANCLGQAQALMQGKTEQQAFDELIASNMPTEQAKALAKHKAMPGNTGSNTLVLESLTPYSVGALLALYEHKIFCQGILFGINSFDQWGVELGKQLGNQLMNAITTKNSSQLDPSTQALLKHINL

SEQ ID NO: 46100 - protein, 312 aa, Pseudomonas syringae pv. tomato str. DC3000; identical to SEQ ID NO: 1278

SEQ ID NO: 46101 - protein, 276 aa, Rhodococcus sp. RHA1
MSADLAGKTAFVTGAARGIGRACAVEFAAAGADLMLVDITRNLPGVPYPLGSQSQLDYTAELCREHGATVLTQAVDVRELAEITAAVQVAHERFGRLDVLLNNAGIAAPSGKAAHDIAESEWRLMIDVDLSGAWRTIATAGRIMVTQRSGSIINIASTAGLVGYRHFAGYVAAKHGLVGLTKAVALDYAPSGVRVNALCPGSVRDSSEYEGRMLAEIARSLGVGVDEHESVFVQAQPTNKLVEPGEVAAAARWLASDDARGVTGSVVTVDGGFTAR

SEQ ID NO: 46102 - protein, 431 aa, Pseudoalteromonas tunicata D2
MEQTMLLHNLKDHSEKVSFIQAVKTGLGRDQGVFFPENLTPIADIDALLELDFVTRSSKILSHLIGDELSSEQVAAMVARAFNFDLKLVEVEKNIYCLELYHGPTLAFKDFGGRFMAECLAEFSQGNKTTILTATSGDTGAAVAHAFYKKDNIDVVILYPKGKISLAQQKLFTTLGENIHCYAVDGSFDDCQAMVKAAFLDNEVKQRLGLNSANSINISRLVAQVCYYFEALARLPKAQRAQAHVSVPSGNFGNVCAAMIGAVIGLPAAKLSATTNQNDTVPRFLHNKEWQPAATKESLSNAMDVSRPNNWPRVQYMLDHNWFSYDNFYSHAIDEQTTQAAMHHLNQLGYLAEPHTAIAYEGLKRDLAADGVGVFLATAHPAKFKESVEGILDIKLEMPKPLSDALAKPCLAVDLVNDYHVLREALLVKLG

SEQ ID NO: 46103 - protein, 523 aa, Chlorella sorokiniana
CRPPSSPSLSWPPGLRSPALPRAVACARGRSAKRDVAAKRLRSRSPRMDATTGDFTALQKAVKQMATKAGTEGLVHGIKNPELRQLLTEIFMKDPEQQEFMQAVREVAVSLQPVFEKRPELLPIFKQIVEPERVITFRVSWLDDAGNLQVNRGFRVQYSSAIGPYKGGLRFHPSVNLSIMKFLAFEQIFKNSLTTLPMGGGKGGSDFDPKGKSDAEVMRLWQSFMTELQRHISYVQDVPAGDIGVGAREIGYLFGQYKRITKNYTGVLTGKGQEYGGSEIRPEATGYGAVLFVENVLKDKGESLKGKRCLVSGAGNVAQYCAELLLEKGAIVLSLSDSQGYVYEPNGFTREQLQAVQDMKKKNNSARISEYKSDTAVYVGDRRKPWELDCQVDIAFPCATQNEIDEHDAELLIKHGCQYVVEGANMPSTNEAIHKYNKAGIIYCPGKAANAGGVAVSGLEMTQNRMSLNWTREEVRDKLERIMKDIYDSAMGPSREYNVDLAAGANIAGFTKVADAVKAQGAV

SEQ ID NO: 46104 - protein, 685 aa, Glycine max
MGEVPAVMQATQGEQSNNASAVHWERFLPRMVLRVLLVEADDSTRQIIAALLRKCGYKVVAFCDGLKAWETLKNKAFDLDLILTEVDLPSISGFSLLTLIMEHDICKNIPVIMMSSHDSVSMVFKCMLKGAADFLIKPVRKNELRNLWQHVWRRHAISRPPQNLTLPEIELGFAAENHAASNDSSGSVASTPKDDECSEKTSEAHSTCPSPFLEAESTYMENMQDILQLKSSSNLSNIDTVKHENSTKCERESDKHNDEAGEKSLFILEDARCNKTFKPTGLRLGQSYECHETRNQDEVLRIELIKSNPEINTDIHRCSDELVDPSTGAIDLIATFKNLPKSTDEKCSFSSGNTAKFDFDTQLELSLRRDFPGSSCKAAFKERQILNHSNASAFSRYSNSKLLQPLFPTPSTISAKLTNASQNSHESLKLSKNTSTSHQYSEKSQNQEEKIITSVIGQSGQVDPKLPNSQLGLFPATGVTSDHKSKGNGNVFPSKLYAKSGVHPISTPKSVCQKESSPFPTSTSSQSNPQSHNSERHHWLEDATHASDQNVNDQSNLECETHDSPAASQSAGPSFFHDTANHNSSGVYRSDGNATSAKVAKESHEIFIDSGQRSYDGFIGTDSHRTSQREAALTKFRLKRKDRCYEKKVRYQSRKRLAEQRPRVKGQFVRQVHDDHPVADVGGGS

SEQ ID NO: 46105 - protein, 359 aa, Oryza sativa
  misc_feature (305)..(305): Xaa can be any naturally occurring amino acid
MAASSPASSGKAASDSSAPAVAVANGNGTTPQKLPPASAFDMPKPNLRGLNKPKCIQCGNVARSRCPFQCCKSCCYKAQNPCHIHVLKQNNTLPDKPPLSTAPLSEQPSANIPSTGSSRLASLQRLPHHFLNSLRTKKSLAKKDVMGINKWRFEKLKEHIQGDIDAENEAYERYTQNVGLLEETFGLTEDAADEPEPEATSSEERMETLVSEAKVRLKSDSANADGFRDRIATILDQKIKELLESKSTYEDDNPPDQNPDDHPKPVKLSIKQQMERGAKMTELLAKMIRAQSEVDLKICSGIAAXQLFGKKNELSNQESVASVTIPYSFPKLWTRVEIDDAMMCKINGEFSSSTEVMQL

SEQ ID NO: 46106 - protein, 478 aa, Rhodopseudomonas palustris CGA009
MNAVGKSSNDPRCVPLIMCGGAGTRLWPASREVRPKQFLPLFGPRSTFQETLLRVSDPALFGRPIIITNTAYRFMVRDQLAEIGIEADVLLEPARRDSGPAIVAGAVFAEQREPGAVVLALAADHVVRDKDAFIAACRDGLAGVAEGRIVTFGVKPERPATEYGYISPGDAIVGKVRNVAKFVEKPDLATAEGYVAAGYLWNSGNFMFPAAALLEEYNAVDPDSVATITEAVTTAGRDLGFVTLPEASFGKAKPISIDYAVMEKTKRAAVVPVDCGWSDVGSWRAVWELTAKDGGGNAAQGPAVFEDSRNCHVSSEHTLVALEGVDDLVVVATQDAVLVSRQKDGNGLKRLVAKVKTVAPEVTDHHAQVHRPWGSYRSLDSGDRHQVKRIIVKPGERLSLQKHHHRSEHWIVVRGTAQVTVDELVKIIHENESIYIPIGATHRLENPGKITLELIEVQTGSYLGEDDIIRFDDDYRRS

SEQ ID NO: 46107 - protein, 708 aa, Burkholderia mallei ATCC 23344
MNQQAFPATGTVTRERRDKVLVVTIDHPPVNALSADVRRGLVDALDAADADAAVGAVLIVGAGRNFIAGADIREFGKLPVPPLLPDVCNRIETSGKPVVVALHGAALGGGLEVALAAHYRLAVPGAKLGLPEVQLGLLPGAGGTQRTPRLIGAKAALELMLSGRHASAEEALALGLVDRLAHSDDTLAEGLAYVHELLAAGAGVRRTRDAQGLADRAAAEAALDAARADVARHSRGLFSPARIVDAVAAALAQPFDEGLRTERRLFVECLDSPQRAGLVHAFFAQREAAKSPETRRGAPRAIERIGVVGGGTMGAGIAVAALDAGFPVTMIERDDASLERGRAHVEKVYAGLVAKGRMTPAAQAARLARFKGGTSYEALAQADVVIEAVFEDMAVKKAVFAELARACKPGAVLATNTSYLDIDELAASVERAPDVIGLHFFSPANIMKLLEVVVPAKVSADVVATAFELARKLGKIPVRAGVCDGFIGNRVLAVYRTAADYMMEDGASPYQIDRAIREFGFPMGPYQVVDLAGGDIGWATRKRRAPTRDPRLRYVEIGDRLCERGWFGQKTGRGYYLYPDGARVGTPDPEVEAIIAQARAAKGVSPRAFTDEEIVRRYLAAMINEGANVVHEKIALRPLDVDAVFLHGYGFPRHRDGPMHYADTVGLANVLADIRAFAGEDPVFWKPSPLLVDLVARGETFASLNRID

SEQ ID NO: 46108 - protein, 229 aa, Glycine max
  misc_feature (10)..(10): Xaa can be any naturally occurring amino acid
GTMADDEMRXLNVPALQTDGLIFLWVTGRAMELGRECLELWGYKRVEEIIWVKTNQLQRIIRTGRTGHWLNHSKEHCLVGIKGDPEVNRNIDTDVIVAEVRETSRKPDEMYPMLERISPGTRKLELFARMHNTHAGWMSLGNQLSGVRLVDEGLRARFKAAYPDVEVQPASPPRAFAMEVDTSVAAHSGRPFSATESKSTSTQFAEPAAAPETAFVSEDKPLAIDVDIG

SEQ ID NO: 46109 - protein, 334 aa, Zea mays
MGSVASAAVPPPPPQSALPQAGAPPYGPGLAGILPQMSKGEEKKDEKVDYLNLPCPVPFEEIQREALMSLKPELFEGLRFDFTKGLNQKFSLSHSIFMGSLEVPAQASETIKVPTAHYEFGANFLDPKLMLIGRVMTDGRLNARVKCDLTDNLTLKVNAQLTQEAHYSQGMFNFDYKGSDYRAQFQIGNNAFYGANYIQSVTPNLSMGTEMFWLGHQRKSGIGFACRYNTDKMVGTLQVASTGIVALSYVQKISEKVSLASDFMYNHMSRDVTSSFGYDYLLRQCRLRGKIDSNGVVAAYLEERLNMGVNFLLSAEIDHCKKNYKFGFGMTVGE

SEQ ID NO: 46110 - protein, 305 aa, Bacillus thuringiensis serovar konkukian str. 97-27
MKLCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGTGKKVLCVAPDTGERYLSMGLFE

SEQ ID NO: 46111 - protein, 434 aa, Chlamydia trachomatis D/UW-3/CX
MTHLQEETLLIHQWRPYRECGILSRISGSLLEAQGLSACLGELCQISLSRSDPILAEVIGIHNRTTLLLALTPIYYLAIGAEVVPLRRPASLPLSNHLLGRVLDGFGNPLDGGPQLPKTNLSPLFSSPPSPMSRTPIQEVFPTGIRAIDALLTIGEGQRVGIFSEPGGGKSSLLSTIAKGSQQTINVIALIGERGREVRDYVNQHKEGLAAQRTVIIASTAYETAASKVIAGRAAITIAEYFRDQGARVLFTMDSLSRWIESLQEVAIARGETLSTHHYAASVFHHVAEFLERAGNNDKGSITSFYAILHYANHPDIFTDYVKSLLDGHFFLSPQEKSFSSPPINVLTSLSRSSRQLALPHHYAAAQELLSLLKAYHEAIDIIQLGAYVSGQDAHLDRAIRLLPSVKQFLSQPYSHYSAIHETIEQLCQLLKHE

SEQ ID NO: 46112 - protein, 76 aa, Methylococcus capsulatus str. Bath
MSDIAERVKKIVAEQLGVKDEISNEASFVDDLGADSLDTVELVMALEEEFECEIPDEDAEKITTVQQAIDYIQSHT

SEQ ID NO: 46113 - protein, 332 aa, Neptuniibacter caesariensis
MNGSRSTDSEQITIEKVHAVSKMMVFTGNANPDLARKVVDRLDIPMGKANVGRFSDGEVSVEIQENVRGKDVFIIQSTCAPTNDNLMELIVLADALRRASASRITAVVPYFGYARQDRRPRSARVPITAKVVADMMTAIGIDRVLTVDLHADQIQGFFSVPVDNVYGSPVLLDDIADQEYENTMIVSPDVGGVVRARAVAKQLDCDLAIIDKRRERANESDVMNIIGDVEGRTCVLVDDMCDTAGTLCKAAKALKAQGAERVVAYATHAVLSGPAITNITNSDLDEFVVTDTIPLSESAQACSKIRQLTLAPLLAEAVRRVCNEESISAMFR

SEQ ID NO: 46114 - protein, 367 aa, Corynebacterium glutamicum ATCC 13032
MTSRTPLVSVLPDFPWDSLASAKAKAASHPDGIVNLSVGTPVDPVAPSIQIALAEAAGFSGYPQTIGTPELRAAIRGALERRYNMTKLVDASLLPVVGTKEAIALLPFALGISGTVVIPEIAYPTYEVAVVAAGCTVLRSDSLFKLGPQIPSMMFINSPSNPTGKVLGIPHLRKVVKWAQENNVILAADECYLGLGWDDENPPISILDPRVCDGDHTNLIAIHSLSKTSNLASYRAGYLVGDPALIGELTEVRKNLGLMVPFPIQQAMIAALNDDDQEAGQKLTYAIRRAKLMRALLESGFQVDNSEAGLYLWATREEPCRDTVDWFAERGILVAPGDFYGPRGAQHVRVAMTETDERVDAFVSRLS

SEQ ID NO: 46115 - protein, 169 aa, Triticum aestivum
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEGAMENPKGPSRCSTCRKRVGLTGFNCRCGNLYCATHRYSDKHECKFDYRAAAMDAIAKANPVVKAEKLDKI

SEQ ID NO: 46116 - protein, 650 aa, Vitis vinifera
MEEESGGGPRVVAISLIEKATNSTASEVDPRLLKSIKSVVRSSDSELRIAAQTLMDLMKRDHAQVRYLALLIIDELFMRSKLFRTLLVVNLDQLLSLSVGFRRNQPLPAPAAVASILRSKAIEFLEKWNTSFGIHYRQLRLGFDYLKNTLRFQFPNLQANAARIQQERKEREMRSKEILLKKFETLKEKFSSIKEEIQLTMDEIRECLDIVRPKDESVPLDFIEDDEMEEFCSSELRQIRLDSLKEAEKVHENSDNKVVFDALRELYKLLVTRHLVSAQEWISVLIRVEVADNRSRDSMLKEFIDIRNHIQSVKKKCEESGCVLANTMNDEEEDFWEEGKIELSESDSFTAANKQSKDLAKASTSSKAKSEAPECSNKESNGNKRSGRESIESDSTSLRSKLLAEAPLMNWGSFLDNWGSKQDVLANQRGLELEGHWGRVDYDAVIPAEKIAELNIQTTVYKEERVDIQPCRAPLSKGGLCQRQDLRVCPFHGPIIPRDDEGKPIHENSSTEEITLDLGSDLVEQLAKQAVKNVRDRDKEETKKREYDKQALKRAKLAKVREHNEAVLREAAMASTSRSEAFGEDLGATNMDKPLARNKKQTLASMLRKKITTKDRLGQKLLNTRVRDETMRQLTLGEDANYREAFPNQW

SEQ ID NO: 46117 - protein, 226 aa, Chlamydia trachomatis D/UW-3/CX
MTLLILLRHGQSVWNQKNLFTGWVDIPLSQQGIQEAIAAGESIKHLPIDCIFTSTLVRSLITALLAMTNHSSQKVPYIVHEERPDMSRIHSQKEMEQMIPLFQSSALNERMYGELQGKNKQEVAAQFGEEQVKLWRRSYRIAPPQGESLFDTGQRTLPYFQERIFPLLQQGKNIFISAHGNSLRSLIMDLEKLSEEQVLSLELPTGQPIVYEWTGQKFTKHAPSLG

SEQ ID NO: 46118 - protein, 266 aa, Listeria monocytogenes EGD-e
MNRIGFIGAGNMGTAMIRGLAQANLVKREEIIVGGRNLEKLKPLEAEFTGLQITTDTEKLVEQADIIILAVKPYTIPEILTSVKEKLTPDKIIISVAAGVTIQDLEELTSAKTKIVRVMPNTPALVGEAMSSVSPNTNVTSEELKEVTAIFTSFGEAEVVSENLMDAVIGVSGSSPAYVYMFIEALADGAVLSGMPRDKAYKFAAQAVLGAAKTVLETGEHPGKLKDMVTSPGGTTIEAVKSLENDGFRSAVINAVQAAAKKNSSM

SEQ ID NO: 46119 - protein, 319 aa, Bradyrhizobium sp. ORS278
MRHRPVTGSGAETPAPAGERWGLDRLVAELRVSREETHSIRKDGTIHRPPSREKLAQVVAALTEALFPRHYGQYDLDSENIDYFVGHRLSIGLDLLSDQIHRAALFVGDELIPGFRQPDAVELTHSFAKGLPGLRGILISDLRAAFVGDPAAKSFPEILIGYPGMTAIIHHRLAHLLYGHGARLVSRLIAEIAHARTGIDIHPGAQIGSGFFIDHGTGVVIGETAVIGDNVRIYQAVTLGARHFPTEEDGTLIKGDARHPIVEDDVVIYAGATILGRITIGQGSTIGGNVWLTHDVPPNSIVTQATLRNKVGGPNLQKS

SEQ ID NO: 46120 - protein, 162 aa, Brassica rapa
MVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 46121 - protein, 884 aa, Oryza sativa
MGFLNLVGNSFGCSASGERLVSAARDGDLQEARALLEYNPRLAWYSTFGGRNSPLHYTAAQGHHERYSYSRFASTSVVKQSSGGLFSWLLGEKSSQLPPLDVPLPGITLPPPLPDFVEPSKTKVTTLPNGIKIASETSVSPAASVGLYIDCGSIYETPASSGASHLLERMAFKSTTNRSHLRLVREVEAIGGNVSASASREQMCYTYDAFKAYVPEMVEVLIDSVRNPAFFNWEIKEQLEKIKAEIAEVSDNPQGLLLEALHSAGYSGALAKPLMAPQSAIHRLDSSILEEFIAENYTAPRMVLAASGVEHDELVSIAEPLLSDLPSVKRPEEPKSVYVGGDYRCQADSDKTHIALAFEVPGGWFEEKTAIIVTVLQMLMGGGGSFSAGGPGKGMHSRLYLRILNNYHQIESFSAFNSIYNHSGLFGIHATTSPNFASKAVDLAAGELLEVATPGKVTQEQLDRAKQATKSAVLMNLESRVVASEDIGRQILTYGERKPIEHFLKDLEAITLNDISSTAKKIISSPLTLASWGDECFLAVIHVPSYESVSQKFFSNTAELLRMCRDFKSMHAEIVLMIFPFMRRQKATAAVALSRAGGGSGGVQGGDRALQGGWGKRRLPGRAGEAVAVTAPSRSGGGSGGGGGGALQGGRGKRQRRRSPLGQVGKAAGATAAVADAVAVFFPLVGKLTDARALSAAERHDVPAFLRLVPSLEAPELPAPLLAVQVTRFVGGGDGGGVAVQHAVPDGQSFWRFMDAWSAPALGRPSAPAPVFDRSAIVHPMAAAMAQRILRKVTPELPLLLTANLLRRTWQHHDTTTLELERHRIADIKNLIVELDEATTSPGRVRGAAAAAAATDRRRPPDSPSHPRPPSARATKPCPQLLAH

SEQ ID NO: 46122 - protein, 495 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSTDYKGQDFELLPFGAGRRGCPGIALGVASMELALSNLLYAFDWELPYGVKKEDIDTNVRPGIAMHKKNELCLVPKNYL

SEQ ID NO: 46123 - protein, 489 aa, Persea americana
MEWPKSNDHSLLSKMATNDGHGEKSRIFDGWKAYDNDPYHPTTNPQGVIQMGLAENQLCFDLIEEWIKKNPKWSICTAEGASEFKDIALYQDYHGLPAFRSAIAKFMEKVRGGRAKFNPDRIVMSGGATGAHELVAFCLADPGDAFLVPTPYYPGFDRDLRWRTGVQLVPVVCYGKNDFKITRVALEEAYKKAQEDNIRVKGVIITNPSNPLGTVLDRETLRSIAKFVNEKNIHLVCDEIFAATVFNQPDFIGISEILEEEEEEDVQYNLDLFHVVYSLSKDLGFPGFRVGVVYSYNDDVMNCGRKMSSFGLVSTQTQYLIAGMLSDEVFVENFLAESHRRLAARHKFFTKDLDEVGIGCLNSNAGLYCWVDLRRLLKEATVAGEIALWRTIINEVKLNVSPGSSCHSSEPGWFRVCFANMDDETMKEAIKRIRKFVFENRLVGVASGKGPAVAAKSLGCASKLLRDLKIPYPRQCIMSPQSPLVQATT

SEQ ID NO: 46124 - protein, 495 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFAPYNDYWREMRKICVLHLFSLKKVQLFSPIREDEVFRMIKKISKQASTSQIINLSNLMISLTSTIICRVAFGVRFEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKNYL

SEQ ID NO: 46125 - protein, 269 aa, Myxococcus xanthus DK 1622
MLRLRRMLILILATFGSLYLVLCVVVFALQRSLLYPAPKGTPPLAESDGFSRLPLEGGLYVDLFHLPAPPGAPTVVHFHGNGEEVLTQMGLGSLMQARGLGFLTVEYPGYGASPGHPTEEGIYAAAEAALAWLRAKGVSAEQTVLSGRSLGTGVAVEMARRGHGSRVMLVSPYTSIPDIGATAFPFLPVRLLARDRYDTASKAAAVKLPVLIIHGEEDTLIPVDMGRRLGTLFPQAVVETVAGAGHNDVLEDPGKVYRHRMASFALGEP

SEQ ID NO: 46126 - protein, 299 aa, Klebsiella pneumoniae subsp. pneumoniae MGH 78578
MVARVDRFPVPGESLVACGSMTSAGGKGANQATAALKAGANVHYIGKIGNDTFGHFARRHLKGVGFNAVTLLVAEEIPTGNALIYVAGNDAENMIAVDPGANMTVTDDEIAGCIPAIGCADVVLVQLENNLSAIEQVIDAGKQAGALVILNPAPWQPVEHAVLSKVDLLTPNATEAGLMTGRRVDSLTAAAEAADVLHAQGARNVIITLGASGALLSEHGVKSRVPCFPSHPRDTTGAGDAFNGALAARLACGEPLQAAARFAAAYAAVSVEKQGASSLPEYLEAQERLLRAAADYEMA

SEQ ID NO: 46127 - protein, 218 aa, Klebsiella pneumoniae subsp. pneumoniae MGH 78578
MDMMKLTEQLRFLNSKADRLHVDIMDGHYVKNLALSASFVAQIRPYTSLPIDVHLMVEAPASFIPALLDAGADAFSLHPETICREAFRVINMLRQAGKEVGMVLNPATPVESIQHYLHLLDKVTVMTVDPGYAGQPFIPEMLAKITQLHQLKETGSLRFLLEVDGSCNRNTYRALLGAGAQILVMGSSGLFRADMPLELAWETMSRELSAALHSPELV

SEQ ID NO: 46128 - protein, 483 aa, Persea americana
MGFLRNQQLLSKMATGNGHGENSPFEGWKAYDSNPYHAIKNPDGVIQMGLAENQLSFDLVEDWIKENPESSICTLKGVSQFKDIALFQDYHGLSAFRNAVANFMGKVRGGKVKFNPDRIVMSGGATGAHETMAFCLANPGDAFLVPTPYYAGFDRDLRWRTGVQLIPVVCESSNGFKVTRDALEIAYKKAQEDNIKVKGVLITNPSNPLGTILDRETLKSIVSFINEQNIHLICDEIYAATVFSQPDFISISEILEEGITCNLDLIHVVYSLSKDLGFPGFRVGVIYSYNDDVVNCAREMSSLGLVSTQTQHLLSAMLSDEQFVDKLISESAERLASRHKMFTIELGKVGISCLKSNAGLFCWMDLRALLEKKTVEGEMALWRTIIEKVKLNVSPGSSFHCSEPGWFRVCFANMDDETMKVALDRIIDFVFKPNKKEIMAPKKVQQKWQANLHLRLSLCGRRHEEVTKTPCTMSPHSPLVRAT

SEQ ID NO: 46129 - protein, 278 aa, Lactobacillus johnsonii NCC 533
MKRSERLVDMVKYLLARPHTLIALPFFADRYGAAKSSISEDLAILRQTLANDQNGILETVAGAAGGVRYIPFVGKKEATDYLHDLADRIEDPDRILPGNFVYLSDILGSPQDLRQIGQLIATKYAYSNIDYVMTIETKGIALAQAVSRFLNVPFVMVRRRPKITEGSTISVNYVASSSERVEKMELAKRLLPEGSNVLIVDDFMKGGGTLTGMEELVKEFKGTVAGMCVLCETKYASQKVVDDYQSLIKITEVDRDKKLIKVRPGNFLEQTDFNRFPK

SEQ ID NO: 46130 - protein, 323 aa, Lactobacillus johnsonii NCC 533
MSQLDKEIKIFALNSNKPLAEKIADKVGVKLGKSDVKRFSDGEIQINIDESVRGKDVYLVQSTSAPVNDNLMELLIMIDAVKRASARSVNLVMPYYGYARQDRKTRAREPITAKLVADMLQKAGADRVLSLDLHAPQIQGFFDIPVDNLMGAPLLADYFLGHDLEKDAVVVSPDHGGVTRARKLAEFLKTPIAIVDKRRPKANVAEVMNIIGDVKGKRAIIIDDMIDTAGTITLASQALMDAGATEVYASATHAVLSGPAIERLNNSPIKKLILTDSINQPEEKDLSKAEIVSVGPLMGEAIKLIQEHKPVSPLFNTRFQSHN

SEQ ID NO: 46131 - protein, 472 aa, Vitis vinifera
MWPIALCIGTFVIIRIIHWGYSWRNPKCNGKLPPGSMGLPLLGETLQFFAPNTSSDIPPFIKERMERYGPIFRTNLVGRPVVVSTDPDLNYFIFQQEGQLFQSWYPDTFTEIFGRQNVGSLHGFMYKYLKNMVLNLFGPESLKKMLPEVEHATCRNLDRWSCQDTVELKEATARMIFDLTAKKLISYEQDKSSENLRENFVAFIQGLISFPLDIPGTAYHKCLQGRKKAMSMLKNMLKERRAMPRKKQSDFFDYVIEELKKEGTILTEAIALDLMFVLLFASFETTSLAITLATKFLSDHPLVLKKLTEEHEAILEKREIVDSELTWKEYKSMTFTFQFINETVRLANIVPGIFRKALREIQFKGYTIPAGWAIMVCPPAVHLNPAKYEDPLAFNPWRWEGVESSGASKHFMAFGGGMRFCVGTDFTKMQMAVFLHCLVTKYRWQTVRGGDIVRTPGLQFPNGFHVQILGKN

SEQ ID NO: 46132 - protein, 511 aa, Salmonella enterica subsp. enterica serovar Typhi str. Ty2
MSLSKDNIWKLLAPLVVMGVMLLIPVPDGMPPQAWHYFAVFVAMIVGMILEPIPATAISFIAVTICVIGSNYLLFDASELADPAFKASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVPWKDITRYNSAWNTLVNLATLVVMANGLTRSGFIDWFANTMSTHLEGFSPDATVIVLVLVLVLVLVLVLVLVLVLVLVLVLVLVFYFAHYLFASLSAHTATMLPVILAVGKGIPGVPMEQLCILLVLSIGIMGCLTPYATGPGVIIYGCGYVKSRDYWRLGAIFGVIYIAMLLLVGWPILAMWN

SEQ ID NO: 46133 - protein, 341 aa, Xanthomonas campestris pv. campestris str. ATCC 33913
MSDPTQKIAVLGAGSWGTALAALVARHGHPTVLWGRDAAMVDAIDRTHENPRYLPGIALPDSLRATTDLQQTIAGASWILVVVPSHAFTETIKLLAPLRPAGAGIAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLSDAIREIGQVVESVQTADEVMRQAEQHGIELPISNAVRAVLHGEITPEAGLKELLARERKPEYPQTLFT

SEQ ID NO: 46134 - protein, 478 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATTLLAKAKARGVSLLLPTDVVIADKFAPDANSKIVPASAIPDGWMGLDIGPDSVKTFNEALDTTQTVIWNGPMGVFEFEKFAKGTEAVANKLAELSKKGVTTIIGGGDSVAAVEKVGVAGVMSHISTGGGASLELLEGKVLPGVVALDEATPVTV

SEQ ID NO: 46135 - protein, 406 aa, Bordetella bronchiseptica RB50
MAITDVLVPQLSESVSEATLLTWKKQAGAAVEADEILIEIETDKVVLEVPAPSSGVLSEIVMGDGSTVTSGEVIARIDTAAKAAAAPAAAAEAPAAAAAAAPAAAAPAAASSTASGVASPAAAKILAEKGVDAASVAGTGRDGRVTKGDALAAGNAPAAKAAAPVAPPTLSLDGRPEQRVPMSRLRARIAERLLQSQAENAILTTFNEVNMQAVMDLRARYKDKFEKEHGVKLGFMSFFVKAAVAALKKYPVLNASVDGKDIIYHGYFDIGIAVGTPRGLVVPILRNADQLTIAEIEKTIADFGKRAADGKLGIEEMTGGTFSISNGGVFGSMLSTPIINPPQAAILGIHATKERPVVENGQIVIRPINYLAMSYDHRIIDGREAVLGLVAMKEALEDPQRLLLDL

SEQ ID NO: 46136 - protein, 449 aa, Arabidopsis thaliana
MVRGLMKFPGISTKLLNISVNSLCKFRNLERAETLLIDGIRLGVLPDVITYNTLIKGYTRFIGIDEAYAVTRRMREAGIEPDVTTYNSLISGAAKNLMLNRVLQLFDEMLHSGRHGEAFKILHEDIHLAGLVPGIDTYNILLDALCKSGHTDNAIELFKHLKSRVKPELMTYNILINGLCKSRRVGSVDWMMRELKKSGYTPNAVTYTTMLKMYFKTKRIEKGLQLFLKMKKEGYTFDGFANCAVVSALIKTGRAEEAYECMHELVRSGTRSQDIVSYNTLLNLYFKDGNLDAVDDLLEEIEMKGLKPDDYTHTIIVNGLLNIGNTGGAEKHLACIGEMGMQPSVVTCNCLIDGLCKAGHVDRAMRLFASMEVRDEFTYTSVVHNLCKDGRLVCASKLLLSCYNKGMKIPSSARRAVLSGIRETVSYQAARKTHIKIKAAIECNTLMYP

SEQ ID NO: 46137 - protein, 263 aa, Yersinia pestis CO92
MAISIKTPEDIQKMRVAGRLAAEVLEIIEPYVKPGVTTGELDRICHDHITNHQQAISACLGYHGFPKSVCISVNEVICHGIPSDEKVLKEGDIVNIDVTVIKDGFHGDTSKMFIVGKPTILGERLCRVTQESLYLAIKMVKPGIRLRTLGKAIQKFVEAENFSVVREYCGHGIGEGFHEEPQVLHYDADDGGVVLQAGMAFTIEPMVNAGDYRIRTMKDGWTVKTKDRNLSAQYEHTIVVTDNGCEIMTLRKDDTIPNIITHE

SEQ ID NO: 46138 - protein, 768 aa, Bordetella bronchiseptica RB50
MRRKGCAPMDENLTKLALDYHAYPTPGKISVTPTKTLANQDDLSLAYSPGVAAACMAIFDQGNDAASKYTSRSNLVGVITNGTAVLGLGNIGPLAAKPVMEGKGCLFKKFAGIDVFDIELAENDPDKLVDIIAALEPTLGGVNLEDIKAPECFYIEKKLRERMNIPVFHDDQHGTAIISSAAILNGLKVVGKDIGQVKLACSGAGAAAIACLDLLVHLGIKREHIYVVDSRGVIWEGRDENMEPNKRRYAQKTEARTLADVVNGADVFLGCSTAGVLTPEMVKTMAAQPLILALANPEPEIRPELAKAARPDCIVATGRSDYPNQVNNVLCFPFIFRGALDAGATRITEEMKLACVKAIAELAQAEQNDEVARAYAGQELSFGPDYIIPKPFDPRLIVQIAPAVAQAAADSGVATRPIEDIEAYRQKLMGFVYHSGQLMRPLFQQAKQAPKRVVYADGEDERVLRAVQTVIDEKLAEPILVGRPSVIEMRIKKFGLRMVPGQNVEIVDPEDDSRFNDTWNGYYQLRGREGVTPAIAKAMIRKHNTLIGAMLLRRGDADALLCGVASKYDNQLKYVEEVIGRKPGQTYGALNVLMLPNQTLFVTDTHVNENPSADEIANITIQAAEEMLRFGVMPKIALLSHSNFGSRPTDSSRKMAHARKLVAERAPHLEVDGEMHADAALSESIRLQAYPDSTLKGRANLLVMPNLDTGNITYNMLKMTGSNGIAMGPILLGSARPVHILTTSATVRRIVNMTALAVVDAQQEAAEG

SEQ ID NO: 46139 - protein, 509 aa, Campylobacter jejuni RM1221
MLQALAIKYRPKTFDELIGQKTVSVSLKYALNHNRLAHAYLFSGLRGSGKTSSARIFSRALVCEQGPSDTPCGTCKHCLAALEGKHIDIIEMDAASNRGLEDIQALIEQTKYTPSMARFKIFIIDEVHMLTPQAANALLKTLEEPPSYVKFILATTDPLKLPATVLSRTQHFRFKQIPQSEILNHLKEILLKENVKFEEEALKFIARSGNGSLRDTLTLLDQAIIFCQNEISISKTTDMLGFLDPEKIKAFYQAILTKDKEKVFAYLEELQDYEASSVIDEMLFYLKESFFAKSTEFSTLIYERFFRILSKAKNMLCDDDGFTICVMAFMMMEASHLKEIDAQIQEIKQENTTNITPRITPSPIIPNLEKKIEKNAYEILLDSIYDRDFDLAECFKQSTKFISFENNTLNISSNAQGQNRDTLNKGFKLIQELFKAKFGENAKINVQKVLTIDENKLQSLTQELPNNENKNIDIQSSINMLKEGAKKFDPQEDLKEALKDCFGEPSIEN

SEQ ID NO: 46140 - protein, 424 aa, Chlamydia trachomatis D/UW-3/CX
MFTCEAGIASVQQAIKDVAEGKFVIVIDAASRENEGDLILAGEKVSTEKMSFLLSHTTGIVCASLSREQAKSLDLPAMVQDNQCAFKTAFTVSVDASSGVTTGVSASDRTRTVQLLADPAATAESFVRPGHVFPLISQPGGAVQRPGHTEAAMDLMRLAGMQPCGIFAELVNPDHSMMRQQQVLAFAEQHDLTVITVDDLITYRYTYDSLVTKISSARLPTKYGDFSIHVYESIIDGTQHFALVKGDIHEQEAVPVRVHSECLTGDILGSCRCDCGAQLDMAMRYIAEEGLGVIVYLRGQEGRGIGFGHKIRAYALQDLGYDTVDANLQLGFPIDAREYGMAAQVLKDLQLTSVRLITHNPRKFFELQRLGIHVLDRIILPVSISTENEGYLRTKKERMGHWLDLPVLDDVEEEYETVERMSCR

SEQ ID NO: 46141 - protein, 492 aa, Nicotiana tabacum
MLFLLFVALPFILIFLLPKFKNGGNNRLPPGPIGLPFIGNLHQYDSITPHIYFWKLSKKYGKIFSLKLASTNVVVVSSAKLAKEVLKKQDLIFCSRPSILGQQKLSYYGRDIAFNDYWREMRKICVLHLFSLKKVQLFSPIREDEVFRMIKKISKQASTSQIINLSNLMISLTSTIICRVAFGVRIEEEAHARKRFDFLLAEAQEMMASFFVSDFFPFLSWIDKLSGLTYRLERNFKDLDNFYEELIEQHQNPNKPKYMEGDIVDLLLQLKKEKLTPLDLTMEDIKGILMNVLVAGSDTSAAATVWAMTALIKNPKAMEKVQLEIRKSVGKKGIVNEEDVQNIPYFKAVIKEIFRLYPPAPLLVPRESMEKTILEGYEIRPRTIVHVNAWAIARDPEIWENPDEFIPERFLNSSIDYKGQDFELLPFGAGRRGCPGIALGVASMELALSNLLYAFDWELPYGVKKEDIDTNVRPGIAMHKKNELCLVPKNYL

SEQ ID NO: 46142 - protein, 157 aa, Chlamydia trachomatis D/UW-3/CX
MKPLKGCPVAKDVRVAIVGSCFNSPIADRLVAGAQETFFDFGGDPSSLTIVRVPGAFEIPCAIKKLLSTSGQFHAVVACGVLIQGETSHYEHIADSVAAGVSRLSLDFCLPITFSVITAPNMEAAWERAGIKGPNLGASGMKTALEMASLFSLIGKE

SEQ ID NO: 46143 - protein, 356 aa, Leifsonia xyli subsp. xyli str. CTCB07
MALTIGIAGLPNVGKSTLFNALTKNDALAANYPFATIEPNVGVVNLPDPRLGKLAEIFGSERILPAPVSFVDIAGIVKGASEGEGLGNKFLANIREADAIAQVVRGFSDPDVVHVAGKVDAANDMETINTELILADLQTLEKAETRYEKEVKGRKLEPTVLETARAALACLNEGTPLSASSLDLEPLRELGLLTAKPFIYVFNVDEAVLTDEARRASLAALVAPAQAVFLDAKLESELIDLDAEDAAELLASTGQSESGLDQLARIGFDTLGLQTYLTAGPKESRAWTIRKGWKAPQAAGVIHTDFEKGFIKAEVISFGDLVATGSVAEARAHGKARIEGKDYVMQDGDVVEFRHS

SEQ ID NO: 46144 - protein, 470 aa, Leifsonia xyli subsp. xyli str. CTCB07
MMSWHPSGSLAVLTADEIPSLQRRRLLRRITVLSTFGGLLFGYDTGVISGALPFMRFEGVALSPFEEGVVVSSLLFGAAAGSLVGGRIADRSGRRRLLIGLAIVFFAAALGCTFAPSIAVMVAARVLLGIAVGAASVAVPLFLTEVSPAQRRGQIVTHNELMIVSGQLAAFTVNAAIAAAVPEHAEVWRWMLVVASLPAVVLFFGMLVVPESPRWLILQGRFAEGRAEHQAEREAAEIRDAIEHAPSASFADLVRALGTPWIRRVFLVGVGIAMVQQLTGVNSIMYYGVQILQRAGFDAQAALVGQIANGVISVLATFGGIWLLGRVGRRPLLITGLIGTTSALLLVGTSSAVLAGTPALPFATLTLTVLFLTFQQGAVSPVTWLMLAEIFPARIRGVAFGAAALVLWLTNFLVGFLFPQLVSGMGISPTFFVFAAVGCGALLFVVRALPETRGRSLETLERELEAHYTR

SEQ ID NO: 46145 - protein, 516 aa, Neptuniibacter caesariensis
MTQKRATKALIILDGYGVESSESSAIQAANTPVWDKLLAENPNSRIQTSGMAVGLPDGQMGNSEVGHMNIGAGRVVYQNFTRISKAIEDGEFFDNAVLVDAMDKAISVGKAVHIVGLLSPGGVHSHEEHIFALLEMAVKRGAEKLYVHAILDGRDMPPRSAEPSLLRTEEKLAELGVGAIATVAGRYFSMDRDNRWDRVQQGYDAMTSGQAPCTATSAVGALQDAYGRDENDEFVQATVITDTEGNPKGVVSDGDALICANFRPDRAREITRAFTEKADFSGFERAATPELASYVMMTQYAADIQADCAYPPQAISNDLGEFLSGIGKTQLRIAETEKYAHVTFFFNGGQEEVYPGEDRILVPSPDVATYDLQPEMSAPEVTEKLVEAIRSGKYDLIVCNFANGDMVGHTGKFDAAVKACEVVDDCVEKVLAALREVDGEALITADHGNVELMVNPETGQPHTSHTNWPVALIYDGPRNGELNLADGALCDLAPTLLSLMGLEAPEEMSGKPLASF

SEQ ID NO: 46146 - protein, 328 aa, Clostridium perfringens ATCC 13124
MAILVCGGAGYIGSHMVAELIENNKEVVILDNFEKGHEDAILSGKLYKGDLRDRKILDKIFTENNIEAVIDFAAYSLVGESMTEPLKYFNNNVSGTISLLEAMRDHNVKYIVFSSTAATYGEPENIPILETDKNLPTNAYGESKLLVEKILKWCDTAYGIKYTALRYFNAAGAHVNGKIGEDHAPETHLIPLILQVALGKRDKIMMFGDDYDTKDGTCVRDYIHVSDLASAHSLALERLMNGGESRIYNLGNGTGFTVKEVVEVARKVTGHPIPAEVAPRRAGDPAILIASSDKAIEELNWKPKFNSLETIIETAWNWHKNHPNGYEK

SEQ ID NO: 46147 - protein, 443 aa, Thermococcus kodakarensis KOD1
MTPEEVVERYSQVISRASHVTYVPIVPSRAENALVWDIEGRAYIDFLADAAVQNVGHNNPRVVEAVKKTADRLLHFTFIYGFPVEPLLLAEKLREIAPLEGAKVAFGLSGSDANDGAIKFARAYTGRRSIIGYLRSYYGSTYGAMSVTGLDFEVRSKVGQLSDVHFIPFPNCYRCPFGKEPGKCRMECVSFLKEKFEGEVHAEGTAALIAEAIQGDAGMVVPPENYFKKLKRILDEHGILLVVDEVQSGLGRTGKWFAIEHFGVEPEIITLAKPLGGGLPISAIVGRGEIMDSLPPLGHAFTMSGNPVASAAALAVIEEIEEKELLKRAQILGERAKRRLEKMKKKHELIGDVRGLGLMLGVDLVKDRETKERAYDEAKKVVWRAYELGLIVAFLQGNVLRIEPPLTIEEEVLDEGLDKLEEAIEDVEEGRVPDEVIEKVQGW

SEQ ID NO: 46148 - protein, 646 aa, Vitis vinifera
MPEKKPTSSDSASTLDAKKLNLLPAVKYLLKELDLEHVDLDNLPQMVEAESYSYPDVTETSEKPLDSPAEASGEKNEQSTENVSGGSGRSVPTLKESHSVGASLERYDQIREDKGVKKTDEPEKPLVFRSEVNEEKVVCTLKQPLNVETNIGNLDQNTSPGSRLSGHQVTGTEGASLVDEAWDRLQKSFVYFRGKPVGTLAAIDPSAEPLNYNQQVFVRDFVPSGLACLMKNPPEPEIVKNFLLQTLHLQGCQKKIDNYTLGEGVMPASFKVLHDPKTQKETLVADFGGSAIGRVAPVDSVFWWIILLRSYTKCTGDNSFSELPQVQGGIKSILKLCLCDGFNNFPTLLCADGCCMVDRSMGINGYPIEIQSLFYFALRCARQMLKPEHGGKEFFKRIDARITALSFHVQTYYWLDITQLNNIYRYKTEEYSHTAVNKFNIIPDSIPEWLFDFMPLRGGYFMGNVSPGRMDFRWFLAGNCIAILSSLATSEQATAIMDLVEERWEQLIGEVPLKVVYPALEGHYWELVTGCDPKNTPWSYHNGGSWPVLLWLLTAACIKIGRPQIAKRAIDLVEQRLSKDGWPEYYDGKTGRYVGKQARKFQTWSIAGYLVAKMMIENESNLLVISHEEEKKTNKLRHTRSASCFF

SEQ ID NO: 46149 - protein, 114 aa, Zea mays
HASVIAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 46150 - protein, 207 aa, Vibrio fischeri ES114
MSYQENNAMPSIMDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAPGKRYVLPNSRVMIHQPLGGFQGQASDIQIHAQEILTIKKKLNTLLAEHTGQPLEVIEQDTDRDNFMSADDAVKYGLVDAVLNKRD

SEQ ID NO: 46151 - protein, 336 aa, Klebsiella pneumoniae subsp. pneumoniae MGH 78578
MVKVGINGFGRIGRNVLRAALNNPDIQIVAINDLTDSKTLAHLLKYDSLLGKLDAEVTAGEGGLVVDGKPITVFSERNPASIPWRQCEVDIVIEATGLFTDREKAAVHIHSGGAKRVIISAPGKNDDLTIVMGVNESLYSPDKHYVISNGSCTTNGLAPAAQVLHQHFGIKHGLMNTTHAYTNSQALHDQPEKDLRGARAAALSIVPYSSGAAKALGKVIPELDGRLTGYSLRVPVPVVSIVDLTVTLERDVTVEEVNNAFREAAAAGPLKGILGYSDEPLVSSDYQGDPRSSIIDGLSTLVIGGNMVKILAWYDNEWGFSNRLVDLALMMAKRES

SEQ ID NO: 46152 - protein, 467 aa, Exiguobacterium sibiricum 255-15
MQLKREMTSRHLFMISLGGIIGTGLFLGSGLTISQAGPLGAVLSYIVGGTIMYLTMLCLGEMAVHMPVSGSFQTYTTRFIGPGIGFAVGWIYWLGWAVTVALEITAAGSLMDRWFPNTPIVIWCAIFTVILFGLNAVSAKAFGEAEFWFSSLKVLAILFFIALGGAAWFGWIDMTAARPESLFANFTSNGLFPNGALGVLTTMIAVNFAFQGTELIGVAAGESNDPEKSIPKAIRNTVWRTFIFFVLSITIVGALIPYETAGGISSPFIMVFDAIGIPYAADLMNIVVLTALLSVGNSGLYAATRMLWSMSQEGMISKKLAIVNSRGVPMRALCFTMLFAMLSLLTAFFAEDTVFIWLLSLAGLGAQVGWISISASQIAFRRQFIKNGHTVSELKFKTPFFPVLPIISFSLNMLVLISLAFQADQRIALYIGVPFFLLTWGCYHLFVKGKHIAAQTERQAASSTLES

SEQ ID NO: 46153 - protein, 431 aa, Bacillus anthracis str. Ames
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFDFIDIIIAMIIAGAINASMLIVAAALFFKNGLHVEDLDVAFNQFSNLVGPVSAALFGIGLLSAGLSSSSVGTMSGDIIMQGFIRMHIPLYLRRFITMIPPLVIIALGVNPTYALVMSQVVLSFGIAFALVPLIMFTSSKKIMGTLVNHRITTFIAWIIAVLVIILNIFLLYQTFVG

SEQ ID NO: 46154 - protein, 218 aa, Exiguobacterium sibiricum 255-15
MIKIAPSILSADFANLERDVKAVKAAGADYIHFDVMDGQFVPNISFGLPVLSSLRQKTDMILDVHLMIDRPENFVEAFVEAGADIVTFHVEATNHVHRVLQQIKAAGAKAGVVLNPHTPLSMIEHVLEEVDMVLLMTVNPGFGGQAFIPGVMKKLSQLAALKAEHDLSFEIEIDGGVNAETAKLCIENGANVLVAGSAIYNAPDYSEAITSIRNAAHV

SEQ ID NO: 46155 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIAFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFNDPWDWDNIPIFV

SEQ ID NO: 46156 - protein, 487 aa, Nicotiana tabacum
MELGDYKILNVGLLLVVTLVVAKLISALIMPRSKKRLPPVIKSWPILGGLLRFLKGPVVMLREEYPKLGSVFTLNLLNKNITFFIGPEVSAHFFKAPETDLSQQEVYQFNVPTFGPGVVFDVDYTIRQEQFRFFTEALRVNKLKGYVDHMVMEAEEYFSKWGDSGEMDLKYELEHLIILTASRCLLGEEVRNKLFEDVSALFHDLDNGMLPISVIFPYLPIPAHRRRDNARKKLAEIFANIIDSRKRTGKAESDMLQCFIDSKYKDGRATTDSEITGLLIAALFAGQHTSSITSTWTGAYLLCNNKYMSAVVDEQKNLMKKHGNKVDHDILSEMEVLYRCIKEVLRLHPPLIMLLRSSHSDFTVKTREGKEYDIPKGHIVATSPAFANRLPHVYKNPDTYDPDRFTPGRDEDKVAGAFSYISFGGGRHGCLGEPFAYLQIKAIWSHLLRNFEFELISPFPEIDWNAMVVGVKGKVMVKYKRRKLSNE

SEQ ID NO: 46157 - protein, 106 aa, Haemophilus somnus 2336
MDVLVPTPYPLQPGSVIRCRPVGVLKMTDEAGGDAKVVAVPHTKLSKEYDYIKDVDDLPALLKAQIQHFFESYKALEAGKWVKVEGWEGVEAARQEILESFERAKK

SEQ ID NO: 46158 - protein, 69 aa, Triticum aestivum
MVKICCIGAGYVGGPTMAVIALKCPDIEVVVVDISKPRIEAWNSDTLPIYEPGLDDVVKQCRGRNSSSD

SEQ ID NO: 46159 - protein, 336 aa, Acidovorax sp. JS42
MVTGGAGYIGSHMCVALAQANEPFLVLDNFGNSRPSVLERIGRITGREPECVRGDVRDAALLQQLFARHEFTAVIHFAALKAVGESVREPLAYYDNNVAGTVTLLQAMRQAGVRQLVFSSSATVYGDPASLPIREDCPLSATNPYGWSKLMMEQVLADVDASEPGQWRIARLRYFNPVGAHESGLIGEDPQGVPNNLMPYVAQVASGQREFLNVWGSDYPTPDGTGLRDYIHVCDLAEGHVAALRYLREHPGLLTVNLGTGRPVSVLEMVRGFEQASGRPVPYRLAERRPGDVAACWADPGLAERLLGWRATRDVQAMCQDAWRWQDGVARTLQPA

SEQ ID NO: 46160 - protein, 564 aa, Lachancea kluyveri
MSEITLGRYLFERLNQVEVQTIFGLPGDFNLSLLDKIYEVPGMRWAGNANELNAAYAADGYARIKGMSCIITTFGVGELSALNGIAGSYAEHVGVLHVVGVPSVSSQAKQLLLHHTLGNGDFTVFHRMSANISETTAWVTDIATAPAEIDRCIRTTYVTQRPVYLGLPANLVDLMVPASLLDTPIDLSLKPNDPEAEAEVVNTVLELIKDAKNPVILADACASRHNVKSETKQLIDITQFPAFVTPLGKGSIDEQHPRFGGVYVGTLSNDDVKEAVESADLILSVGALLSDFNTGSFSYSYKTKNIVEFHSDYIKIRNATFPGVQMKFALQKLLSQVGEVVKDYKPVAVPAKPTPNPACDPSTPLKQEWVWNQVGRFLQEGDVVITETGTSAFGINQTHFPNNTYGISQVLWGSIGFTTGACLGAACAAEELDKNKRVILFIGDGSLQLTVQEISTMIRWGLKPYLFVLNNDGYTIERLIHGENAQYNEIQPWKNLDLLPTFGAKDYETYRVATTGEWDKLAQDEAFNKNSRIRMVEVMLPVMDAPSNLVKQAQLTASINAKQE

SEQ ID NO: 46161 - protein, 627 aa, Burkholderia mallei ATCC 23344
MTDRIRPRPFRSRAGAIAAAFFAVTAAGCANAPGPGAQNAAAPASAASTPPAAPGAEAPAAPAELSSWVDKPGWTAQRDMIAAAHPLAAQAGQAMLKAGGTAVDAAIAAQMVLMLVEPQASGIGGGAFLLHENGKTIEAYDGRETAPAAATDRLFLDANGKPLPRAALGARTVGAPGALRMLELAHRAHGKLPWRRLFQPAIRLAEQGFPLGPRLAAALANEPSLARDPAARAYFYDRNGAPKPAGTTLKNPQLAATLRLVAAHGANAFYTGAIARDIVATVRQAPNPGVLSMQDLAQYRAKTREPLCADYRKWTVCGMPPPSAGGLVVAQILGLLEAQPDWRQIGAQKPVRNAVGVEPTPFAAHLFSEAGRLAYADRAQYVADPDFVAPPGGSWKRLVERRYVAERARLIGDASAGEASAGSPSGLPPATAADRGAEPPSGSQITVVDRYGNAVSMASTLDERFGSRLMVRGFLLNSQLLDFSPASAEHGKPVANRVQPGKRARSTLAPELVFEKGSSRLMMALGSAGGASTANDVAKTLVGMIDWGMTMQQAIALPNFGSRNGPTELEQGRVSDALAGALKARGHDVRVVELGSSLQGIQRINVEEQSVWFGGSDPRRDGIVAGD

SEQ ID NO: 46162 - protein, 383 aa, Methanopyrus kandleri AV19
MEKLVLLPGPVMVHEDVLLRSAKQVMNHRSEEFEEILTECVELSKYLFQTDGNVAIITGSGTAAMEAAIYSLLEPGEEVVAVVNGKFGERFADIAERRGAEVRRVEFEWGKVADPERVEEALADSDAEVVTLVHNETSTTVLNPAEEIARICREYDALFVVDAISSLGGVEFRMDDWGVDVCVTGSQKVLGCPPGLALVAVNDRALEVMEEKDAGSYYLDIPKYLEYLEKDPKQTPYTPAVNAFYALHEALKRLKEEGLEARWERYRLMQRIVREGIRALGLELFVEDDEIASPTVTGVTYPEGVDDREFRGEILRDRYDVVVAGGQDHLAGEIFRIGHMGEVRIRDMITAVTCIGLGMRELGVDVDVGAAAEAMADVLSEVS

SEQ ID NO: 46163 - protein, 374 aa, Corynebacterium glutamicum ATCC 13032
MTQVTESAVRSALSRVEDPEIGKPITELGMVKSVSIDGSDVQVEVYLTIAACPMKTTIVTNTEAALKDIDGVGQVHVTTDVMSDEQRRALRVSLRGETSEPVIPFAQPGSTTRVYAVASGKGGVGKSSMTVNLAAALAKRGLSVGILDADIYGHSVPGMLGSDQRPHQVDDMIMPPQAHGVKMISIAHFTEGNAPVVWRGPMLHRAIQQFLTDVFWGDLDILLLDLPPGTGDIAITVAQLIPNAELLIVTTPQAAAAEVAERAGTISVQTNQKVAGVIENMSAMVLPDGTTMDVFGTGGGQKIADRLTAVTGEEVKVIGSVPLDPNLRIGGDVGNPIAISEPHSPTAAAINEIAEHLAHRKVSLVGKTLGLGVK

SEQ ID NO: 46164 - protein, 494 aa, Nicotiana tabacum
MNFLVVLASLFLFVFLMRISKAKKLPPGPRKLPIIGNLHQIGKLPHRSLQKLSNEYGDFIFLQLGSVPTVVVSSADIAREIFRTHDLVFSGRPALYAARKLSYNCYNVSFAPYGNYWREARKILVLELLSTKRVQSFEAIRDEEVSSLVQIICSSLSSPVNISTLALSLANNVVCRVAFGKGSAEGGNDYEDRKFNEILYETQELLGEFNVADYFPRMAWINKINGFDERLENNFRELDKFYDKVIEDHLNSCSWMKQRDDEDVIDVLLRIQKDPSQEIPLKDDHIKGLLADIFIAGTDTSSTTIEWAMSELIKNPRVLRKAQEEVREVSKGKQKVQESDLCKLDYLKLVIKETFRLHPPVPLLVPRVTTASCKIMEYEIPVNTRVFINATANGTNPKYWENPLTFLPERFLDKEIDYRGKNFELLPFGAGRRGCPGINFSIPLVELALANLLFHYNWSLPEGMLAKDVDMEEALGITMHKKSPLCLVASHYTC

SEQ ID NO: 46165 - protein, 299 aa, Neptuniibacter caesariensis
MPLTRKEAMTTAHVLSEAMPYIQRFVGKTIIIKYGGNAMIDEKLQNSFARDIVMMKLIGINPIVVHGGGPQIGQLLNDLKIESHFINGMRVTDSKTMDVVEMVLGGAVNKQIVGLINNNGGQAIGLTGKDGQLLRAKKLRVKHKTPEMEAPEIIDIGHVGEVASVNVKVLDMLVNSDIIPVIAPIGVGEDGASYNINADLVAGKVAEVLQAEKLILLTNIEGLMDKDGNILTGLTTKQVDDLIEDGTIYGGMLPKIDCALSAVKGGVTSAHIIDGRVEHSCLLEIFTDEGVGTLITNRA

SEQ ID NO: 46166 - protein, 67 aa, Glycine max
MASSVISAPAGTTVNRAGAGMVAPFTGLKSMAGCPSRRTKNDVSSIASSGGRVQCMQVWPPVGREEV

SEQ ID NO: 46167 - protein, 646 aa, Vitis vinifera
MGSLSEEEDQFFDTREDITSVSDSGSDCQENLDSDIRERRTKFLKWMGLGVDHVVREVPEELVSGELKGEIDRITENSGAVLGMSSSDDGFSSSQSSMCWPSDAQDFLGGSLEENLFCRIRKFERTLGLSPLVQKMMRKEAEKACNPVEAAKRCRRGWWRRLGAVACIANCPIEVGKFKPNGPYPILGTKSQTVKVRPYRRRSKELSALYMGQDFVAHEGSILTMKFSPDGQYLGSAGEDRVVRVWLVTESERSDGFDAPDVDCSYAYFTVNHLSELVPIHADKEKKGKLKTLRKSLDAACVIFPQKVFQILEKPLHEFHGHCGEVLDISWSKNKYLLSSSVDKTVRLWQVGCNQCLKVFSHNNYVTCVQFNPVDDNYFISGSIDGKVRIWEIPGGQVVDWTDITEIVTAVCYRPDGKGVIVGSMTGNCRFYDASDDRLQLHALICLQGKKKSSFKRITGFQFSPSDPSKLMVTSADSQVRILDGVDVICKYRGLRNAGSQISASFTSDGMHIVSASEDSNVYVWNCISQDVPNNWSCERFFSNNASVAIPWCGATCLTQKINHINATWVRAQSLPKGSATWPEEKLLTPSSLVVSSAMCKSQYKFLKTSCQSMFGSPHAWGLVIVTAGWDGRIRSFQNYGLPIRK

SEQ ID NO: 46168 - protein, 313 aa, Eucalyptus globulus
ANLFAMQLATASVLPAVLTAAIELDLLEIMARAGPGAYLTPGEVASQLPTQNPDAPVMLDRIFRLLASYSVLTCTLCDLPEGKVERLYGLAPLCKFLVKNEDGVSLAPLRLIDQDRVFLESWYYMKDAILEGGIPFHKAHGMTAFDYPGTDPRFNKIFNRAMSDHSTIMMKKILETYNGFEGLKTVVDVGGGTGAILNMIVAKYPSIKGINFDLPHVIEDAPSYPGVEHVGGDMFVNIPNGDAVFMKWICHDWSDEHCAKLLKNCYDALPVNGRVIVAEYILPAYPDQSLSTKGVIHMDCIMLTHFSGGKERT

SEQ ID NO: 46169 - protein, 229 aa, Triticum aestivum
  misc_feature (98)..(98): Xaa can be any naturally occurring amino acid
  misc_feature (109)..(109): Xaa can be any naturally occurring amino acid
  misc_feature (152)..(152): Xaa can be any naturally occurring amino acid
  misc_feature (155)..(155): Xaa can be any naturally occurring amino acid
  misc_feature (162)..(162): Xaa can be any naturally occurring amino acid
  misc_feature (189)..(189): Xaa can be any naturally occurring amino acid
  misc_feature (193)..(193): Xaa can be any naturally occurring amino acid
MAASPATSSSAARATSFARLSNAPLRAPRAGAVSFPSPNSARPAALVADARASRLPVVAAAAAGHQRLMGSLTNTEGLRFAVVVARFNEIKGPTWLLXRGLLEAFEREXYSKQKMVHRRLGFLASFENSCSSQRKIGKIRKIMMQILCTREXRIXSDAYTEXHRCCANSAVCGVINAGLSAGVPCVFGXLTCXDMDQALNRAGGKAGNKGAETAITAIEMASLFRHHLA

SEQ ID NO: 46170 - protein, 269 aa, Glycine max
  misc_feature (76)..(76): Xaa can be any naturally occurring amino acid
MAMARRRALALVSQLLQRRVLPAPRFLSSAAGGALDRLNSPPFARPAAPRNPASPSPWDRLGGQKRTMFIQTQSTXPNPQSLMFHPGKPVMEVGSSDFPNARTAMTSPLAKALFAIEGVTRVFFGSDFVTVTKSDETSWDYLKPEVFAAIMDFYSSGQPLFLDSNTAAGMDTAIHEDDSEIVAMIKELLETRIRPAVQDDGGDIEYRGFEPETGIVKLKMQGACSGCPSSSVTLKSGIENMLMHYVPEVKGVEQEFDGDEEAELAGQME

SEQ ID NO: 46171 - protein, 197 aa, Triticum aestivum
DDCPSPPSSDGNRHLVTPLVVTAFVLVFLSLVSLSIYCFIRRRRRQRRQQSLLAAGAANPAAQGDGPAPEMAGAATATDVEGGAAPDPEDEEVVHHAWHIRTVGLDEAAIESIALTRYRVGAGTLGGAADCSVCLGEFLDGELLRLLPKCGHAFHVPCIGTWLRAHVNCPLCRADVVVLDSAATGRSEPPADAQQFL

SEQ ID NO: 46172 - protein, 423 aa, Rhodococcus sp. RHA1
MSAESVAATPEPTGGHIRLTSHSGGVGALPIHWGAPTPSERGPVVGTTTNRAHRNVIGTHSGSYSIYRALAVASGALSRHHKADLTDTAPTNIIGPYPQWSEPGKIVSLDPWGATVAEVFAAELAAGHDIRPSIAVTKAHVILPEIMEAIQKGRLHPDGRFLLPSGAALVTKAAIEPVWHLPGVAERFHCSETDLRRVLFEETGGMYPELVTRSDLEVFLPPIGGQTVYIFGDARDLADPGVELTARVHDECNGSDVFGSDICTCRPYLTHAIEECIQGAQRGGVGLVAYSRKEGRALGEVTKFLVYNARKRQVGGDTADQYFARTECVAGVQDMRFQEMMPDVLHWLGVRKIHRLVSMSNMKYDAITGSGIEVGERVDLPADLIPADARVEIDAKMAAGYFTPGAVPDADELAKVKGRELDG

SEQ ID NO: 46173 - protein, 453 aa, Salmonella enterica subsp. enterica serovar Paratyphi A str.
MSFDSLGLNPDILRAIAEQGYREPTPIQQQAIPAVLEGRDLMASAQTGTGKTAGFTLPLLQHLITHQPHAKGRRPVRALILTPTRELAAQIGENVRDYSKYLNIRSLVVFGGVSINPQMMKLRGGVDVLVATPGRLLDLEHQNAVKLDQIEILVLDEADRMLDMGFIHDIRRVLAKLPAKRQNLLFSATFSDDIKALAEKLLRNPLEIEVARRNTASEQVTQHVHFVDKKRKRELLSQMIGQGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRITTPGYEPDPSIKAEPIQNGRQQRGGGGRGRGQNQGGAGRSQQPRRQDSGAAKAKPKPRTGEGKPAGDKARPPRRPRRITPAQ

SEQ ID NO: 46174 - protein, 552 aa, Coprinopsis cinerea okayama7#130
MSGKLASSYASWAELQKIYDHQHSKLVLKDLFAQDPERFKKFSKEYTSSTNPETTILLDYSKNLITEPILAKLLDLAREAGVEEWRDKMFAGEHINNSEGRAVLHVALRAFGEINTTEEGVSQVGSVLAHIKEFTEAVRSGQWKGYTGKSIDTIVNIGIGGSDLGPVMVTEALKPYSKRDLKAKFVSNVDGTHIAEVLRECNPETTLFIIASKTFTTQETITNAETARSWFLDTAKDKAHVAKHFVALSTNTKAVTAFGISEQNMFQFWDWVGGRYSLWSAIGLSIALVIGYENFEALLKGAHGMDMHFREAPLERNLPVLLAVIGIWYNDFYGSQTHALLPYDQYLNKFADYFQQGDMESNGKSVTKNGERVNYQTGPIIWGASGTNGQHSFYQLVHQGTKLIPADFIAPATTHNPINHSKHHRILLSNFFAQPEALAFGKTEEEVRAELGSGAAEEVVKSKVFEGNRPTNSIMFPLLTPEVLGALIALYEHKIFTQGVIWGINSFDQMGVELGKVLAKKILAQLEKPEDVQGHDSSTTGLIHYYQKWRKE

SEQ ID NO: 46175 - protein, 564 aa, Lachancea kluyveri
MSEITLGRYLFERLKQVQVQTIFGLPGDFNLSLLDKIYEVPGLRWAGNANELNAAYAADGYARVKGMSCIVTTFGVGELSALNGIAGSYAEHVGVLHVVGVPSVSSQAQQLLLHHTLGNGDFTVFHRMSSEISETTAVITDIKDAPKEIDRCIKVTYSKQRPVYLGLPANLVDLKVSASLLDTPIDLSMTPNDADAEDEVVETVLAMVSKAKNPVILADACCTRHDVKRETKKLIDLTQFPAFVTPMGKGSIDEDHPRFGGVYVGTLSDPEVKEAVESADLVLSVGALLSDFNTGSFSYSYKTKNIVEFHSDYTKVRNATFPGVQMKLVLQKLLSKVSDAASGYKPVPVPKGTRSNPGVESSTPLKQEWIWNHISDWLEEGDVVITETGTSAFGINQSRFPNSTYGISQVLWGSIGYSVGSCLGAAFAAEELDKNRRVILFVGDGSLQLTVQEISTMVRWGLKPYLFVLNNDGYTIERLIHGETAQYNDVQPWLHLNLLPTFGAKDYDSIRISTTGEFLKLTEDQAFSRNSKIRLIEVMLPVMDAPSTLVKQAQLTAATNAKQG

SEQ ID NO: 46176 - protein, 473 aa, Oryza sativa
MEGIHAGTVTMACSWLVLTAAMAVLASWLIRLVSLKWNSSHPCKADEGSRLPPGSRGLPLLGESLEFFTSSTSLELPVFFKRRLNRYGPVFRTNMVGQDLIVCLDPEVNSFVFQQEERLFQCWYPDSFMRIIGADNIITTLGSSHKYIRNLILRLFGPENLRRAMLQDVHRTAQASLLSWLDRPSIELKDAVSSMIFSVTAKKLISYDSLASDGKMWKQFDAFIRGLLAFPIGIPGTAFYKCMQGRKNIMKMLKELIDERKEASGRRGSIDFIDVLLEELNEEKPLISENVALDLIFLLLFASFETTASAITAVVRFLTDNPEALQELADTAEPTGGASKDFMAFGGGLRLCVGADFAKLQTAIFLHCLVTKYRGSYGRCPTTTEPLGPLLRLYQRRGSGRVAGGLERRGGQRRVAAAGGSGSGLDCRDLGSGCGNGFDGRRRHRWVAAAGDEGCGSSGAALGRGRIRCPREA

SEQ ID NO: 46177 - protein, 577 aa, Lachancea kluyveri
MSTMQLGTYLFYRLSQVTKTVFGVPGDFNLNLLEHVYNFDESQIKWCGNANELNAGYAADGYSRINKFGCFITTYGVGELSALNAVSGAFAENAPVLHIVGTSSMLAKRGACPLNQIHHLIPPKKTYEAPDHKVYEKLAEPFSIHTESLSDENLEKIQDQIDSVIESIFCHMKPGYLFIPSNLPDAEIPVDLNKQLNFDFITKLRVDPHATSEMVSLTLKRIYSSRNPGFIVDQFMRFDLEKLNLFLEKFNFYCYNTTTARGFADESLPNFHGVFNNELSTNGTLEILDQNDFILHLGTNINEVSYFVGGSTPLDKKDVIFIGKDYAQVGTNGHIITGINCHVFFEELLQRMNSKTMPKVKTRKSTALYNNGYTVDDDSKTVTQANLSQVVSAQLRENDVIINEMCSFMFEMPNIKYSKGCQFVGQPFYGSIGYALPATLGASLAIKDYKKSGRVILFQGDGSAQMTLQELASYIRFEIDPIIFMLNNSGYSVERVIKGPTRSYNDIIVDWDWCNILSVFGDRNGDRSTSYKVEKLGELKNVLTKRLDYSDGKIKMVEIILDRMDVPFGFKKLIGAN

SEQ ID NO: 46178 - protein, 804 aa, Oryza sativa Japonica Group
MTPHQLYIFLGLLLFSLHGAPPCSAAVNDTLTAGESLAVSDKLVSRNGKFTLGFFQPSFVTNSGNITSPNWYVGIWFSNISAFTTVWVANRDNPVTDLQLNQTRLELSKDGDLVISSNASIIWSSATVANTTTVTTMNTTSVILANNGNLMIIGSSPTSNVSWQSFDHPADVMLPGAKFGWNKVTGATIKYVSKKNLIDPGLGLYYFQLDNTGIVLARSNPAKTYWSWSSQQSSKAISLLNQMMSINPQTRGRINMTYVDNNEEEYYAYILSDESLYVYGVLDISGQLIINVWSQDTRSWQQVYTQPVSPCTAYATCGPFTICKGLANPVCSCMESFSQKSPQDWEVGNRTAGCFRNTPLDCGNTTSSTDVFQAIARVQLPSNTPQSVDNATTQSKCAQSCLSYCSCNAYSYENNRCSIWHGDLLSVNSNDGIDNSSEDVLYLRLSTKDVPSSRKNNRKTIVGVIAAACIVCFLVMLMLILLILKKKLLHASQLGGGIVAFRYSDLRHATKNFSEKLGGGGFGSVFKGVLSDSTIIAVKKLDGARQGEKQFRAEVSSIGLIQHINLVKLIGFCCKGDKRLLVYEHMENGSLDAHLFQSKATVLNWTTRYNLATGVARGLSYLHHSCKEYIIHCDIKPENILLDALFTPKIADFGMAAFVGRNFSRVLTTFRGTIGYLAPEWISGVAITPKVDVYSFGMVLLEILSGKRNSHKVCTDDNNSNQVAFFPVTAISKLLEGDVQSLVDPELNGDFSLEEAERLCKVACWCIQDNEVNRPTMSEVVRVLEGLHNFDMPPMPRLLAALAI

SEQ ID NO: 46179 - protein, 258 aa, Agrobacterium tumefaciens
MADQNMPKSAEQDTAAIVEKIARKAGERALDHFRSLSSLPVETKGHLDLVTEADKDVEAFLIGSLREAFPDDGIMGEESGEIPGASGRVWVIDPIDGTFNFVRGGQNWAISIGLYENRRPSFGVIYAPVRDLILVGGKTVPTRLNGQPIKPLPALDMSRASTGFSRFISDDLKISFRFCGAATLSMIEVAMGETDGYVSLGDSTWDVMAALPILGHLGISNTIDWDRIDLSSKLRFACGSDEFLSKVRPLIEKVSAAA

SEQ ID NO: 46180 - protein, 442 aa, Pseudomonas syringae pv. phaseolicola 1448A
MTEALTTLLPNLGLRLQFAQPRPMRGTLRSIRGVLLRASVAGVGIGELCVLRDPGNGRELSAEVIGFDEDDAILSPIGSMEGLSTRTQIIATGQALGVQVGDALLGRVISPMGEFLDGPAPTATLGMQHYPLHAEPPAPFSRQRIVKPLSLGIRAIDSLLTLGQGQRMGIFGEPGVGKSSLLASIVRNSDADVIVIGLIGERGREVRELLEGQLDATARARTVAVVATSDRPAAERVRAAYVATTLAEYHRDQGRNVLLLMDSLTRFARAQREIGLAVGEPPPRRGYPPSFFSALPRLLERAGPGPQGSITALYTVLTEGDAAMDPVAEETRSILDGHIVLSAELAQRDHFPAIDVLRSRSRLMDHIATAEHRHLASRLRELIARRQEIELLIQVGEYAAGSDPIADEAIARHSPIEAFLRQPPSEHDSLAQTLARLRKVLA

SEQ ID NO: 46181 - protein, 288 aa, Brassica rapa
MSTDLTEEESLSGKDYQDPPRVKIFEARELGKWSFYRAVIAEFIATLLFLYVTVLTVIGFKSQTDLQTGGGACASVGLLGISWAFGGMIFILVYCTAGISGGHINPAVTFGLFLASKVSLVRAISYIVAQCLGATCGVGLVKVFQKTYYNRYGGGANVLADGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAALYHQFVLRAGAMKAYGSVRSQLHELHA

SEQ ID NO: 46182 - protein, 527 aa, Neptuniibacter caesariensis
MDFIWILFAFVCGYLMRLVEMPPLIGYLFAGFFLHFIGIEPVSSLDTLADLGITLMLFTIGLKLNVKDLLKTEVWASTLSHMGIWILITGSLFLLLATLAVPYFTDLDLKSAALIAFALSFSSTVCIVKLLEESGEMKTRHGQLAIGVLVMQDIVAVLFLVAATGKIPSIWAIGLLGIFLIKPLLNHMLMRAGHGELLPLAGFFLALGGYELFNLVGVKGDLGALVFGMLLSTHPKASELTKSLLSFKDLFLIGFFLSIGFTALPDWSMLGMATILAILIPLKYLMFFGIFTRLHLRGRTSYLSALALSNFSEFGLIVAYLCVDSGWLSEQWLVILALSVSISFILTSIIYRSAHSFYLRHKEKIKSYESLKPLASDIFIQPKDSEILVIGLGRVGKGAFKALHSMVGDKVWGMDADRNRIKKFQSKGLHVFYGDGEDADLWSNMDTHNIKLILLALPAIDDMLNIAEQLHSANYQGEIAAIARFPDEHDLLVEGGIDKVFNFYTEAGFGFAEESLQLIDYKKEASS

SEQ ID NO: 46183 - protein, 576 aa, Physcomitrella patens subsp. patens
MKVIEDVVSETEGTLGYYIARRLVEIGVRDVFTVPGDFNLVLLDHLIAEPKLRLVGCCNELNAGYAADGYARAHGVGACVVTFTVGGLSVINAIAGAYSENLPIICIVGGPNSNDFGTNRIIHHTIGEPDFGQEHRCFQQITCAQIVIQNLDDAHELLDRAISTALNKSKPVYVSVSCNLPSLPHPSFKISPIPYSITQGTETNSLCLESALDTVAEILNTAVKPVLIAGPNLRIAKAIDAFEALATASGYAVAVMPSGKGHFRETHPHFVGTYWGAVSTSYVSEIVESADIYVFVGPIFNDYSSVGYSLLCKKEKMIIVQPERVTIGNGSSFGCVLMKDFLLALAKKVKRNTTSFDNYLRMYVPPGVPLKQKPNESLKTVNLYKHIQGMLSRHTAVIAETGDSWFNCQKLKLPDGCGYEFQMQYGSIGWSVGATLGYAQGAPNKRVIACIGDGSFQVTAQDVSTMIRCGQRSIIFLINNGGYTIEVEIHDGPYNIIKNWNYTGVVEAFHNGEGKLWTCKVRTEDDLIDAIATAQGEKKDHLCFIEIMVHRDDTSKELLEWGSRVAAANSRPPNPQ

SEQ ID NO: 46184 - protein, 158 aa, Glycine max
  misc_feature (98)..(98): Xaa can be any naturally occurring amino acid
  misc_feature (100)..(100): Xaa can be any naturally occurring amino acid
  misc_feature (115)..(115): Xaa can be any naturally occurring amino acid
  misc_feature (130)..(130): Xaa can be any naturally occurring amino acid
MDSSLISFPAVTTVNRAGAGMVAPFTGLKYMAGFPTIKTNNDITSIASNGGRVQCMHVWPPLGKKKLETLYYLADLDDAQLLEEVEYLLRKGWIPCLXIXLEHGFLYREHNRLPXYYDGRYCTMCKLPMXCCTDASQVSEELQEATTAYSSCFMRIIA

SEQ ID NO: 46185 - protein, 487 aa, Triticum aestivum
SAPGTACADTLEFVDVSANLLIGARPACMRSNSSARTVLDAGNCFRDAKLQRPSTYCSPGALAALLPPPQGSGAEQGGGKGGGVGMVLGIVGGVVAGALLIALVMVVVLRRARRQHPGVMALPKSPLIRAAKKGDSAKATAKMSQKIATPADKRHASQAAMVNTLEVPAYRVYTAEELQEATDNFASSNLIKKSALAQHYNGQLQDGTRVLVRCLRLKPKYSPQSLSQYMETISKFRHRHLVSIIGHCVVSDQENPTIASSVYLISECVTNGSLRSHLTEWRKREMLKWPQRVSAAIGIARGIQFLHNAIAPDIVQNDLNIENILLDKTLTSKISGFSLPMISTSKNGKLFSENPFAVQEENDHYSAQSAEQGDKDDIYQFGQILLEVITGKPTASQSELESLRAQLSEALAEDPDMLKDMADPTIRGTFAVDSLSKVTEVALNCTAGDPSDRPSVDDVLWNLQYSMQVQDGWASSESLSLSVKSQA

SEQ ID NO: 46186 - protein, 416 aa, Leifsonia xyli subsp. xyli str. CTCB07
MTDPTRTPFAGPSLAAFEAARAIVATVAQPTPLESSRYLAGVLGAPVLLKCENLQRTGSYKIRGAYNRMSKLTAEERNRGVVAASAGNHAQGVAFAARELGIHATIFMPVGVAIPKFQATRAYGADVVLSGSIVDEALRAAADFAAETGAVLIPPFDHPDVVAGQGTLGLEILDEVPDVSTIVVPIGGGGLISGIASAVKQRSAREGRTVRVIGVQAANAAAYPPSLEAGAPTEISLVATIADGIAVSRPGALNFQIVQDAVDAVVTVTEDDIARALLVLLERAKLVVEPAGAAAVAAVLAGHIPADGTTVVILSGGNIDPLLMQRVISHGLAASDRYLKLSIMLPDRPGQLARIAEILAGVNANVVEVLHTRHGRGLQLSQVELDVSVETRGSEHRQQVISVLRAAGYDPVLEED

SEQ ID NO: 46187 - protein, 174 aa, Zea mays
LEQSSTFHVVTIGTEQRIAEAADGANPHRLLATVSVSKPSYPTVVTTPMSAYGADPASKPSYSTFPSLATGNGGAGAGAGAGGGGAAAGSGGGGGTWCVASQSASPTALQVALDYACGYGADCSAIQQGGSCFNPDTVHDHASYAFNSYYQKNPAPTSCDFGGTATITNTHPSK

SEQ ID NO: 46188 - protein, 272 aa, Vitis vinifera
MADKTVILAMINKAYVDGDKTMLDLFLDGFWLGEGTRGLLDHLLLVAVDQTSLERCKFLHLHCYKLETEGVDFSGEKMYLSEDFMKMMWRRTLFLGEVLKKGYNFIFTDIDIMWLRNPFPRLTLNQSVDLQISTDDFNGDEWSESNHINTGFYMIKSNNKTIQLFGMWYAQRNNSNGLKEQDVLDGMQKDGVFRDLGVKARFLDSLYFSGFCKESKDFKVVTTVHATCCRSIHAKVADLTVVLHDWLRFKNSPTNETSTFQWSSHTACMHSW

SEQ ID NO: 46189 - protein, 420 aa, Thermococcus kodakarensis KOD1
MKEIAVIGLGYIGLPTAIMFANAGFRVTGYEIREDVVRSINSGKAHIIEPEIDELLKKAVSSGNLRATSDPEEIRNKDAYIICVQTPLKEDKTPDLSYLESAVRTVAERMKKGSLVVIESTVPPLTTVKMAKLIEEIRGFKAGEDFYMVHAPERVMPGRIFKELVYNSRIFGGITPESSEIAEKLYRSFVKGQTFKTSSTVSEVVKLMENTFRDVNIALANEFAFLAHQYGVNVFEAIELANTHPRVNIHLPGIGVGGHCLPKDPHLLLWPAKEDFGLIRTAREINDSMPLFTKDLLFSAFKQLNVPPEEAVVAVLGLAYKGNSDDTRNSPAIAFIDAIKDDVREVRSYDPFVGGSAESLEEALRGADAAVIATDHTAFKNLNWEELGKLMRTKILIDGRHIIDKPPRGFLFKGIGRGEY

SEQ ID NO: 46190 - protein, 290 aa, Klebsiella pneumoniae subsp. pneumoniae MGH 78578
MRVYVTGNITVDETWSIPDIPKKGASIHGVKVSQDIGGKGANQAIILSRCGIETRLIAATGNDSNGAWIRQQIKNEPLMLLPDGHFNQHSDTSIILNSADGDNAIITTTAAADTFSLDEMIPHMADAVAGDILLQQGNFSLDKTRALFQYARSRGMTTVFNPSPVNPDFCHLWPLIDIAVVNESEAELLQPYGVKTLVITQGAAGAWLVQEGQRQFCPAVPAEALDTTGAGDTFLAVMLASALLRGVAPDALALAHASRAAAITVSRRGTLSAFPGSRELAALLTTDGAR

SEQ ID NO: 46191 - protein, 366 aa, Vitis vinifera
MGASVVPERWDVLGLGQAMVDFSGMVDDEFLERLGLEKGTRKVVNHEERGRVLQAMDGCSYKAAAGGSLSNSLVALARLGGRSIGGPPLNVAMAGSIGSDPLGSFYRTKLRRANVNFLSAPVKDGTTGTVIVLTTPDAQRTMLAYQGTSSTVDYDACLASTISKTNILVVEGYLFELPDTIRTITKACREAHRNGSLVAVTASDVSCNERHYDDFWEIIGNYAGIVFANSEEARALCHFSSKESPASATRYLSHFVPLVSVTDGPRGSYIGIKGEAVYIPPSPCEPVDTCGAGDAYASGILYSFLRGVSDVKGMGTLAAKVAATVVRQQGTRLSVHDAVELAESFAFHLNSSTIRSDIGSDHISSL

SEQ ID NO: 46192 - protein, 274 aa, Vitis vinifera
MEFVLCIRCCLQAAFFPFTILDWLVTKIIFPGFKEVQEEEKSQMVGNVFTSVASSYDLMNDLMSGGLHRLWKDRLVSKLHPFPGMKHLDVAGGTGDVAFKILETINKMKLRTMHNVPEDEMLDVGKKRAMEQGLGKDPTLLWLEGDAEALSFDDDSMDGYTIAFGIRNVTHIEKVLSEAYRVLKRGGRFLCLELSHVEIPVFKELYDYYSFSVIPAMGELVAGDRASYQYLVESIRRFPPQEKFASMIANAGFQKVEYENLVGGVVAIHSGLKF

SEQ ID NO: 46193 - protein, 339 aa, Oryza sativa Japonica Group
MPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAGIAGGTGVMPGGNVGQDHAVFEQGASAGNVGNENILEQKKANPIALLLSSAMMLRHLQFPSFADRLETAVKRVIAEGKYRTKDLGGTSTTQEVTDAVIANLD

SEQ ID NO: 46194 - protein, 258 aa, Escherichia coli
  misc_feature (1)..(2): Xaa can be any naturally occurring amino acid
  misc_feature (52)..(52): Xaa can be any naturally occurring amino acid
  misc_feature (157)..(157): Xaa can be any naturally occurring amino acid
  misc_feature (196)..(196): Xaa can be any naturally occurring amino acid
  misc_feature (214)..(214): Xaa can be any naturally occurring amino acid
  misc_feature (250)..(250): Xaa can be any naturally occurring amino acid
  misc_feature (252)..(252): Xaa can be any naturally occurring amino acid
XXNPLIIKLGGVLLDSEEALERLFSALVNYRESHQRPLVIVHGGGCVVDELXKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLXNVNADQAATALAATLGADLILLSDVSGILDGKGQRIAEXTAAKAEQLIEQGIITDGXIVKVNAALDAARTLGRPVDIASWRHAEQLPALFNGXPXGTRILA

SEQ ID NO: 46195 - protein, 325 aa, Rhodococcus sp. RHA1
MTDRYVLVDTDAGVDDALALLTIAQHAGAEIVGVGTVFGNCTERQAARNALTVLSVAGMRDVPVCVGQSRPGPPPATSSPHGLDGLGDRGYRPPPGVGPAPESAVDQLLRVAQDRPGAVDLLCLGPLANIAAAVTRDPRILTRFRSVTIMGGMGPVSRREVEAAEQPQFLEKGDTNTNHDPVAARVVAAAPGQITWVGMSVTGRLRLAWADLVARSAVGKTATFVRDITEDYHRYCTGTYRSEDPIYTAHDSVAAAVMLDPTVMLSATDAQPRVYHDEDGRAAVWGVSPVRGPAHRFVTDLDYRSIGARITATLDADPPGSDPTG

SEQ ID NO: 46196 - protein, 438 aa, Bacillus cereus ATCC 10987
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPVSCFLSIGIVFTGLPVYWYLNKKNKNEVS

SEQ ID NO: 46197 - protein, 488 aa, Brassica napus
MELDSDKNLLKTGLVTIATLVIAKLIYSFFTSSSKKKRLPPTLKAWPPLIGNLLRFLKGPIVMLRDEYPKLGSVFTVNLLHKKMTFLIGPEVSAHFFKAPESDLSQQEVYQFNVPTFGPGVVFDVDYTVRQEQFRFFTEALRVNKLKGYVEMMVTEAEDFFSKWGESGEVDLKTELERLIILTASRCLLGREVRDQLFDDVSALFHDLDNGMLPISVLFPYLPIPAHRRRDRAREKLSEIFTKIIGSRKRSGKCENDMLQCFIESKYKDGRQTTESEVTGLLIAALFAGQHTSSITSTWTGAYLMKYKEYFSAALDEQRKLMEKHGDKIDHDILSEMDVLYRCIKEALRLHPPLIMLMRASHCDFSVTARDGKTFDIPKGHIVATSPAFANRLPHIFKDPDSYDPDRFSPGREEDKAAGAFSYISFGGGRHGCLGEPFAYLQIKAIWSHLLRNFELELVSPFPEIDWNAMVVGVKGSVMVRYKRRQLS

SEQ ID NO: 46198 - protein, 490 aa, Saccharomyces cerevisiae
MFRIQLRTMSSKTCKSDYPKEFVSFLNSSHSPYHTVHNIKKHLVSNGFKELSERDSWAGHVAQKGKYFVTRNGSSIIAFAVGGKWEPGNPIAITGAHTDSPALRIKPISKRVSEKYLQVGVETYGGAIWHSWFDKDLGVAGRVFVKDAKTGKSIARLVDLNRPLLKIPTLAIHLDRDVNQKFEFNRETQLLPIGGLQEDKTEAKTEKEINNGEFTSIKTIVQRHHAELLGLIAKELAIDTIEDIEDFELILYDHNASTLGGFNDEFVFSGRLDNLTSCFTSMHGLTLAADTEIDRESGIRLMACFDHEEIGSSSAQGADSNFLPNILERLSILKGDGSDQTKPLFHSAILETSAKSFFLSSDVAHAVHPNYANKYESQHKPLLGGGPVIKINANQRYMTNSPGLVLVKRLAEAAKVPLQLFVVANDSPCGSTIGPILASKTGIRTLDLGNPVLSMHSIRETGGSADLEFQIKLFKEFFERYTSIESEIVV

SEQ ID NO: 46199 - protein, 295 aa, Methylococcus capsulatus str. Bath
MFPTIESFVGNTPLVRLQRLPGDTANFILAKLEGNNPAGSVKDRPALSMIRCAEARGDIQPGDRLIEATSGNTGIALAMAAAIKGYRMTLIMPDNMSAERRATMKAFGAEIILTPAAGGMEAAIDLARAMEARGEGKILDQFSNSDNPRAHYEGTGPEIWRDSQGRVTHFVSSMGTTGTIMGTARYLKERNPAIQIIGVQPKDEARIPGIRRWPQEYLPKIYDPSLVDRILDVTQEEAESTTRELAAQEGIFAGISSGGAVAAALRLSREVENAVIAVIICDRGDRYLSTGVFPE

SEQ ID NO: 46200 - protein, 470 aa, Corynebacterium glutamicum ATCC 13032
MEMVMKNKRVAIIGAGPSGIAQLRAFESAEKQGHEIPELVCFEKQDTWGGQWNYSWRTGTDSYGEPVHSSMYRNLWSNGPKEVLEFAEYSFDEHFGKPISSYPPREVLWDYIAGRAKKSNVEKYIKFAHVVRWVSFDEATKLFTVTVENLRTGETSSDTYDNVIVGAGHFSFPNVPHFDGVETFPGQIMHAHEFRGAEAVADKDILLIGASYSAEDIGTQAYKMGARSVTFSYRSNPMGYEWPEEMTELPLVERFDGSEVHFVNGEKRKVDIVVFCTGYLHHYPFMPSELTLSSPNNLYPDTLYRGVVSEANNQLFWLGAQDQWLTFNMFDAQAWYVRDVILGRVALPSKEAQRNHMDKWLSRFEGLKSENDQIDFQCDYVEDLIDQTDYPSFDLKEVANILKGWVKSKEEDILNYRDYTYTSVMTGTTSVEHHTPWMIELDDSLERYLSEPQEDEARQVYRGKKVRDKA

SEQ ID NO: 46201 - protein, 267 aa, Yersinia pestis CO92
MSIPVFGLGTFRLQDQIVIDSVSQALTLGYRAIDTAQIYENEAPVGQAIQESGINRDELFITTKIWIANLSKDKLIPSLRESIQKLKTDYVDLTLIHWPSPNDEVSVAEFMSELLKAKGLGLTRQIGISNFTIDLMKQAIAAVGAEEIATNQIELSPLLQNRNVVDFAKQNGIAVTSYMTLAYGKALAEPVIKTIAEQHGATPAQVILSWAMQLGYGVIPSSTKAANLASNLLAQKLCLNAADMALIATLDRNERLVSPDGLAPKWD

SEQ ID NO: 46202 - protein, 573 aa, Trichoderma atroviride
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 46203 - protein, 224 aa, Vitis vinifera
MVLAASGIEHEEFLSIAEPLVSDLPSVPRPEEPKFVYVGGDYRCQAYSGITHLVLAFEVPGGWHNEKEAITLTVLQILMGGGGSFSTGGPGKGMHSRLYLRVLNEYQQLQSFSAFNNIFNNTRIFGIYASTGSDFVAKAIDIAVGELLSIVSPGQVDQVQLTRAKEATKSAVLMNLESRMIASEDIGRQILTYGERKPLEHFLKAVDEIKALTFLVYSTAKWVI

SEQ ID NO: 46204 - protein, 128 aa, Zea mays
MTVEAVNPKAYPLADSQLAITILDLVQQATNYKQLKKGANEATKTLNRGISEFVVMAADAEPLEILLHLPLLAEDKNVPYVFVPSKQALGRACGVTRPVIACSVTSNEASQLKSQIQQLRDAIEKLLI

SEQ ID NO: 46205 - protein, 313 aa, Leifsonia xyli subsp. xyli str. CTCB07
MSVTVLGSANLDLVYRVERIPSPGETVLAAGAVPVGKGNNQVTAVARSGADATFIAALGKDAAAERLIASLTESGVALCLRRVDEPTGTAVIKVDEGAENAIVVDAGANGELLRLTSGEREAIAAADALLMQLETPVETVTEAALAARAAGTAVVLNAAPIPPVPAELMQAVDLLIVNEHEAARLAAAVADAPDPADEEAVATVLSGLGLAVIVTLGARGALVCVPGEPVEPVPGLRVDAVDTTGAGDTFCGALLAELDRSGAFVDAGGDLRRSALVAAAAFATAAAALSVQCPGAVLSIPTLEEIHDFRSSR

SEQ ID NO: 46206 - protein, 176 aa, Triticum aestivum
  misc_feature (127)..(127): Xaa can be any naturally occurring amino acid
MAPTVMASSDTSVAPFQGLKSTAGLPVSRRSNGASLGSVRNGGRIRCMQVWPIEGVKKWDTLSYLPPLSTEALLKQVDYLIRSKWVPCLEFSKVGFIFREHNASPGYYDGRYWTMWKLPMFGCTDAXTQVINEVEEVKKEYPEAYVRIIGFDNMRQVQCVSFIAFKPPGCEESGKA

SEQ ID NO: 46207 - protein, 541 aa, Prochlorococcus marinus str. MIT 9211
MPQIPSSSNIKKPGGVAPVVLAILDGWGHSEKFEDNAIKNADTPIMDALWQAYPHTLIEASGADVGLPDRQMGNSEVGHLTIGAGRIIQQELVRITNTVRSNKLFEIDALKDLAELLKANKKTLHIIGLCSDGGVHSHINHLCGLLDWSSNQGIQKVAVHAFTDGRDTPAQSAKKYLEIITEKLNSSDIGELTSLCGRYWAMDRDNRWERTSKAYELLTNPNFPICDSSPEELIANSYQEGVTDEFLEPVRFKRSYIENGDGVIMFNFRPDRARQLIKAISLPDFDQFAREYTPKPNVLTFTQYEANLPVSVAFPPESLEDLLGEVISKHGLLQYRTAETEKYPHVTYFLNGGIEKPLPGEHRHLVPSPRVATYDMTPAMSADILTESCLKAIESGLYSLIVINYANPDMVGHTGVMEAAKEAINKVDTCIGRILDSTGKMSGTLLITADHGNAEVMKGADGQPWTAHTTNPVPVIIIEGEKRKLSGEGNSIQLRQGGGLADIAPTVLQLLSLPKPKVMTGSSLIENIETPTIPSRVTQTA

SEQ ID NO: 46208 - protein, 453 aa, Oryza sativa Japonica Group
MASYDKAIESYKRAVTTAASLAASAMLVRGVVNELVPYEVRDLLFSGVGYLRSRMSSQHMVIIEETEGWTNNQLYDAVRTYLATRINTDMQRLRVSRDNSSSSNGNGNGRGGNGNYRLEVRSFEMSFHKKHKDKALNSYLPHILATAKKIKDQDRTLKIYMNEGESWFAIDLHHPSTFTTLAMDHKQKQSVMDDLERFIKRKEYYKKIGKAWKRGYLLYGPPGTGKSSLIAAMANYLKFDVYDLELTEVNWNSTLRRLLIGMTNRSILVIEDIDCTLELQQREEGQESSKSNPSEDKVTLSGLLNFVDGLWSTSGEERIIVFTTNYKERLDPALLRPGRMDMHVHMGYCCPESFRILASNYHSIDNHATYPEIEELIKEVMVTPAEVAEVLMRNDDTDVALEGLIQFLKRKKDVGKEGKAENVEQVVKAEETEKGMMKKNDVPENQDPQDASK

SEQ ID NO: 46209 - protein, 468 aa, Clostridium perfringens ATCC 13124
MKDVKVLKKEYENAWTKYEEADLKQVFSLSDRYREFMSVAKTERECVKVLAHMAESKGFKNFYEVIKNGEKVTAGDKLYSINMDKTITLIKVGSEPLEKGLRIIGAHIDSPRMDVKQNPLYEDSGLALLDTHYYGGVKKYQWVTIPLAIHGVVVKKDGTKVDIKIGEDENDPVLGISDLLIHLSADQLDKKGAKVVEGEDLNILVGSMPLKGTEEKEAVKANILVLLNEKYGITEEDFVSAELEVVPAGKARDYGLDRSMILAYGHDDKICAYTSAEALMDLENVDKTCVALLVDKEEIGSVGATGMQSRFFENIIAELMDRKGEYSELKLRRCLQNSMMLSADVTAAFDPNYPSVCEKKNTAYFGHGVVFSKYTGARGKAGCNDANAEYIAHLRNIMDKNGVVWQTGELGKVDQGGGGTIAYILAQYNMEVIDCGVALQNMHAPLEVASKADLYETKKCYKAFFEEA

SEQ ID NO: 46210 - protein, 362 aa, Exiguobacterium sibiricum 255-15
MSKRTLILEDGMVFEGEAFGSSEVTMGEVVFQTGMTGYQEMLSDPSYCDQMIVLTNPLIGNYGMNRDDYETTRPLAKALIVREVCHTPSNFRSQTSLATALEEFNIPGLTGIDTRQLTRHLRSKGVMRGLLVDGTYDLTEQLERLKQMALATDQVKRASTERAYVIPGAGPRIVLVDFGAKLGIIRELVRRGCEVVVVPHDVTAKDVLRYMPDGVMLSNGPGNPKDVPTAIPLIQELTGQVVIFGICLGHQLIALAHGADTFKLPFGHRGANHPVEDLRTGQVSITSQNHGYAVEDQSLAGLNLKLTHRAINDGTVEGIRHTTHPVFSVQYHPEASPGPMDANDLFDQFLTEITNQQEVSHA

SEQ ID NO: 46211 - protein, 403 aa, Vibrio fischeri ES114
MTIEILVPDLPESVADATVATWHKQPGDAVERDEILVDIETDKVVLEVPAPEAGVLETILEDEGATVLSKQLLARIKPGAVVGEPTTDVTTATESSPDKRHTASLSEESNDALSPAVRRLLGEHDIAPSDVKGTGVGGRITREDVDAHIAALKAAPKAEKAADKPAEALAHRSEKRVPMTRLRKTVANRLLEAKNSTAMLTTFNEVNMKPIMDLRKQYKDQFEERHGTRLGFMSFYVKAVTEALKRYPEVNASIDGDDIVYHNYFDISMAVSTPRGLVTPVLKDCDTLGFADIEKGIKELAIKGRDGKLAVEDLMGGNFTITNGGVFGSLMSTPIINPPQAAILGMHKIQDRPMAVDGKVEILPMMYLALSYDHRLIDGRESVGFLVTIKELLEDPARLLLDV

SEQ ID NO: 46212 - protein, 388 aa, Vibrio fischeri ES114
MNLHEYQAKQLFAEFGLPVPEGYACDTPQEAFEAAGRISTAKKVVKCQVHAGGRGKAGGVELHDTKEGVKEFAQKWLGKNLVTFQTDANGQPVSKILVEEASNIANELYLGAVVDRASQRIVFMASTEGGVDIEKIAEETPELIHKAAIDPLVGPQAYQGRELAFKLGLEGDQIKQFVKIFMGLGNMFAQYDLALLEINPLVVTAEGSLLCLDGKINIDSNAMYRQPKLREMHDPSQEDEREAHAAQWELNYVALDGSIGCMVNGAGLAMGTMDIVNLHGGQPANFLDVGGGATKERVTEAFKIILSDSNVKAVLVNIFGGIVRCDLIADGIIGAVEEVGVEVPVVVRLEGNNAPLGSQKLAESGLNIIAATSLTEAAEKVVAAAEGK

SEQ ID NO: 46213 - protein, 488 aa, Prochlorococcus marinus str. MIT 9211
MAPAATASTGTKGIVRQVIGPVLDVEFPAGKLPKILNALRIEGKNPAGQDIGLTAEVQQLLGDHRVRAVAMSGTDGLVRGMEAVDTGAPISVPVGEATLGRIFNVLGEPVDEQGPIKSSTTSPIHRSAPKLTDLETKPKVFETGIKVIDLLAPYRQGGKVGLFGGAGVGKTVLIQELINNIAKEHGGVSVFGGVGERTREGNDLYEEFKESGVINADNLTESKVALCFGQMNEPPGARMRVGLSALTMAEHFRDVNKQDVLLFIDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPAVVGDEHYRTARAVQSTLQRYKELQDIIAILGLDELSEEDRKTFDRARKIEKFLSQPFFVAEIFTGMSGKYVKLEETIAGFNMILSGELDNLPEQAFYLVGNIEEVKAKAQKINSENKG

SEQ ID NO: 46214 - protein, 119 aa, Zea mays
MDYGPSDSSGTDDDLPQLPHRSIRGSGRVSGNGRTIVPAGSYARAPTDMEAQIQQLEQEAYCSVLRAFKAQSDAITWEKEGLMTELRKELRVSDKAHRELLNKVNNDNIICSIREWRST

SEQ ID NO: 46215 - protein, 215 aa, Klebsiella pneumoniae subsp. pneumoniae MGH 78578
MDLTQFKEQITAMNKKADFYHVDIMDGNYVRNITLSPFFIENLKKITTVPIDVHLMVNHPEDIIPMCLEAGADIISFHPETANNKIFRLLNQIKDAGKKCGVVLNPATPAESIAEYAHLLDKVTVMSVDPGYAGQKFIPESLNKIRKLINMRKNNGYHYLTEIDGSCNEKTFGQIAESGVDVFIVGTSGLFSLHEDVSQAWDRMIEIFQRETVAA

SEQ ID NO: 46216 - protein, 1080 aa, Saccharomyces cerevisiae
MSNYYRRAHASSGSYRQPQEQPQYSRSGHYQYSNGHSHQQYSSQYNQRRRYNHNDGTRRRYNDDRPHSSNNASTRQYYATNNSQSGPYVNKKSDISSRRGMSQSRYSNSNVHNTLASSSGSLPTESALLLQQRPPSVLRYNTDNLKSKFHYFDPIKGEFFNKDKMLSWKATDKEFSETGYYVVKELQDGQFKFKIKHRHPEIKASDPRNENGIMTSGKVATHRKCRNSLILLPRISYDRYSLGPPPSCEIVVYPAQDSTTTNIQDISIKNYFKKYGEISHFEAFNDPNSALPLHVYLIKYASSDGKINDAAKAAFSAVRKHESSGCFIMGFKFEVILNKHSILNNIISKFVEINVKKLQKLQENLKKAKEKEAENEKAKELQGKDITLPKEPKVDTLSHSSGSEKRIPYDLLGVVNNRPVLHVSKIFVAKHRFCVEDFKYKLRGYRCAKFIDHPTGIYIIFNDIAHAQTCSNAESGNLTIMSRSRRIPILIKFHLILPRFQNRTRFNKSSSSSNSTNVPIKYESKEEFIEATAKQILKDLEKTLHVDIKKRLIGPTVFDALDHANFPELLAKRELKEKEKRQQIASKIAEDELKRKEEAKRDFDLFGLYGGYAKSNKRNLKRHNSLALDHTSLKRKKLSNGIKPMAHLLNEETDSKETTPLNDEGITRVSKEHDEEDENMTSSSSEEEEEEAPDKKFKSESEPTTPESDHLHGIKPLVPDQNGSSDVLDASSMYKPTATEIPEPVYPPEEYDLKYSQTLSSMDLQNAIKDEEDMLILKQLLSTYTPTVTPETSAALEYKIWQSRRKVLEEEKASDWQIELNGTLFDSELQPGSSFKAEGFRKIADKLKINYLPHRRRVHQPLNTVNIHNERNEYTPELCQREESSNKEPSDSVPQEVSSSRDNRASNRRFQQDIEAQKAAIGTESELLSLNQLNKRKKPVMFARSAIHNWGLYALDSIAAKEMIIEYVGERIRQPVAEMREKRYLKNGIGSSYLFRVDENTVIDATKKGGIARFINHCCDPNCTAKIIKVGGRRRIVIYALRDIAASEELTYDYKFEREKDDEERLPCLCGAPNCKGFLN

SEQ ID NO: 46217 - protein, 175 aa, Ralstonia solanacearum GMI1000
MSFNNVSPGKDIPNDFNVIIEIPAQSDPVKYEADKETGLLHVDRFVGTGMRYPANYGFIPQTLAGDGDPVDVLVVTPFPLVHGCVVRCRTLGMLKMTDESGQDAKLVAVPVNKLSPATAHMTDLSDIGQNLLDQIKHFFEQYKALEPGKWVKVEGWGGIEEAHKEIVDGVANYKK

SEQ ID NO: 46218 - protein, 478 aa, Ralstonia solanacearum GMI1000
MHAQHFIANRLMAADSGLRIKVFDPSDGQPFAEIARGNATDISVAVHAARRAFDGIWGRLAPAERGRLLMRVALRLADHEEELARLEARDTGKPMRQARADARAIARYFEFYAGAADKLHGQTIPYQPDTTVLTVREPHGVTAHIIPWNYPMQIFGRSVGAALAVGNACVVKPAEDACLSILRVAELAAEAGLPDGALNVVTGYGHEAGAALAAHPGINHVSFTGSPETGKLIVRAAAENHVPVTLELGGKSPQILFADADLDAAIPAVVSGIVQNAGQTCSAGSRVLIERGLYETVLDRLASVFEAIKVGPSTLDLDCGPLINPRQQQRVWDFVSDAQHANIPVMAQGLVVPEAPETGYYQAPMLLRDVPPTHRLAQQEVFGPLLAAMPFDGEAEALALANGTPYGLVAAVWTRDGARQLRLARALKAGQVFINNYGAGGGVELPFGGTGQSGHGREKGFEALYGFTTVKTIAIRHG

SEQ ID NO: 46219 - protein, 231 aa, Saccharomyces cerevisiae
MSEFLNENPDILEENQLPTRKEDSTKDLLLGGFSNEATLERRSLLLKIDHSLKSQVLQDIEVLDKLLSIRIPPELTSDEDSLPAESEDESVAGGGKEEEEPDLIDAQEIYDLIAHISDPEHPLSLGQLSVVNLEDIDVHDSGNQNEMAEVVIKITPTITHCSLATLIGLGIRVRLERSLPPRFRITILLKKGTHDSENQVNKQLNDKERVAAACENEQLLGVVSKMLVTCK

SEQ ID NO: 46220 - protein, 417 aa, Prosthecochloris aestuarii DSM 271
MEVSLFAALIGGIIVLGVVGDFLFAKSKIPTPVILMLAGIILGPVTNIFTSDIFFEIAPYFGTFALILILFEGGLDLEFDLVIRQFSSALLLGFLSFILSCAGITAVCLIQLQMDMSQALLYGFIFSGTSPAVILPILSRLSITKNLKTLLTLEAVISEVLTVISVIIMINILREPGHFDPRLIVQHISASIGISIVLALLSGIIWSRFMGYFSRQNLAYMLTLGVVLLLYTLTAFLGGEPAITVLAFGILLGNGKHLATKTQNLMARMNSTINVTNFELDEVVKKINAELTFLVRTFFFVFIGLLFNFTLFTPNVLSTAGTILAIFLISRYATVTMVRPLSPSLRSAHTSSTLGLIPRGLATAVMAFLVIDAKITPSDQLLPVVFSVILGSNLLMSGFVYYYQSRHSNREEQEKSA

SEQ ID NO: 46221 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAMVLPLELTVCGFTVGYWNQDITVWITTFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEDKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 46222 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRREVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTLLFSR

SEQ ID NO: 46223 - protein, 238 aa, Triticum aestivum
DLGGSLGRDAATGRGVMYATEALLAEYGKSISGSTFVIQGFGNVGSWAAQLIHEKGGKVIALGDVSGTIRNKAGIDVPALMKHRNEGGQLKDFHGAEVMDASELLVHECDVLLPCALGGVLNRENAPDVKAKFIIEAANHPTDPEADEILTKKGVVVLPDIYANAGGVIVSYFEWVQNIQGFMWEEEKVNMELHKYMNSAFQNIKAMCKSQDCNLRMGAFTLGVNRVARATILRGWEA

SEQ ID NO: 46224 - protein, 397 aa, Burkholderia thailandensis E264
MSQVKRLTDLIAEGKLSGKRVFIRADLNVPQDDHGNITEDTRVRASVPAIQAALDAGAAVMVTSHLGRPTEGEFTPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAVATVKKVADIEADDMILDIGPETAKALAGQLEKAGTIVWNGPVGVFEFDQFGNGTKTLADAIANSAAFSIAGGGDTLAAIAKYGIHDKVSYISTGGGAFLEFLEGKKLPAVEVLETRA

SEQ ID NO: 46225 - protein, 334 aa, Prosthecochloris aestuarii DSM 271
MTKVKVGINGFGRIGRLVFRQALANDKIEITAINDLCDTKTLAHLLKYDSTHGVFNAEVSVEDDKLIVNGKSILICSEKDPAQLPWKELGIDLVVESTGLFTKRAAAAKHLEAGAKKVIISAPAKDAVDATIVVGVNDDIITGEEEIISNASCTTNCLAPMAKVLEDNFGIEKGFMTTVHAVTNDQRILDLPHSDLRRARTAMSSIIPTSTGAAKAIGLVVPELAGRLDGMAMRVPVPDGSVTDLTVILKKPATKEEINAAIQAAAEGNMRGVLEFCTDPIVSQDIVGNANSCIFDSLLTMSTGTMVKVVGWYDNELGYSTRVIDLLEIYSHFV

SEQ ID NO: 46226 - protein, 468 aa, Corynebacterium glutamicum ATCC 13032
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 46227 - protein, 541 aa, Medicago sativa
MAIEMSSIVSKLSMLSTSDHASVVSMNLFVALLCACIVLGHLLEENRWMNESITALLIGICTGVVILLFSGGKSSHILVFSEDLFFIYLLPPIIFNAGFQVKKKQFFVNFMTITSFGAIGTLISCVIITTGATFAFKRMDIGPLEIGDYLAIGAIFAATDSVCTLQVLNQDETPLLYSLVFGEGVVNDATSVVLFNAIQSFDLNQLNPSIALHFLGNFLYLFVASTLLGVVTGLLSAYVIKKLYIGRHSTDREVALMMLMAYLSYMLAELTYLSGILTVFFCGIVMSHYTWHNVTQSSRITTKHSFATLSFVAEIFIFLYVGMDALDIEKWKFVSDSPGTSIAASSVLLGLILLGRAAFVFPLSFLSNLTKKSQHQKISFRQQVIIWWAGLMRGAVSMALAYNQFTMSGHTQLRSNAIMITSTITVVLFSTVVFGLLTKPLIRLLLPHPKITSSMTTTESTTPKSFIVPLLGDSRDSEADLEGHEIHRPNSLRALLSTPTHTVHRLWRKFDDSFMRPVFGGRGFVPVEPGSPSERNGNQWG

SEQ ID NO: 46228 - protein, 462 aa, Listeria monocytogenes EGD-e
MFKTNVEQNNVPVFGSFESGQDLPEKRMNKESVDPRIAYQLVKDQLIDEGSARQNLATFCQTYMEPEAEQIMAETMEKNAIDKSEYPQTAKLESSCVNMLADLWNVDESEHYMGTSTVGSSEACMLGGMAMKFRWRSAALKNGLDIHAKKPSLVISSGYQVCWEKFCVYWDIELREVPMSEEHLSINTDIIMDYVDEYTIGIVGILGITYTGKFDDIMTLNDLVEDYNNTHDNEVVIHVDGASGAMFTPFVEPGLEWDFRLPNVVSINTSGHKYGLVYPGVGWILWRDKEYLPEELVFDVSYLGGHMPTMAINFSRSASQIIGQYYNFLRFGYEGYRQIHMRTRDGALQLSQAVAETGLFEIYNDGANLPIVCYKLKDDANVAWTLYDLADRLQMKGWQVPAYPLPKEMGNTIIQRYVCRGDLGQNMVTAFKNDLSESIEELNNAHILYHDVNTSKTHGFTH

SEQ ID NO: 46229 - protein, 465 aa, Desulfitobacterium hafniense DCB-2
MNIGKIVQIMGAVVDVEFASEALPEIYSAVKVTVPEKKIDLTLEVAQHLGNNTVRCVAMSSTDGLQRGMAALNTGAPITVPVGPATLGRIFNVLGKAIDNGEEVHTDTSYPIHRPAPAFVDQDPSTVMLETGIKVIDLLAPYSKGGKIGLFGGAGVGKTVLIQELINNIAMEHGGLSVFAGVGERTREGNDLWNEMRESGVIDKMAMVFGQMNEPPGARLRVGLTGLTMAEYFRDVQNQDVLLFIDNIFRFTQAGSEVSALLGRMPSAVGYQPTLATEMGALQERITSTRNGSITSVQAIYVPADDLTDPAPATAFAHLDATTVLNRAISEKGIYPAVDPLDSNSRILSPQILGEEHYKVARDVQQILQKYKELQDIIAILGMDELSEDEKLVVSRARRIERFLSQPFHVAEVFTGSPGKYVPIKETIRGFKEIVEGKHDNLPEAAFHMVGTIEEAIEKAKALGA

SEQ ID NO: 46230 - protein, 426 aa, Leifsonia xyli subsp. xyli str. CTCB07
MAAIEAVGAREILDSRGNPTVEVEVLLEDGTVSRAAVPSGASTGAFEAYELRDGDKGRYLGKGVEKAVDAVLDEIGPAIEGFEASDQRIVDEAMIELDGTDNKKRLGANAMLGVSLAVAKAAADSADLPLFRYLGGPNAHVLPVPMMNIINGGAHADTGVDIQEFMILPIGAETFSEGLRWGVETYHSLKALLKSKGLNTGLGDEGGFAPELEHNRAALDLIAEAIEKAGFTVGSQIALGLDVASTEFFENGVYRFEGQDRTAAEMSAYYTDLANNYPLVSIEDPLAEDDWEGWAHLNAEIGSTLQLVGDDLFVTNPKRLAQGIQQKAANSILVKVNQIGTLTETLDAVSLAQRSGMTAVLSHRSGETEDTTIADLAVATDSGQIKTGAPARSERVAKYNQLLRIEEELGEAAVYAGRSAFPRYQG

SEQ ID NO: 46231 - protein, 793 aa, Arabidopsis thaliana
MSNESTNCSFFLNLFMLLLLLIFYSADACQRECGGISIPYPFGIGKDCCLEKYYEIECRNTTSRKLVPLLSFINKEVVSISLPSADSHFAYEVSDQERHESFGLVRVKFPITSAGCFNDGKESGGGSKMNFTGSPFFIDRSNSLIAAGCNSKVSLMYIKPKMVGCELSCNTSKDSYSNSIPFVEAGCSSNVLPYSQDQGCPEEIAEETGCNGIGCCQASLPNEPQQVIGIRTENNDGNSTTKVECTVSAFLTDEIYALPKATKTEHLLAKRYATVSLGWVIQTSNRSFLDSLALACKDREDYRNTTNLERKCTCGRITISETSYANCGCTYGYTGNPYVLNGCKDIDECKVKFEYCGKTETCVNFEGGYRCVRDKTKAIMIGAGTGFGVLVLVGGLWWLRKFLIKRRITKRKKKFFKRNGGLLLLQELNTREGYVEKTRVFNSRELEKATENFSENRVLGHGGQGTVYKGMLVDGRTVAVKKSKVIDEDKLQEFINEVVILSQINHRHVVKLLGCCLETEVPMLVYEFIINGNLFKHIHEEESDDYTMLWGMRLRIAVDIAGALSYLHSSASSPIYHRDIKSTNILLDEKYRAKVADFGTSRSVTIDQTHWTTVISGTVGYVDPEYYQSSQYTEKSDVYSFGVILAELITGDKPVIMVQNTQEIVALAEHFRVAMKEKRLTDIIDARIRNDCKPEQVMAVAKVAMKCLSSKGKKRPNMREVFTELERICTSPEDSQVHNRIDEEEEEEEEEEEVVTTINRGDSWSISVTAPALSIVASSPSSDVEPLFPRLTW

SEQ ID NO: 46232 - protein, 112 aa, Beta vulgaris subsp. vulgaris
HVIKIKDIILPPEREKFNDVYIVYELMDTDLHQIIRSNQELTEDHCQYFLYQLLRGLKYIHSANVLHRDLKPSNLLLNANCDLKICDFGLARTTAETDFMTEYVVTSWYAPG

SEQ ID NO: 46233 - protein, 530 aa, Arabidopsis thaliana
MAVSSAFVVTPKLEKLLANHHNPTYSSSPAPLDVIGIRALPMNNRNKRGLIQRARCEISPSNKAASISALEQLKTSAIDRYTKERSSIVVIGLSIHTAPVEMREKLAIPEAEWPRAIAELCGLNHIEEAAVLSTCNRMEIYVLALSQHRGVKEVTEWMSKTSGIPVSEICQHRFLLYNKDVTQHIFEVSAGLDSLVLGEGQILAQVKQVVKVGQGVNGFGRNISGLFKHAITVGKRVRTETNIAGGAVSVSSAAVELALMKLPESSHASSARMLVVGAGKMGKLVIKHLVAKGCTKMVVVNRSEEKVAAVRNEMPPGVEIIYKPLDEMLSCAAEADVVFTSTASETPLFLKEQVETLPPVRDARLFVDISVPRNVGSCVAEIDGTRVFNVDDLKEVVAANKEDRVRKAMDAQAIITDESKHFEAWRDSLETVPTIKKLRGYTERIIAAEIEKSLPKMGIDMNKKMRKTVDDLIRGIVNKLLHGPMQHLRCDGNDSRTLSETLDNMQALNRMYGLDAEILEEKIRAKVEKK

SEQ ID NO: 46234 - protein, 510 aa, Bradyrhizobium sp. ORS278
MKDILDTLEERRKGAKLGGGEKRIEAQHARGKLTARERIELLLDKGSFEEFDMFVEHRSTEFGMEKTKVPGDGVVTGWGTVNGRKTFVFAKDFTVFGGSLSETHALKITKLQDMAMKARAPIIGLYDAGGARIQEGVAALAGYSYVFRRNVLASGVIPQISVIMGPCAGGDVYSPAMTDFIFMVKNTSYMFVTGPDVVKTVTNEVVTAEELGGASVHATRSSIADGAFDNDVETLLQMRRLIDFLPSNNSDGVPEWPSFDDIERVDMSLDTLIPDNPNKPYDMKELILKVVDEGDFFEIAEGFAKNIVTGFGRIAGRTVGFVANQPMVLAGVLDSDASRKAARFVRFCDAFNIPIVTFVDVPGFLPGTAQEYGGLIKHGAKLLFAYSQCTVPLVTVITRKAYGGAFDVMASKEIGADMNYAWPTAQIAVMGAKGAVEIIFRADMADPEKIAARTKEYEDRFLSPFIAAERGYIDDVIMPHSTRRRIARALAMLRDKKMEMPAKKHDNLPL

SEQ ID NO: 46235 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMTFFYSELALVQYAMLVYPPSVTAAAAVYAARSTLGMNPQWTDILEHHTGLAEPQLLDCARRLISFHALAPESKQKAVYRKYSKPKLGSVALQSPDKKLLSG

SEQ ID NO: 46236 - protein, 569 aa, Vitis vinifera
  misc_feature (121)..(121): Xaa can be any naturally occurring amino acid
  misc_feature (150)..(150): Xaa can be any naturally occurring amino acid
  misc_feature (241)..(241): Xaa can be any naturally occurring amino acid
  misc_feature (384)..(384): Xaa can be any naturally occurring amino acid
  misc_feature (541)..(541): Xaa can be any naturally occurring amino acid
  misc_feature (562)..(562): Xaa can be any naturally occurring amino acid
MTGFEGFSGHDERRERKSDFENSEDERRTRIGSLKKKAINASTKFKHSLKKKSSRRKSDGRVSSVSIEDVRDVEELEAVDAFRQALILDELLPTKHDDYHMMLRFLKARKFDIEKAKHMWXDMIQWRKDFGADTILEDFEFKELNEVLKXYPHGHHGVDKEGRPVYIERLGKVDPYKLMQVTTMDRYVKYHVQEFEKSFALKFPACTIAAKRHIDSSTTILDVSRRGMLSGFKNLTKAARXLIMRLQKIDGDNYPEVLGNKYQNKLLEIIDASELPEFLGGTCTCADQGGCLRSDKGPWNNPDILKMMHNGDARRARQVVKVLNSEGKVIAYAKPQYPMMKGSDTSTAESGSEAEDIASPKMTKSYSQLRLTPVREEAKVVGKXSYAGSFGGYDEYVPMVDKAVDAGWKKQAALQRPSSSKECDHDENIPQLAPDATHKEDFRPPSPIPAFTEADLLSSVLKKLSELEEKVDTLQAKPSEMPYEKEELLNAAVCRVDALEAELIATKKALHEALLRQEELLAYIDSQEEAKFRKSNLEHNXDERALNVQSTRFLSRMMCLCXDILSNDL

SEQ ID NO: 46237 - protein, 223 aa, Exiguobacterium sibiricum 255-15
MSISENVQQVRQNMKQAYEKTDQKKQVQLIGVTKSVSSEVAAELLAAGITALGENRPEGLTDKQTVLGREACEWHFIGTLQTRKVRQVIDRIDVLHSLDRLHLAEEINKRAKQPVDCFVQVNVSGEESKQGIDPEDVHSFLHEVGQYPMVRVIGLMTMAPLTEDEQVLRSVFRSLRVLRDEVATRQLPHAPCTELSMGMSSDYQIAIEEGATYVRIGTTLVQS

SEQ ID NO: 46238 - protein, 721 aa, Vibrio fischeri ES114
MSRTIMLVPISAGVGLTSASLGVLRSMERKGVSVSFYKPISQPRHGGDQPDLTTSIVTSSSDIKAAEPTTISRAEELLRNEQSDVLLEEIVARYKSISQGTDVTLIEGLVPTRKHPFANQLNGEIAKTLGAEIVFVATPGTDNPSQLKERIEVACSNFGGTKNKQIAGVIINKLNAPVDEAGRTRPDLSEIFDDADATTKTNLEVMQIFNSSPIRVLGCVPWKVDLIATRAIDMAKHLNAEIINEGDIATRRIKSITFCARSLPHMIEHFKPGSLLVTSADRPDVIVAACLAAMNGVEIGAILLTGGYEIPQSIAELCKPALESGLPIFTAQGNTWQTSLNLQSFSLEVPADDKERIEFVNEHVASHIDGPWIDSLSEGTEGIRRLSPPAFRYQLTEFARKAAKRIVLPEGDEPRTVKAAAICAERGIATCVLLGNPEEIRRVAAQQGVELGAGVEIIDSDSVRENYVARLVELRGAKGMTEVVAREKLQDSVFLGTMMLEAGEVDGLVSGAVHTTANTIVPPFQIIKTAPDASIVSSIFFMLLPDQVLVYGDCAINPDPTAEQLAEIAIQSADSAMAFGIDPRVAMISYSTGESGKGADVDKVREATKIAQEKRPDLVIDGPLQYDAAIMENVAASKAPNSPVAGKATVFVFPDLNTGNTTYKAVQRSADLVSIGPMLQGMRKPVNDLSRGALVDDIVYTVALTAIQADQAAQAEEKVIN

SEQ ID NO: 46239 - protein, 91 aa, Zea mays
  misc_feature (24)..(24): Xaa can be any naturally occurring amino acid
  misc_feature (75)..(75): Xaa can be any naturally occurring amino acid
MEQTFIMIKPDGVQRGLIGDMISXFEKKGFYLKGMKLMNSERAFAQQHYADLYDKPLFTRLNRYIMSGPVVAMVXEANDIMLTGRRIIGAT

SEQ ID NO: 46240 - protein, 252 aa, Ralstonia solanacearum GMI1000
MRLAGKIAIVTGAGSGFGEGIATTFAREGARIIVNDLNIEAGERVASAIRVAGGDAHFVHADVSDGEAVASLLAATLERYGDLDIVVNNAGTTHRNKPVLEITEHEFDRVFAVNVKSLYWTARHMVPHFRARGGGVFVNVASTAGVRPRPGLVWYNASKGAVITASKAMAAELGPDRIRVNCVNPVMGATGLLEQFMGMPDTPENRARFLASIPMGRLSTPQDVANACLYLASDEAEFITGACLEVDGGRCV

SEQ ID NO: 46241 - protein, 507 aa, Oryza sativa
MAAARAHVKDPAHRTKVVLRRLPPAIAQQAVVEQVDARFGGRYDWSCFRPGNASQKNHRYSRLYLNFKGPEDVVEFAEVFNGHVFVNEKGAQFKALVEYAPSQQVPKSNTKKDARQGTIMKDPEYLEFLESISKPAEHLPSAEIQLERKEAERAAAGKEPPVVTPLMVYVRQQRAAKSMAQRSGSSRLSRKVAGVVTSSPSPSKRGSEKRRTSASTQYVLRENAKEKPTYILVPKRDEHAQREKDATSGGISGSAHVAENKKEKIVLLKGRARVDSNTSDVTSQQQSGTPMKNAAQSSSRQDPRLEGSGRIIKTILSNKEGRHVVTSQHDQEGHIITAEKRPPRIPNPRSVVKDQVVENAEKNHLDDKHSHLHGSGLISEKTERHARNRDRPDRGVWAPRRYDKSASGGTHSSSSEFSPMQQHSGENFCQQADGHGERKIDPRGHGGIRGGPVENGHRHANRRGPPRGLKEMEISASTSDGKPSKRASANYGAHERQVWVQKSSSAT

SEQ ID NO: 46242 - protein, 517 aa, Triticum aestivum
MEAHMAAARPPTHHHSHSHSHTHQQQQQKAANLARTFTKLLRRKRSDSAAAGAGPKETVDAPPSVTGDDYDSSMDATTPTTATAPTMPSLSKLKLSGNLAAAYSLDAFFRNAAEKKAAGAPQQQPSPPAAATVAAADSLLANLFAGVSAVKAAYAQLQLAQFPYDAEAIQSADAAVVAELTRLSDTKRRFLNTALSAHAEEQRHLLKTYQITARKLEAELRAKDAELDRAKGSLDAELRAERAMEVRLHPGRTLASLDELHVSGLNPTHFLTALRHAVKSIRSFSKSMLSSMQAAGWDLAAAAAAVHPGVPLRRAGDAKFVFESYVAMKMFANFHRRDFNFSFLDEREFYERRRFFEEFTELKAAPASVFLDVRNTRWSGFGKFLRAKYLSLVHARMETAFFGRQEQRGIVSAGPGFPESSWFAEFAEMARRVWLLHCLFYAVDGGEEEDGASIFQVRTGARFAEVYMESVNEGRTEDAFCTAAEDRTVGFTVVPGFRVGRTVIQCRVYLARPGRRP

SEQ ID NO: 46243 - protein, 421 aa, Pseudoalteromonas tunicata D2
MQRVIIVEDSKVVQQVLRHLAAQWLEIEVDFAWSLREAAGLIKHHKYALALVDLTLPDAPDGEVVKLMMKAAIPTVVLTSAIDEYKRLQMIEMGVIDYVLKDNRDSYLYAIKLLAQLLRNQGSKVLVADDSKTSRNMMRQMLEQLLYQVVEAADGEEALEMLCEDNSIKLLLTDFAMPKMDGFELAKAIRHRRGRDELAIIGISASGSQSLSAKFIKYGANDFLIKPFMPEEFHCRVMQTMEQLNMIGKIKDAANRDYLTNLYNRRYFYQQAQYKLKHDSKKQTLFLAMLDIDYFKQINDTYGHQAGDEVLVSLSSLLQQHFPETLTARLGGEEFAVVFEAEDNDDANELMDEFRFFISNRMFSFAEQPIAVSISIGIAAVNDAALEHVIQQADLALYDAKGQGRNQVVFFVEQVQCIDEI

SEQ ID NO: 46244 - protein, 705 aa, Vitis vinifera
MNVKSVLLLISLLWLTTASTATPSMAKQNCQERCGDVTIPYPFGIGKDCYLNEWFAVNCNDSFNPPTPYLSHPELNLKLTFVSLAYQLVTVISPMAVYCQDHDRNRSTWKGIDLSKTPFFYSEGNALRVVGCANSVLITRQGTILAGCSSICDNSSSVLSNGCYGINCCKTTVPSNLDFYILNTTWSTNMVTELNCTYAAFGRNFILRGKSSGSGMEYEASSEGEVIWMIKESVEGSDCHKNTVPDGALGNHSYYSCSCPAYQEGNPYLPNGCQVVEVCANCKGRCLTRIDGRFFCDERSLASKFWILGISLGGGLLFLLLGGFWLYKVLRRRRKIKLREQFFQQQLLQHQMSSNEISIENTKIFTFNELKKASDNFNENRILGRGGQGTVYKGMLTDGRIVAIKKSKIVDESQYEQFINEIVILSQLNHRNIVKLLGCCLEIEVPLLVYEFISHGTLFQLIHDENNELPFSWERRLEIATEVAGALAYLHSASSTPIFHRDIKSKNILLDEKYRAKVADFGTSRSVSIDQTHLTTLVRGTFGYLDPEYFRTGQFTEKSDVYSFGIVLVELLTGQKPISSTRTEEERSLASYFILSIEETNLFDILDAQVVKEGGEEEIMAVVNVATQCLNLNGKKRPTMKEVALELERVKSHLPLHVRGHFELAEYIRTEIIGPSDCASSSTGSGLTYRNTPSLNENSSFSNTL

SEQ ID NO: 46245 - protein, 326 aa, Solanum lycopersicum
MSQESLVLRGTMKAHTDWVTAIATPIDNSDMIVTSSRDKSIIVWSLTKDGSQYGVPRRRLTGHGHFVEDVVLSSDGMFALSGSWDGELRLWDLQAGTTARRFVGHTKDVLSVAFSVDNRQIVSASRDKTIKLWNTLGECKYTIQEQDSHSDWVSCVRFSPNNLQPTIVSGSWDRTVKIWNLTNCKLRSTLAGHSGYVNTVAVSPDGSLCASGGKDGVILLWDLAEGKKLYSLDAGSIIHTFCFSPNRYWLCAATESSIKIWDLESKSIVVDLKVDLKQESEMFGTAATDSKTKVIYCTSLSWSADGSTLFSGYTDGLIRVWGIGRY

SEQ ID NO: 46246 - protein, 447 aa, Glycine max
  misc_feature (202)..(202): Xaa can be any naturally occurring amino acid
  misc_feature (218)..(218): Xaa can be any naturally occurring amino acid
MHMNTYSEATTSQPMPPTMDEDLENNTEDCNNAMTPMVRKKSELVVVTNNDSRFQMLRNFMTNLQEVIFGTKLVVLFPAVPLAVVANFYSFGRPWIFAFSLLGLAPLAERVSFLTEQIAYFTGPTVGGLLNATCGNATEMIIALLALHQNKVHVVKLSLLGSILSNLLLVLGSSLLCGGLANLKREQRYDRKQADVNSLLLXLGLLCHLLPLLFKYAXEEADHSIATSTLQLSRASSVVMLLAYAAYIFFQLKTHRKLFDAQEVDDDEEKAVIGFWSAFTWLVGMTLVISLLSEYVVGTIEAASDSWGISVSFISIILLPIVGNAAEHAGSIIFAYKNKLDISLGVAMGSATQISMFVVPLSVVVAWIMGIRMDLDFSLLETGCLAFTIIITAFTLQDGTSHYMKGVILTLCYIVIGACFFVLKTPLIGQSPKASFGVKPSFEAITT

SEQ ID NO: 46247 - protein, 326 aa, Solanum lycopersicum
MAQESLVLRGTMKAHTDWVTAIATPIDNSDMIVTSSRDKSIIVWSLTKDGAQYGVPRRRLTGHGHFVQDVVLSSDGMFALSGSWDGELRLWDLQAGTTARRFVGHTKDVLSVAFSVDNRQIVSASRDKSIKLWNTLGECKYTIQDGHSHSDWVSCVRFSPNTLQPTIVSGSWDRTVKIWNLTNCKLRSTLAGHSGYVNTVAVSPDGSLCASGGKDGVILLWDLAEGKKLYSLDAGSIIHTLCFSPNRYWLCAATESSIKIWDLESKSIVVDLKVDLKHESEMANESGTAPKTKVIYCTSLSWSADGSTLFSGYTDGLIRVWGIGRY

SEQ ID NO: 46248 - protein, 380 aa, Pseudomonas syringae pv. phaseolicola 1448A
MAKRDYYEVLGVERGSSEADLKKAYRRLAMKHHPDRNPDDKASEELFKEANEAYEVLSDASKRAAYDQYGHAGVDPSMGGGGGFGGGAGGANFSDIFGDVFSDFFGGGRGGGGGGRGGAQRGSDLRYTLELNLEEAVRGTNVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGTQGGPTGDLYVVINVREHAIFQRDGKHLFCEVPISFTDAALGGELEVPTLDGRVKLKIPEGTQTGKQFRLRGKGVAPVRGGGAGDLMCHVAVETPVNLSKRQRELLEEFRTSLENDESHSPKASGWFEGVKRFFGDL

SEQ ID NO: 46249 - protein, 218 aa, Pseudoalteromonas tunicata D2
MTQDEMKKAAAWAALEYVEKDSIIGVGTGSTVNHFIDALGTIKGDIRGAVSSSEASTEKLKALGIEIFELNDVDGLSVYVDGADEINPANEMIKGGGAALTREKIVAAVAKKFVCIVDSSKQVDVLGNFPLPVEVIPMARSYVARELVKLGGDPMYRQGVVTDNGNVILDVFNLQISQAKQLEQQINQIVGVVTNGLFAARGADVVIVGTPDGPKILK

SEQ ID NO: 46250 - protein, 78 aa, Triticum aestivum
GAATPRTPRRRPLPPPSAGPALALVDERMSTEGTGLSLGLSNNLLGWILLGVFGLIWSLYTVYTSGLDEDEESGGLSL

SEQ ID NO: 46251 - protein, 294 aa, Bordetella bronchiseptica RB50
MSERVLLAGCGDLGVRVARRLLARGDQVWALRRQPPPAEDGGLRWIAADLTQPATLAGLPGGLTQVVYLPAPGARDPARYREIFVDGLRHLRDALDTAALRRTLFVSSSAVYGEHDGQWVDEHTPPGPLGFNGRSLLEAERSLGAWPGQAVVLRLAGLYGPGRLQLLERLRAGQARAPVDPPHWANRIHIDDAAAAIAHLLRLPAPEPLYLGCDDTPLPLHELYAALATLAGAPPPGEGPAPAQVGSKRLCNARLRASGLQLQWPDSRAGYAALLDGKATLQATIHTTTKRSIP

SEQ ID NO: 46252 - protein, 538 aa, Saccharomyces cerevisiae
MSMPIASTTLAVNNLTNINGNANFNVQANKQLHHQAVDSPARSSMTATTAANSNSNSSRDDSTIVGLHYKIGKKIGEGSFGVLFEGTNMINGVPVAIKFEPRKTEAPQLRDEYKTYKILNGTPNIPYAYYFGQEGLHNILVIDLLGPSLEDLFDWCGRKFSVKTVVQVAVQMITLIEDLHAHDLIYRDIKPDNFLIGRPGQPDANNIHLIDFGMAKQYRDPKTKQHIPYREKKSLSGTARYMSINTHLGREQSRRDDMEALGHVFFYFLRGHLPWQGLKAPNNKQKYEKIGEKKRSTNVYDLAQGLPVQFGRYLEIVRSLSFEECPDYEGYRKLLLSVLDDLGETADGQYDWMKLNDGRGWDLNINKKPNLHGYGHPNPPNEKSRKHRNKQLQMQQLQMQQLQQQQQQQQYAQKTEADMRNSQYKPKLDPTSYEAYQHQTQQKYLQEQQKRQQQQKLQEQQLQEQQLQQQQQQQQQLRATGQPPSQPQAQTQSQQFGARYQPQQQPSAALRTPEQHPNDDNSSLAASHKGFFQKLGCC

SEQ ID NO: 46253 - protein, 337 aa, Zea mays
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYGDIKKAIKAASEGPLKGIMGYVEEDLVSTDFVGDSRSSIFDAKAGIALNDNFIKLVSWYDNEWGYSNRVVDLIRHMFKTQ

SEQ ID NO: 46254 - protein, 339 aa, Burkholderia thailandensis E264
MSASPALSPRRVSVAPMMDWTDRHCRSFHRTISRHAWLYTEMVTTGALIHGDVARHLAFTPDEAPVALQLGGSEPAELAHSARLGERWGYDEINLNCGCPSERVQRGAFGACLMNEPQLVADCVKAMRDAVSIPVTVKHRIGVDAIEDYAFVRDFVGTVASAGCEVFVVHARNAILKGLSPKENREIPPLKYDYAYRLKRDFPQLEIVINGGITTLDEVEQHLRHVDGVMLGREAYHNPYVLAGVDARFYGATEPAPTREAVEAKLVEYCAAELARGTYLGAIVRHALGLYRGVAGARGWRRVLSDSKRLARGDLSIFDEARAHLTSPEEFFEKKALQS

SEQ ID NO: 46255 - protein, 507 aa, Candida albicans SC5314
MLASKKKRTRRIKRQPICEQIPTSNTAFFFTLDIPIMPVNFLTSVVFDGPEVIPYWDQIKEYGPTVLPILLTLAGAKYYFHGATNTWERDMHGKVFMITGGTSGIGAQIAYELGQRGAQLILLTRRTNDQWVAEYIEDLRDKTNNGLIYAEECDLSSLYSIRKFATRWLDNQPPRRLDGVICCAAECIPRGKSRQITMDGVERQIGINYLAHFHLLTLLGPSLRVQPPDRNVRVLIATCSSQNLGDVDLNDLLWSNKRYPATQPWKVYGTSKLLLGLFAKEYQRQLMGYERKDKAPCNVRINLINPGIVRTPSTRRFLSLGTVWGLIIYLILFPIWWLFFKSAEQGAQSFYFALFAPIFMKIEGGNVVQECKIMTKVRKEYTDDDLQQKVFHNTEELIKQIETKSAIERKKHENAKKTPEQKAKERQEELNRKRDLHIKPETPEELESKLNSLRNQIGMGTGISSNEMPLFPDDETLKKVISSKKNASSNNSGGSKSNKSQKKSKKV

SEQ ID NO: 46256 - protein, 99 aa, Prosthecochloris aestuarii DSM 271
MTYTLLSDINKEAAKAYDVLAEAEGVSYRGLFLIDREGIVRYQVVNDLGLGRNVDEVLRMVEALQFTEEFGEVCPANWHKGARTMKPTDEGLKEYFKSE

SEQ ID NO: 46257 - protein, 264 aa, Prosthecochloris aestuarii DSM 271
MAAEEIWDRICAEALREGQREPYMRNFLEQHILRFDRFVDALSMLLSVKLASKHFPPQVLQELFDDFYSRSPEDLDNAVADLTATLQRDPAAVNYFEIMLFLKGYQALQSYRLSHWLWNHDRKSMAYLLQNRMSEVYAVDIHPAARIGKGILLDHATSLVIGETAVVEDNVSILHEVTLGGTGKESGDRHPKVRKSVLIGAGAKILGNVEIGEGAKVGAGSVVLENVPPHYTVAGVPAQIVGRTEVAEPSLDMNQRLQNSRRLE

SEQ ID NO: 46258 - protein, 179 aa, Triticum aestivum
RIITHKESEQAQSWSKIYSEDTKEQSIPVITAWQLNERMYGELQGLNKQETADRFGKEQVHEWRRSYDTPPPNGESLEMCADRAVSYFKDQVVPHLTAGKHVMVAAHANSLRSIIMHLDKLTSQEVISLELSTGIPMLYIFKEGEFIRRGSPVGPSEASVYAYTRNLATYRNTLDSMVQ

SEQ ID NO: 46259 - protein, 199 aa, Neptuniibacter caesariensis
MQVYSIDGITPVVDPTAYVHPTAVLIGDVIIGPGCYVGPNAALRGDFGRLILEEGANVQDTCVLHGFPGTDTVVEKDGHIGHGAVLHGCRIGRNALVGMNAVVMDGAEIGAESIVAACAFVKAAFKCEPRSMLVGSPAKFLREVSDKEIAWKSAGTATYQDLTNRCLTTMEKVEPLTEVEPNRPRMDVGEVKPKYKTEA

SEQ ID NO: 46260 - protein, 292 aa, Bacillus licheniformis ATCC 14580
MKKVRKAIIPAAGLGTRFLPATKAMPKEMLPIVDKPTIQYIIEEAVEAGIEDIIIVTGKSKRAIEDHFDFSPELERNLEEKGKIELLEKVKKASNLADIHYIRQKEPKGLGHAVWCARNFIGDEPFAVLLGDDIVQAEKPGLRQLMDEYEKTLSSVIGVQQVPEDQTHRYGIIDPLTNEGRLYQVKNFVEKPKPGTAPSNLAILGRYVFTPEIFMYLDKQQIGAGGEIQLTDAIQKLNEIQRVFAYDFEGKRYDVGEKLGFIQTTLEFAMQDDELKDSLIPFMQDLLAKEEV

SEQ ID NO: 46261 - protein, 360 aa, Clostridium perfringens ATCC 13124
MDIIGSINTRFLSKSEQSKNEIFNKIDNIVKGGGNIIRMNLSHGKHRDVECCIDYIRSNHKNVKILLDLQGNKIRVANNIYGTFKVNSGDLVYFCSEETYDVYLKNIDRNKLIPLNIKNKFIYNNTFKKIYMKDATMEFIVISNNNGLIKTKVKLGGVVRKEKGCNLPNLDRKNWGVSEKDLEDIRFALDNKVDIIDYSYCSYMEECREFKNIVFKNLKSNQFIPKLWGKIETNEGINNIKEVAKELDGIVIARGDLTAEIGILNVPIVQEKILYALKNENKSIIVATNVLSSIRNKQNKPTINELSDIYHFIRCGATGFMLTGETSTGENEEYVVTTLKNSIKYYEKLLSKIKKRSKRV

SEQ ID NO: 46262 - protein, 483 aa, Oceanobacillus iheyensis HTE831
MEQTWKEQWFGNIKGDILAGVVVALALIPEAIAFSIIAGVDPMVGLYASFCIAVVISFVGGRPGMISAATGAMALVMVTLVANHGIEYLLAATILTGVLQILFGIFKLARFMKFVPRTVMTGFVNALAILIFTSQLQHFVGETWMMYALVALTLAIIYIFPRITKAVPSTLVAIIVVTIMVLTMNIGVRNVGDMGELTQTLPMFALPNIPLNLETLMIIFPYALALSIVGILESLLTANIIDDMTDTESNKNRETRGQGIANIVAGCFGGMAGCAMIGQSVINVKSGGRGRLSAFVAGLFLMFLILILGDIVVQIPMAALAGVMIMVSISTFDWKSVLHIHRIPRTDAIVMIVTVGTVVLTHNLAYGVLAGVLFSMIFFAAKNSKVKVSTTVSYDTRYYKVQGPLFFASVTDLLSQIDFHDHRSNVEIDLSRSHIWDDSAVGALDKIKTKFEDNDITVRFKGMNKESTQLVQSMEKLSNNSMH

SEQ ID NO: 46263 - protein, 356 aa, Glycine max
MDIDLSPQLPKKVYGANGGSYYAWSPSDLPMLHQGNIGAAKLALNKNAFALPRYSDSSKVAYVLQGSGVAGIVLPESEEKVVAIKKGDALALPFGVVTWWYNKEETELVVLFLGDTSKAHKAGEFTDFFLTGSNGIFTGFSTEFVGRAWDLEESHVKTLVGKQPAKGIVQLEGNISLPDPKPEHRNGMALNCEEAPLDVDIKGGGRVVVLNTKNLPLVGEVGLGADLVRLDGRAMCSPGFSCDSALQVTYIVRGSGRVQVVGVDGRRVLETTVKAGNLFIVPRFFVVSKIADPDGLEWFSIITTPNPIFTHLAGSSSVWKALSPSVLQAAFNVDPEVEQLFRSKRTADAIFFPPPN

SEQ ID NO: 46264 - protein, 296 aa, Zea luxurians
RPEIAHAHQPVMSPSHHGWDGNGAAAVPTPMPKRLDGKVAIVTGGARGIGEAIVRLFAKHGARVVTADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDLDLDVTVPSDQEVEKMEEVVRGLATLKGPTLRPRDIAEAVLFLASDEARYI

SEQ ID NO: 46265 - protein, 700 aa, Debaryomyces hansenii CBS767
MSKEYIIVTGGAGYIGSHTVIELIENGYEVIIIDNLCNSSYDSVARIEFMVKRSVNFFDIDLRDHEKLTNVFKTFKIKGVIHFAALKAVGESTKIPLEYYDNNINGTINLLKVMKENEVKTIVFSSSATVYGDATRFENMIPIPEHCPNDPTNPYGKTKYMIENIIKDIHTSDKFWRAAILRYFNPIGAHPSGLIGEDPLGIPNNLLPYLAQVAIGRREKLSIFGSDYDSHDGTPIRDYIHVVDLAKGHIAALNYLNELNSNEGLFREWNLGTGRGSTVFDVYHAFCKAVGKELPYEVVGRRDGDVLDLTANATRANNELKWKTNFTIEDACKDLWKWTTENPFGFQIKNYKWKLFNDTDVEDFRNRLHTVSFENFKVSIANYGALIQDVNFNNESLVNGFKTFNDYKSEDNPFFGTTVGRYANRISNGEFQLDGTTYKLTKNENGANTLHGGVNGANTLHGGVNGFDKQYFLGPIAKYHRDHTTLEFVLVDTDGNDGFPGDLETTVKYTIKEDSLEIEYISSLAEGSKRSVTAVNLTNHSYWNISPNKDINGTRIRASTNKCLKVNPKSLLPTGEIIESPHDLTKTVELTPDISFDNCFIANEKGSSLDTRSNELIDVVEATHPSSKTKLSVATTDPAFQLYTGDYTDINDFKSRSGFCVESSRFINAVNNKEWAEQVVLRKGETYGSKLKFSLSSVTT

SEQ ID NO: 46266 - protein, 296 aa, Zea luxurians
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDASEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDLDLDVTVPSDQEVEKMEEVVRGLATLKGPTLRPRDIAEAVLFLASDEARYI

SEQ ID NO: 46267 - protein, 399 aa, Bacillus cereus ATCC 10987
MDTLIFEVGTALVLVAIAAVIAGKFKFSVIPFLIVLGMLVGPHAPTIGVIDFKFIESASVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFIAGMIAGRQAGLSHKASTNIGLTIVSRGEFSIIMANIGIAGGLMSVLKPFSALYVLILSILGPLLTKESKNVYKFLNKIFKWDTKTN

SEQ ID NO: 46268 - protein, 296 aa, Zea luxurians
RPEIAHAHQPVMSPSHHGWDGNGAAAVPTPMPKRLDGKVAIVTGGARGIGEAIVRLFAKHGARVVTADIDDAAGEALASALGPQVSFVRCDVSVEDDVRRAVDWALSRHGGRLDVYCNNAGVLGRQTRAARSILSFDASEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDLDLDVTVPSDQEVEKMEEVVRGLATLKGPTLRPRDIAEAVLFLASDEARYI

SEQ ID NO: 46269 - protein, 522 aa, Debaryomyces hansenii CBS767
MTDSVPTFKDLSFYSDPESNNSRYVKLIQKFQENFGIKPEFISRSPGRVNLIGDHIDYNHFSVLPMAIDVDVIGAVGTSDDHKVVLTNTDESFAKEEFDLASDGSVIEIDKTNHTWGNYFKCGLIVAHKYIRDNFPESVDSGSKPLKGLRLTFNGTVPTGGGLSSSAAFCVASTLAILRANGVTSISKADLTRITVVSEHYVGVNTGGMDQCASIYGEQNKALLIQFKPKLIGIPFEIPVIKPNDMVFLISNSLLKANKHETAPTDYNLRVVEIAAASELFAKKFNLNLPKDSNVSTGTLRGFMDKYFEEYLKKDAWDGSDIDVGISRLEEMLKLTETAFSVDEKVGFETSEIAKQLGLSVEEFTKIFLTKAPVRYQKLKIYQRSKHVFSDSLRVLQVLKLLRNYNPSEDSEVFLKKFGTLLSDSHHSSDIYNDSSRPELDQLCEISTANGAYGARVTGAGFGGSVVHLTTADKLSNVVTALTEQYYKKHFPDITQQELAEAIVVSKPATGSCIVELDSISL

SEQ ID NO: 46270 - protein, 483 aa, Mycobacterium tuberculosis CDC1551
MSSSESPAGIAQIGVTGLAVMGSNIARNFARHGYTVAVHNRSVAKTDALLKEHSSDGKFVRSETIPEFLAALEKPRRVLIMVKAGEATDAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 46271 - protein, 296 aa, Zea luxurians
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDLDLDVTVPSDQEVEKMEEVVRGLATLKGPTLRPRDIAEAVLFLASDEARYI

SEQ ID NO: 46272 - protein, 296 aa, Zea luxurians
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALRMKHAARAMAPRRAGSIVSVASVAAVLGGLGPHAYTASKHAIVGLTKNAACELGAHGVRVNCVSPFGVATPMLINAWRQGHDDATADADRDLDLDVTVPSDQEVEKMEEVVRGLATLKGPTLRPRDIAEAVLFLASDEARYI

SEQ ID NO: 46273 - protein, 2207 aa, Physcomitrella patens subsp. patens
MEALHFTPLTLHRQPQAALSIHDRGISTKSHESSDQGKRALGVVRGGVATGSQADSSFGSRQLQAGCNFSGLRKTREFVECSKSRKCRSVNRYWWESLRQRQSKFYFLPVRAGLSSAPVTNQGLYDPSFDKDGCGVGFIAKLSQEPSRDIVKDALEMLERMAHRGACGCEENTGDGAGILVGIPHTYFSQARTKKYLGCDLPPPGDYAVGMMFLPTSEIRREHAKKVFTEVAEALGHTVLGWRRIKTDNSDLGKSAIQTEPVIEQVFLTSSTLSKIDFESQMYILRKTSMLAIRAVLNLKRGAAKDFYICSLSSKTVVYKGQLKPNQLTNYYYADVGDERFTSFMSIVHSRFSTNTFPSWDRAQPMRMLGHNGEINTLRGNVNWMHAREGLFKCKNLGLSPEELKKLLPIVDAGSSDSGVFDGVLELLVRAGRSLPEAVMMMIPEAWQNDPNMDPERRNLYEYFSCIIEPWDGPALVTFTDGKYLGATLDRNGLRPGRFYVTHDGRVIMASEVGVVDVEPENVAQKGRLHPGTMLLVDFENHKVVDGDELKKQQSSRYPYGEWLERQSFTLQDVVNSVSENLRVPPAILGDKNVASPNFSASNMGVKGLLTPLKAFGYTMENLEMLLLPMAKDGSEALGSMGNDAPLAMMSNRPKLVFEYFKQMFAQVTNPPIDPIREAIVTSTRCMVGPEHDLTETVEEQCNRLSLSGPLLDLGEMEAVKKMEYRGWKTMVVDTTFDKSEGPAGLESALTRICAEARNAVAEGYSMLVLSDRATSAQRVPVSSLLATGAVHHHLVQSMERTRIGLVVESAEPREVHHFCTLVGFGADAICPYLAIETISRLQVDGKIPMEWSREELVKKYFYASNSGMLKVLAKMGISTLASYKGAQIFEALGLSSEVVSRCFKGTPSRVEGATFEMLAKDCLRLHELAFPARESPEGSADANALPNPGDYNWRKDGEVHLNDPMAMAKLQEAARTNSVEAYNEFSKLTHELNKKVNVRGMLKFKEQPESTRIPLDNVESAAEIVKRFCTGAMSYGSISLEAHSTLAIAMNKLGGKSNTGEGGENPRRLEPLSDGSQNPQRSAIKQIASGRFGVTSYYLTNADELQIKMAQGAKPGEGGELPGHKVIGDIAVTRNSTPGVGLISPPPHHDIYSIEDLSQLIHDLKNANPAARVSVKLVSEAGVGVVASGVVKGHADHVLISGHDGGTGASRWTGIKNAGLPWELGLAETHQTLVANDLRGRTILQTDGQLKTGRDIMIAALLGAEEFGFATAPLITMGCIMMRKCHKNTCPVGIATQDPVLRAKFAGQPEHVINYFFMVAEEAREIMANLGISKMDDLVGRADLLQVDEEVMAENEKLANIDLSLLLRPAAEIRPGAAQRCVQKQDHELELALDQKLISLSHAALESKVPVYIESPVVNVNRAVGTMLSHEVTKQYKLEELPTDTIYVKLNGSAGQSLGAFTCKGVTLELEGDSNDYVGKGLCGGKIIVYPPRSSTFDPKENILIGNVALYGATSGEAYFNGMAAERFAVRNSGAKTVVEGVGDHGCEYMTGGVVVVLGETGKNFAAGMSGGVAYVLDKEGTFSSTCNTGLVDLDPVEEEEDVMTLRAMIQQHQRHTKSQLAGEILANFDSLLPSFIKVFPRDYKRVLKEIKAKEEAEKMKVAAAAVADAGLAASVANSAPKAAPSTIRPTEVSNPIKHGGFVKYDRKPLPYRPAEERMKDWGEVLASDNQDGLVKTQSARCMDCGTPFCNQDKTGCPLGNKVPEWNELVYQNRWREALDRLLETNNFPEFTGRVCPAPCEGACVLGIIENPVSIKTMECTIIDKGFENGWMVPRPPLKRTGKKVAIVGSGPAGLAAADELNKKGHSVTVFERADRIGGLMMYGVPNMKTDKENVVQRRVNLMEAEGVQFVTNAHVGVDPVYSVENLRSDYDALLLATGATKPRDLPVEGRDLAGVHFAMEFLHKNTKSLLDSNLEDGQYISAKGKKVVVIGGGDTGTDCIGTSVRHSCASVVNLELLPQPPQTRAANNPWPQWPRIFRVDYGHEEAATKFGKDPRSYEVLTKRFIGNEKGEVTGMELVRVEWSKGADGRFQMTEVVGSTQIIEADLVLLAMGFLGPEQNIAEKLGLQTDARSNFQADFGKHATNSQGVFAAGDCRRGQSLVVWAIAEGRQAAAQVDNYLMVKEVVLEQLPSEEHIREFIATSSVQ

SEQ ID NO: 46274 - protein, 363 aa, Arabidopsis thaliana
MANNGPNWDGLLKWSLSHSDGASSSSRISEEDRQWFVEAMQAHTIDSISRMKVISQIMKMPEQVLEAQGVTPDDLEGMLAELQEHVESIDLANDLHSIGGLVPLLSYLKNSNAKIRAKSADVLTTVVQNNPRSQQLVMEANGFEPLLTNFIADPDIRVRTKALGAISSLIRNNQPGITAFRLANGYAGLRDALVSDTVRFQRKALNLLHYLLQESNSDCKIVRDLGFPRIMIHLASNQDFEVREFALRGLLELAREESVRNLDRGDVNLRQLLEERTRRIIVMSDEDLCAAREERQLVDSLWTVCYDEPSLLRERGLVYLPSDDELAPDVVRDRFEPPLRAWAARRHDETSESPVPLLLGPAP

SEQ ID NO: 46275 - protein, 426 aa, Prosthecochloris aestuarii DSM 271
MNIISVGVNHKTAPIEIRERISLSEVQAKEFLSDIISSGIAQEAMVLSTCNRTELYVVPGMSEVTGHYLKEYLISYKNAEKEVRPEHFFNRFYCNTARHLFEVSSATDSLVLGEGQILGQVKNAYRIAVEEQSAGILLTRLCHTAFSVAKKVKTRTRIMEGAVSVSYAAVELAQKIFSNLSMKKILLVGAGETGELAAKHMFQKNARNIVITNRTMSKAEALAEELGTNQVLPFETFRDNLHEFDIIITAVSTKDYVLKAPDMHQSMQKRRLKPVIILDLGLPRNVDPEIRSLQNMFLKDIDDLKHIIDKNLEMRRSELPKVQEIIDEELVGFGQWINTLKVRPTIVDLQSKFLEIKEKELERYRHKVSDEELRRMERLSDRILKKILHHPIKMLKSPVDTADNIPSKVNLVRNIFDLEEQNQLKQ

SEQ ID NO: 46276 - protein, 360 aa, Vitis vinifera
MDAKKPFVAVLLIQTIYAGMFLVSKAAFNVGMNNFIFVFYRQAAATVFLVPIAIIFERKNVPPLSFVTFCKIFMLSLFGITLSLDVNGVALIYTSATLAAATTNCLPVITFFLAVLLRMETVKLRTSSGMAKIAGVLICIAGAATIAFYKGPHLQLMLHHHLFGHHTSHEHQSHVSSGATWVKGCLLMLMSNTFWGLWLVLQAYIMKSYPAKLLLTTLQCLLSSIQSFFIAIALERDPDQWKLGWNVKLVAVAYTGIVVTGVTYYLQTWVIEKKGPVFLAMSTPFALIITIFCSAIFLGEAISLGSILGGILLVGGLYSVLWGKSKEQKMEKTCSTAQAEKETELKEEVAAQSPPPPFFV

SEQ ID NO: 46277 - protein, 285 aa, Glycine max
  misc_feature (102)..(102): Xaa can be any naturally occurring amino acid
MAKHDVEGGSFSAKDYHDPPPAPLIDAEELTQWSFYRALIAEFIATLLFLYITVLTVIGYKSQSDVKAGGDVCGGVGILGIAWAFGGMIFILVYCTAGISGXHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPTI

SEQ ID NO: 46278 - protein, 198 aa, Campylobacter jejuni subsp. jejuni NCTC 11168
MIISAKFITSLVKFDENLSSNFSEVAFLGRSNVGKSSLINSLCKQKNLAKSSATPGKTQLINFFEVICRRNEEKFNINFIDLPGFGYAKVSKNLKEIWNQNLDEFLKLRTSIKLFIHLIDSRHTHLEIDVNLNDYLKRFLRPDQKILKVFTKCDKLNQSEKAKLKNEFKDSILVSNLNKFGLDSLEDIIINQTLGLDK

SEQ ID NO: 46279 - protein, 370 aa, Kluyveromyces lactis NRRL Y-1140
MEGTPKRQRAGSLLGEESPETPSPLSDSNKNDSGSRPSFLPSPRQSSATVGNLEGAPSLASPKRFTHSSHSGEIAIPQSPVGLQHSKFTNLIPPETPKSKNQELFLSPSLELQSPVHKPVVATQKPIREISNNLKSRLNYAYVKMQQNMLQHSKRGLDESIDDAAQVTNEVKPSSYSNVFAQDSDTELETLPSAIKETRNASKSVLAHDTMGLKLKDDLEDLAGENSAQVAFLKALQSPKKKQRSLSSTHPKITRTSSSSNSQPSEVEAIETLMSLSSPHKRRPSGSFDLALPPPTPPPVNNNSTSAATISASDITTTDSDRTSNPSDDSDSKQGPRPSLGSPKLTKPVKLSLHSEVQTDVETDVESQSE

SEQ ID NO: 46280 - protein, 366 aa, Neptuniibacter caesariensis
MSDTNFYTLKIAEVQPETDTAIAVSFAVPAELQDKFNFIQGQFLTLRAEIDGEDVRRSYSICSGVNDGHMRVGIKRVKDGKFSNYANDNFKPGMSVEVMPPQGSFFTEVKADQKKNYMCIAAGSGITPMISIMKTVLSTEPESKVTLIYGNRRSNTVMFKDELNFVKNRYLDRFQWINIMDYEDQGADLLNGRIDNAKGYALQKSGLINIKEVDEAFICGPEAMMSEVSRGFRMEGLTDEHIHYELFASSATDSKAMLEKAAARKEQFGEEKMSKVTVMADGRSVMFDLATVGENILDAGIENGMDLPYSCKGGVCSTCKCKLVKGEVDMDISHGLEQHEIDAGYVLSCQAHPISDEVVLDFDARS

SEQ ID NO: 46281 - protein, 321 aa, Bacillus licheniformis ATCC 14580
MSLDVMTFGESMAMFYANEAGGLHEASSFSKALAGAETNVAVGLSRLGFRVGWMSKVGADSLGTFILNELKKEGVDISEVKRTADRQTGILLKSKVESGDPDVTYYRSGSAASTMSIDDYPAEYFKQAKHMHVTGIPPALSREMRGFARHAVHQMKKDGKTISFDPNLRFQLWPDQQTMVHTINEIAAQADWFLPGINEGKLLTGCNSPEDIAKHYVMQGVKVIVIKLGKEGAYYRTSEKEGYVPGYQVEKVVDTVGAGDGFAVGMISGLLDGLPLEEAVQRANAIGALAVMAPGDMDGLPSRDQLKAFMAGEKNNQKIGG

SEQ ID NO: 46282 - protein, 164 aa, Zea mays
VVHFFTCCRGLAWVGVCARDGGLHGNHWTKIKPAVNQIETHPYFQRDSLVKFCQKHGICVTAHTPLGGSTANAEWFGTVSCLDDPVIKSLADKYGKTPAQLVLRWGLQRDTVVIPKTSKVERLQENFDVFGFDISGEDMERMKAIDRKYRTNQPAKFWGIDLYA

SEQ ID NO: 46283 - protein, 458 aa, Anabaena variabilis ATCC 29413
MAALLSDALVFFGITSDLAYKKIFPALQAMIQRGHFDIPIIGVGRRDWSIEQLQSYVRKSLEEQVGVDEAAFQKLCSLLYYIFGDYSDRATYDKLCQVLQIAEAPLYYLAIPPSLFATVVEGLGQSSCVKNGCVMVEKPFGRDLESARILNCILHSIFPESHIFRIDHYLGKEPVQNLLYTRFANSLLEPIWHRVSIASIQITMAEKFGIDGRGQFYEETGAIRDVVQNHLLQVTACLMMDPPINEQHEAIRDERARLLKSIDPIEPSNVVRGQYKGYASEPGVAPDSKVETFAAVKLNIDTWRWASVPIYIRAGKCLPSTTTEVVVRLKRPPQDVFGERAFGLANYFYFRLSPNVLTAIGIRSKTPGDRMVGSEVGLVAQVEHGNEMNPYERLFEDAMKGDSMLFARQDEVEAQWQIVAPILDRATPVYEYAPHTWGPPLADRMIPPDGGWHNPNET

SEQ ID NO: 46284 - protein, 101 aa, Triticum aestivum
  misc_feature (81)..(81): Xaa can be any naturally occurring amino acid
MAAAEGGGGGGGGKVSFKVILTSDPKLPFKVFSVPEAAPFTAVLKFAAEEFKVPPQTSAIITNDGVGINPQQSAGNVFLEXHAPELRLIPRDRVGATAPSF

SEQ ID NO: 46285 - protein, 367 aa, Zea mays
MALPKDGCLDGAKITEVGGVGYKELLVMALPKDDSIDGAKVAEAIGVKLPDVGGAIRTILNSREAREFASGALAGAMSKAILAPLETIRTRMIVGVGPRHIFGSLVDIIQQNGWQGLWAGNTINMLRIIPTQAVELGTFECVKRSMAEAQEKWKEDGCPKIQLGNMKIELPLHLLSPVAIAGAAAGIAATLACHPLEVIKDRLTINREVYPSIGLAFRRIYKTDGIGGFYAGLCPTLIGMIPYTTCYFFMYDTIKTSYCRLHKKSSLSRPELLLIGALSGLTASTISFPLEVARKRLMAGALQGKCPPNMIAALSEVIQEEGVMGLYRGWGASCLKVMPNSGITWVLYEAWKDVLLADRNKPRSLAN

SEQ ID NO: 46286 - protein, 296 aa, Zea luxurians
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDASEFDRVLRVNALGAALGMKHAARAMAPRRAGSIVSVASVAAVLGGLGPHAYTASKHAIVGLTKNAACELGAHGVRVNCVSPFGVATPMLINAWRQGHDAATADADRDLDLDVTVPSDQEVEKMEEVVRGLATLKGPTLRPRDIAEAVLFLASDEARYI

SEQ ID NO: 46287 - protein, 524 aa, Debaryomyces hansenii CBS767
MSTDKLKSYVEEISPYLTQWYVIALGGILVWYIGTSIKAYQFKQKYGCKEPPLVPGGFLSIKLLLDLLKTKSEGTMLEYAEHFFSLVKSQTFKLKLATVPIIFTQDPENIKAVLATQFNDFALGTRHAHFKPLLGDGIFTLDGDGWKNSRLLLRPQFAREQVAHVQTLEPHLQTLAEHISNKKGETFDIQELFFRLTVDAATEFLFGESVYSLRDGTVKDVAPLDFDGKSSFADSFNLSQSYLASRAYSQMFYFLINNKEFRNSNTKVHKFCKHYVEQALATSQDELDKKSKDGYIFLYELVKQTRNPKILQDQLLNILLAGRDTTAGLLSFTFFELARNPDVFEKLKNEIYTHFGDGANPRIETITFESLKRCEYLKFVLNEVLRLYPSVPINFRVSTKDTTIPRGGGPDKQDPVYVAKGTTVAYSVYTTHRLEQYYGKDSREFRPERWAENKKVGWAYVPFNGGPRICLGQQFALTEASYVVVRLIQMFPNLVSRDDRPYPPRKNVQLTMCHQDGVFISLNK

SEQ ID NO: 46288 - protein, 296 aa, Zea luxurians
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFGASEFDRVLRVNALGAALGMKHAARAMAPRRAGSIVSVASVAAVLGGLGPHAYTASKHAIVGLTKNAACELGAHGVRVNCVSPFGVATPMLINAWRQGHDAATADADRDLDLDVTVPSDQEVEKMEEVVRGLATLKGPTLRPRDIAEAVLFLASDEARYI

SEQ ID NO: 46289 - protein, 546 aa, Thinopyrum intermedium
MGLDLGELAFRYTGLAVSDHDSIVAINIFIALLCGCIVFGHLLEGNRWVNESTTALVLGLITGGVILLCTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVASGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLVPPRTGTAADISSQSFIDPLTASLLGSDFDVGQLTPQTNLQFLLTMPTRSVHRVWRKFDDKFMRPMFGGRGFVPFVPGSPIERSVHGPGLLGTATEAENRS

SEQ ID NO: 46290 - protein, 218 aa, Desulfovibrio desulfuricans G20
MQPKLVLENTIYTLEQLVSFNAPQIALAGRSNVGKSSLVNTLAGRKGLARTSSTPGKTRSINFYKVDPDGYYVVDLPGYGYARCSKAEREKWAKLIRRYLVETPAVCAIAILLDCRLSPQKLDVELAAFARQAGLPLLPVLTKADKCKQQERALRQREWRTILGGEVPLLFSSKTGMGKDKLWQELHRLAFPDMAFDTPSDGAPEPADEPEAASERAE

SEQ ID NO: 46291 - protein, 134 aa, Magnetospirillum magnetotacticum MS-1
  misc_feature (128)..(128): Xaa can be any naturally occurring amino acid
MSREEQAVAEGGRRAPEPPIHGPEGFEGMRRAGRLTAEALDLLVEAAQPGVTTEYLDNLAFEFGMDHGAYPASLFYRGYRKSICTSINHVVCHGIPNDKPLREGDIVNLDCCLILDGWHGDSSRMAYXRRVTQL

SEQ ID NO: 46292 - protein, 407 aa, Zea mays
  misc_feature (179)..(179): Xaa can be any naturally occurring amino acid
  misc_feature (392)..(392): Xaa can be any naturally occurring amino acid
MATSMLSATTVPLQQVQGGGLSEFSGLVRSSASLPMRRNATSDDFMSAVSFRTHAVGTSGGGPRRAPTEAKLKVAINGFGRIGRNFLRCWHGRGDDSPLDVIAINDTGGVKQASHLLKYDSTLGIFDADVEPVGDNAISVDGKVIKVVSDRNPSNLPWGELGVDLVIEGTGIFIDREGXGQAGAKKVLITAPGKGDIPTYVVGINADQYNPDEPIISNASCTTNCLTPFVKVLDQKFGIIKGTMTTTHSYTGGQRLLDASHRDLRRARAAALNIVPTSTGAAKAVVLVLPNLNGKLNGITLRVPTPNVSVVDLVVQVSRKTLAEEVNQAFRDAAANELQGILEVCDVPLVSVDFRCSDVSSTIDASLTIVMGDDMVKVISWYDNEWGYSESXQRVIDLADICANQWK

SEQ ID NO: 46293 - protein, 396 aa, Idiomarina baltica OS145
MDYQLSKRVNSIQPSPTLAVTQKANELRSAGKDVIGLGVGEPDFDTPDFVKQAAIKAIEDGKTKYTAVDGIVELKQAVSDKFKRDNQLEYGLDEIIVSAGGKHSIFNLLSAWLNPGDEVVIPAPYWVSYPDMVKLVEAEPVIVHTDLEQRFKITPEQLRDSLTEKTRLMFINSPSNPSGTAYSAEELRALADVLVDFPNVLIATDDMYEHILWDRSQFANIVMVAPELRDRTVILSGVSKAYAMTGWRIGYAAGPAPIIAAMKKIQSQSTSNPASISQHAAVAALNGDQSCIDTMVSAFKERHDYLVSALNEIEGIECVKGDGTFYTFARIQNLIEKAGVANDVELCEKLLTEANVALVPGSAFGTEGYCRLSFATSLDTLKEAVARINQFVKALK

SEQ ID NO: 46294 - protein, 377 aa, Bacillus licheniformis ATCC 14580
MKAVTFQGPQHVEVSQVEDAKIEKSDDIVVRITSTAICGSDLHLYQGNFPLPKGFQLGHEPMGIVEETGPDVTKVKKGDRVVIPFTVACGHCFYCENKLESQCDNANPHYDSGGYFGYSEKFGNHPGGQAEYLKVPFGNFTPFVIPESCEMEDESLLFLSDVLPTAYWSVLHAGVKKGDTVIVLGCGPVGLMAQKFAWMEGAKRVIAVDYLDYRLKQAEALNRVEVFDFTKYPDMGEHLKEITKGGADVVIDCVGMDGKKSPLEYLEQKLKLQGGTLGPIQISTKAVRKCGTVQITGVYGSNYNMFPLGAFFSRNVTLKMGQAPVIHLMPEIYKKIEENQFDPKEIITHQLPLEEAGRAYHLFNDHEDDCIKVILKP

SEQ ID NO: 46295 - protein, 460 aa, Neptuniibacter caesariensis
MLDDNNKASATTADIQALDAEHHLHPFTNTGALNKKGARVITKGEGVYLWDSEGNKIIDGMAGLWCVNMGYGRKELVEAANTQMNQLAYYNTFFQTTHTPVAELAREIASVTPGDLNHIFFANSGSEAIDTIIRLVRQYWAIKGKPYRNILISRENAYHGSTVGGTSLGGMSGMHKQGAPLVPNIERIRQPYWYGEAGDMSEEEFGIACAKALEEKILEVGPDNVAAFVGEPIQGAGGVIVPPANYWAEIQKICQKYDILLAADEVICGFGRTGSWFGSETLGITPDIISMAKGLSSGYLPIAAVAVGDRISNALIEHDDDFNHGYTYSGHPVSAAVAIANIRLMKEENIVDYVANDIGPYFQQKLRDTLGEHPLVGHIEGVGLVAGIALVKDKATKELFPDDLDIGMICRDHCFNNGLIMRAVGSRMVLSPPLVISRDEVDELIEKARLCFDLTLKSVS

SEQ ID NO: 46296 - protein, 386 aa, Triticum aestivum
LHRTSLYKKAGWYRSGIPGISSTHASDRSPPRVPLYVDDKLRKGVKGAANEEDIETVLDKVMMLFRYLQEKDVFEKYYKQHLAKRLLSGKTSSDEAERNMLVKLKTECGYQFTSKLESMFTDLKTSQDTMQSFYANLAGDSDGPTISVQILTTGSWPTQPCATCNLPPEILGVSEQFRAHYLGTHNGRRLTWQTNMGNADIKATFGDRKHELNVSTYQMCVLMLFNSTDTLTYKEIEQNTAIPPVDLKRCLQSLACVKGKNVLRKEPMSKDISDSDAFHFNDKFSSKLVKVKIGTVVAQKESEPEKQETRHRVEEDRKPQIEAAIVRIMKSRRVLDHNSIVTEVTKQLQARFLPNPVVIKKRIESLIEREFLERDKVDRKLYRYLA

SEQ ID NO: 46297 - protein, 445 aa, Neptuniibacter caesariensis
MSSNNDKEFDLFITDLNGNLRGKRMPANALSKVMEEGVKLPRSVIGFDFWGDDVLDNGLVFETGDSDGICMPVHDEAVPVPWADSPRNQILATMFNPDGTPFSADPRQALNAVVDRFKKLGLTPVVATELEFYLMDGKSEETQRPQPPILVEGHGRRLAETDCYSIDEMDGLSSFFAEVREVCEQQGVPADTIISELGPGQFEINLNHVPNPMLAGDQAIMFKRLVRGIARKHGYSATFMAKPYANKSGNGFHVHFSLLNEAGINVFDNGGDEGTDVLKHAVAGLMNTMADSMLAFAPHMNSYRRFMVGAHAPTCASWGYENRTVAIRIPDSPPVARRIEHRVAGADANPYLVLATILAGALYGIENKLMPPAPIAGDAYTEANQDLILPNKWDDATDIFNRSDVMREYLGEEFVRVFTAAKRQELRKLHAQISDIEYESYLGFL

SEQ ID NO: 46298 - protein, 725 aa, Anabaena variabilis ATCC 29413
MKLLIVENDRDTAAALTTSLVAQQFTVDTASDSRSALELAEATEYDLIVLDVMLPDENGIRLCRQLRTQNQQEPILLLTRKVNPADRIAGFEAGADDYITKPYELSELLARIRALLRRGSTVLTKVLCWGQLQLDPNNCEVMCQGKGLHLTPKEYKLLELFLRHPRRIFDRRTLLDRICSIDECPGEEAITTQIRGLRRKLQMAGLNSDPIETLYGLGYRLKSVPEEREQGSEQGHGDTETRGRGDTETRGQGDTGNIFDRLSALPFGATSRHKSLPSGFGSDAPNVANAALTDSTGNGATPLKSGNPPTGVAPQVENATSKTPTSSPQSGSVQGAGSPHLPISAFSSSYLLNANRYDAEAEAVAAIQQMWQDSQERLQGQLAKLEEAIAHLSTNSLTPDGRQFAQTIAHRLIGSLGAFGMPQAAELARQIERTLKTPTAAVQSEEAVQLKSLLGQLRQVIQQLPTFATTAPTPVLKSSDRVVLLIDDDTDLIERMQANASNWSIHLETVTDLTLARQRLQYLTPDAIILDLTFPNTTESGLTLLAQLKHQFSTIPVLVLTGLGDLTKRVEVTRLGANAFLQKPATPTEVFQAVSQLLHRIDTINARLLIVDDDPALLSILEAQLQPWGFQVTTLADSSQFWQYLEATTPDLLLLDVAMPGFSGIELCQVVKSDPRWSRLPVLLLSAHADADTLYRALAAGADDYILKPIVEADLIQRILNFNSW

SEQ ID NO: 46299 - protein, 389 aa, Anabaena variabilis ATCC 29413
MKAVCWNGANDVRVETVPDPKIINPRDAVIKITTTAICGSDLHLYNGYVPTMEKGDILGHEMMGEVVEIGSAVKNLNIGDRVVVPFPIACGNCWYCQHDFWSLCDNSNPNAWLAEKFMGYSPSGIFGYSHMLGGYAGGQAEYARVPFADTGLFKIPDGLTDEQVVFLTDIFPTGYMAADNCNIQPGDIVAVWGCGPVAQFTIRSAYLLGAERVIAIDRIPERLQMAKDQGKAEILNYEEVNVSEALKEMTGGRGPDACIDAVGLEAHGTGLEGVYDEVKQAVRLETDRPHVLRQVMMDCRKGGHVSIPGVYVGVVDKIPMGAAMNKALVFKMGQTHVHKYLNTLLDHIQNGRIDPSFVITHRLPLDEAPRGYGIFKDKKENCIKVVLKP

SEQ ID NO: 46300 - protein, 127 aa, Oryza sativa
  misc_feature (9)..(9): Xaa can be any naturally occurring amino acid
YSVNEGHAXTGNGPTTKYVKKCRFPKDGSFAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAEE

SEQ ID NO: 46301 - protein, 830 aa, Arabidopsis thaliana
MELEPNKSLSADMPSLLSRSSEAFNGGTGYRSSSDLSMFSSSLPTLFHEKLNMTDSDSWLSFDESSPNLNKLVIGNSEKDSLEDVEPDALEILLPEDENELLPGLIDELNFTGLPDELDDLEECDVFCTGGGMELDVESQDNHAVDASGMQISDRGAANAFVPRKRPNTAGRVSVEHPNGEHPSRTLFVRNINSSVEDSELSALFEPFGEIRSLYTACKSRGFVMISYYDIRAAHAAMRALQNTLLRKRTLDIHFSIPKENPSEKDMNQGTLVIFNVDTTVSNDELLQLFGAYGEIREIRETPNRRFHRFIEYYDVRDAETALKALNRSEIGGKCIKLELSRPGGARRLSVPSQSQDLERTEVTNFYNQVGSHVANSPPGNWPIGSPVKGSPSHAFTRPHGLGMVRPVNSDNMPGLASILPAHPSSFHGFSPVSNDQGLLNHSNQTILNKGLMHNISYGQPHSLPEHITGGISNSMRFIAPHSSGFGTSSDHRYRWGSPPQHMNYPGYTGVSSSSSSTERPFTVRHGFPFAERQASLLGKYQHHVGSAPSSIHFNTQMNCYTGSPEIPLGFSDMGINRNYNSAHGKANLGVSLPGNSSEQDFTGFGMSSMPTVPFGGSRGLQSVRPEPFAEQGRIHNHESHNQNQFIDGGRYHIDLDRIASGDEIRTTLIIKNIPNKYTYKMLVAEIDEKHKGDYDFLCLPTDFKNKCNMGHAFINMVSPLHIVPFQQTFNGKIWEKFNSGKVASLAYAEIQGKSALASYMQTPSSMKEQKQLFPEVSYHDDGQDANDHEQLFSSIWNITAPDSDWSYTMDLIENPRENGNSKNAAEESS

SEQ ID NO: 46302 - protein, 466 aa, Corynebacterium efficiens YS-314
MKFHCKFTCPRCRDGNVEFMTVDEQVSNYYDMLLKRNAGEPEFHQAVAEVLESLKIVLEKDPHYADYGLIQRLCEPERQLIFRVPWVDDNGQVHVNRGFRVQFNSALGPYKGGLRFHPSVNLGIVKFLGFEQIFKNSLTGLPIGGGKGGSDFDPKGKSELEIMRFCQSFMTELHRHIGEYRDVPAGDIGVGGREIGYLFGHYRRLANQHESGVLTGKGLTWGGSLVRTEATGFGTVYFVQEMIKAEGETLEGKKVIVSGSGNVATYAIQKVQELGAVVVGFSDSSGWVSTPNGVDVAKLREIKEVRRARVSSYADEVEGAEYHTDGSIWDLTADIALPCATQNELDGDNARTLADNGCRFVAEGANMPSTPEAIDVFRERGVLFGPGKAANAGGVATSALEMQQNASRDSWSFEYTDERLHRIMKNIFKSCADTAKEYGHEKNYVVGANIAGFKKVADAMLAQGVI

SEQ ID NO: 46303 - protein, 619 aa, Neurospora crassa
MKFLGIAALVAGLLAPPLVLAAPAPGTEGVNLLTPVDKRQDSQAERYGGGGGGGCNSPTNRQCWSPGFNINTDYELGTPNTGKTRRYKLTLTETDNWIGPDGVIKDKVMMVNDKIIGPTIQADWGDYIEITVINKLKSNGTSIHWHGMHQRNSNIQDGVNGVTECPIPPRGGSKVYRWRATQYGTSWYHSHFSAQYGNGIVGPIVINGPASANYDVDLGPFPLTDYYYDTADRLVLLTQHAGPPPSNNVLFNGFAKHPTTGAGQYATVSLTKGKKHRLRLINTSVENHFQLLLVNHSMTIISADLVPVQPYKVDSLFLGVGQRYDVIIDANQAVGNYWFNVTFGGSKLCGDSDNHYPAAIFRYQGAPKALPTNQGVAPVDHQCLDLNDLKPVLQRSLNTNSIALNTGNTIPITLDGFVWRVNGTAININWNKPVLEYVLTGNTNYSQSDNIVQVEGVNQWKYWLIENDPDGAFSLPHPIHLHGHDFLILGRSPDVTAISQTRYVFDPAVDMARLNGNNPTRRDTAMLPAKGWLLIAFRTDNPGSWLMHCHIAWHVSGGLSNQFLERAQDLRNSISPADKKAFNDNCDAWRAYFPDNAPFPKDDSGLRSGVKAREVKMKW

SEQ ID NO: 46304 - protein, 619 aa, Neurospora crassa
MKFLGIAALVAGLLAPSLVLGAPAPGTEGVNLLTPVDKRQDSQAERYGGGGGGGCNSPTNRQCWSPGFNINTDYELGTPNTGKTRRYKLTLTETDNWLGPDGVIKDKVMMVNDNIIGPTIQADWGDYIEITVINKLKSNGTSIHWHGMHQRNSNIQDGVNGVTECPIPPRGGSKVYRWRATQYGTSWYHSHFSAQYGNGIVGPIVINGPASANYDVDLGPFPLTDYYYDTADRLVLLTQHAGPPPSNNVLFNGFAKHPTTGAGQYATVSLTKGKKHRLRLINTSVENHFQLSLVNHSMTIISADLVPVQPYKVDSLLLGIGQRYDVIIDANQAVGNYWFNVTFGGNDLCGTSDNKYPAAIFRYQGAPKALPTNKGVAPPDHQCLDLNDLKPVLQRSLNTNSIALNTGNTIPITLDGFVWRVNGTAININWNKPVLEYVMTGNTNYSQSDNIVQVEGVNQWKYWLIENDPDGAFSLPHPIHLHGHDFLILGRSPDVTAISQTRYVFDPAVDMARLNGNNPTRRDTAMLPAKGWLLIAFRTDNPGSWLMHCHIAWHVSGGLSNQFLERAQDLRNSISPADKKAFNDNCDAWRAYFPDNAPFPKDDSGLRSGVKAREVKMKW

SEQ ID NO: 46305 - protein, 288 aa, Glycine max
  misc_feature (7)..(7): Xaa can be any naturally occurring amino acid
  misc_feature (125)..(125): Xaa can be any naturally occurring amino acid
  misc_feature (167)..(167): Xaa can be any naturally occurring amino acid
MAKDVEXVTEQGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLXRALLYMIAQCAGAICGAGLAKGFQKSFYNRYGGGVNTVSDGXYNKGTALGAEIIGTFVLVYTVFSATDPKRNARDSHVPVLAPLPIGFAVFMVHLATIPVTGTGINPARSFGPAVIFNNDKAWDDQWIYWVGPFVGAAVAAIYHQYILRGSAIKALGSFRSNA

SEQ ID NO: 46306 - protein, 298 aa, Zea mays subsp. mexicana
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDLDLDLDVTVPSDQEVEKMEEVVRGLATLKGPTLRPRDIAEAVLFLASDEARYI

SEQ ID NO: 46307 - protein, 374 aa, Arabidopsis thaliana
MTMMSDLSEDLVEEILCRVSITSLGAVRSTCKGWYVLSKTRVLCKAETKHQFLGFMKKNYKLCSMRFDLHGNFNEEGGEEFMNPSIKKSGNLLDQLDICKVFQCDGLLLCVTKEENTRLVVWNPYSGQIRWIKCNNSYHRYEGYAIGYNNNRKHKILRFSDMSFSTYKIYDFISNSWRVLDIAPNWHINPDQRGASLKGNTYFFAREKREDEEDEDILWQPVEYLLCFDFTTENFGQLHPLPFEQYIDDAGALSSFGEEKLAALFQSFASSVVEIWVTSMIEANAVSWIPFLKVDMKPHCSFRFRLPFDGGSFFIDEEKKVAVVIHVDVVAESEMNRYEDVAYIIGENGSYVPSLAQINQSVEFENEREEEEAN

SEQ ID NO: 46308 - protein, 279 aa, Bacillus cereus ATCC 10987
MKNLQSTTTLHNGVEMPWFGLGVFKVEDGPELVEAVKSAIKAGYRSIDTAAIYGNEKAVGEGIRAGIKEAGISREDLFITSKVWNSDQGYETTLAAYEESLKKLELDYLDLYLVHWPVEGKYKDTWRALETLYKEERVRAIGVSNFQIHHLQDVMKDAEIKPMINQVEYHPRLTQKELQAFCKEQGIQMEAWSPLMQGQLLDNETLQAIAEKHGKTTAQVILRWDLQNGVITIPKSTKEYRIIANADVFNFELTKEDMEKIDALNQNHRVGPDPDNFDF

SEQ ID NO: 46309 - protein, 298 aa, Zea mays subsp. mexicana
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATANADRDLDLDLDVTVPSDQEVEKMEEVVRGLATLKGPTLRPRDIAEAVLFLASDEARYI

SEQ ID NO: 46310 - protein, 538 aa, Oryza sativa Japonica Group
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 46311 - protein, 276 aa, Zea mays subsp. mexicana
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVATPMLINAWRQGHDDATADADRDLDLDLDVTVPSDQEVEKMEEVVRGLATLKGPTLRYI

SEQ ID NO: 46312 - protein, 430 aa, Brassica napus
MAGKKQELPVSGEPLAAVESPMTDTIEKKKKKKKSKKNKHAEVEVPQEVVDKGEELSSKEKKKKRKREEKEMEKEEESEVPEKKLEPEASNGGGGGESEQKVVVTGKGAEEAKYAALTSFAESKLPANVLDCCKTFQKPSPIQSHSWPFLLDGRDLIGIAKTGSGKTLALGIPAIMHMLKKNKSGKGTRNPTCLVLSPTRELAVQISDVLSEAGEPCGLKSIGAYGGSSKRPQINAIRSGVDMVMGTPGRWRDLIESNELRLSDVSLVVLDEADRMLDMGFEEPVRFILSKTNKVRQMVMFSATWPIDVHKLAQEFMDPNPVKIVIGSEDLAANHDVMQIVEVLDDRARDQRLIALLEKYHKSQKNRVLVFALYKVEADRLERFLQQRGWKAVSIHGNKAQSERTRSLALFKEGSCPLLVATDVAARGLD

SEQ ID NO: 46313 - protein, 298 aa, Zea mays subsp. mexicana
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHTIVGLTKNAACELGAHGVRVNCVSPFGVATPMLINAWRQGHDDATADADRDRDLDLDVTVPSDQEVEKMEEVVRGLATLKGPTLRPRDIAEAVLFLASDEARYI

SEQ ID NO: 46314 - protein, 391 aa, Prosthecochloris aestuarii DSM 271
MGLWRLNPVKEAVRFFSRISGGCRSNAIVLAGINLSQGVCDTPVPGVVLEGASHALSQRQNSYTHYAGIGGLREALAEKYRTMYGIDVDPQQEIVVSAGATGAMYCAFQALLNPGDEVIVFEPYYGYHISTLNALQAVPVFLSLTSPDWTFSEADLEAAVSSRTRAILINTPGNPSGKVFTLAELQRIADFAEEHDLFVFTDEIYEHFLYDGRRHHSPFALPGMRKRTVLISGFSKTFSVTGWRIGYAISDARWAQAIGYFNDLVYVCAPSALQPGVAAGLATLDTSYYLSLSAEYGFKRNRFCRALGEAGLNAVLPQGAYYVLADVSHLPGSTTRDKAMHILRTTGVASVPGSAFFRNENDQHLVRFCYAKDDVVLDAACERLMKLKEMD

SEQ ID NO: 46315 - protein, 232 aa, Oryza sativa Japonica Group
MAAAASTLASLSATAAAAAGKRLLLSSPSRSLSLSLASRGRIAVMPHLRAGILSAAPRRAVSASAPAAATIAVGDKLPDATLSYFDSPDGELKTVTVRDLTAGKKVVLFAVPGAFTPTCTQKHVPGFVAKAGELRAKGVDAVACVSVNDAFVMRAWKESLGVGDEVLLLSDGNGELARAMGVELDLSDKPAGLGVRSRRYALLAEDGVVKVLNLEEGGAFTTSSAEEMLKAL

SEQ ID NO: 46316 - protein, 94 aa, Zea mays
  misc_feature (82)..(82): Xaa can be any naturally occurring amino acid
VAGTDKETTTRGHDDLGKRCAKYYEAGARFAKRRAVLKIGPNEPTQIAIDLNAQGLARFTIICQENRLVPIVEPEILVYGPXDFDRCAYVTGTG

SEQ ID NO: 46317 - protein, 372 aa, Idiomarina baltica OS145
METIKSRAAVAWGPGEPLKMEEIDVAPPKKGEVRVKIIATGVCHTDAYTLSGADPEGIFPAVLGHEGGGIVESVGEGVTSVEVGDHVIPLYTAECGECKFCTSGKTNLCQAVRATQGKGLMPDGTTRFSKNGEPIYHYMGTSTFSEYTVLPEISVAKIPKEAPLEKVCLLGCGVTTGMGAVKNTADVQEGDTVAVFGLGGIGLAVIIGAVQAKASRIIAIDVNEDKFEIAKQLGATDFVNPTDYDKPIQEVIVDMTDGGVDFSFECIGNVEVMRSALECCHKGWGESVIIGVAGAGEEISTRPFQLVTGRVWRGSAFGGVKGRSQLPDYVQQYMDGKFDLDTFITHNMSLEEINEAFELMHEGKSIRSVIHY

SEQ ID NO: 46318 - protein, 325 aa, Zea mays
  misc_feature (184)..(184): Xaa can be any naturally occurring amino acid
  misc_feature (266)..(266): Xaa can be any naturally occurring amino acid
MAEEPAIVVAASSSCQVDLGNLMAYDPCHHVAAAASASREELRQECLRKGTELAQAVADALFALPPTEDRDGPIVHLPPHTVRLPREKHLPKPKPPTKWELFAKAKGITKRKKNKREWDEQTQSWKRTYGYDRVNDDKDVPILEAKLTDEPGVDPFAQRRDEKKKRVEKQEKSRLENLKKAAKXHIQLAAKALPITGTKADLPKKSRKEDLESVVGMASSATASGGKFDEKLPGEKPPKHPGKHRKFLPVAEGKGMGSLEKQQNHXILSSLLARNSDEPLDVSKAITMYKVKKEKQRRKEKNMPSKSDKLKPQKKPHKKSSKKRA

SEQ ID NO: 46319 - protein, 426 aa, Physcomitrella patens subsp. patens
MASYPKALGVAAVAYVAVDYLREVAPGLHQVLQPCLWGFFAVAAAVRAPYYDYWTREFRSIGIFLASLVFMLSCLCVEAMAVQYVTTVLGLDWHWSTAPLPDSGQWLVLAGNEKLPAAIVAFLRAPVIGLHHFLMLFLLLAFSVLYGCVKAPGMGLGARYMFTMGVGRLIRVLTFVATILPSARPWCAHARFKTANYPHPWAQKYYMPYAKDPNMVRQVIDRDEAFAAVGSYPPEYVPNWGSMQFLVNILRPMDPAKIGKGPENWFNTLKRAGGGCNDLVFSGHMYVAVLTAMAWQEAYPGWGSVFIWFLVAHTGQREIRERHHYSVDVVSGIYVGILMWRTTRWIWSSKDHNQKLKLKHLAAMEDDLQKAAKEGDLEGIRSMLNRVSKSGAEEKASERTLLLVAGSILFMTLGLGLLAFKLTADG

SEQ ID NO: 46320 - protein, 323 aa, Synechococcus sp. CC9311
MASSKLRPQAAQIRRWLSGLLVPALVVALLVISPQPSEAARGGRIGGGSFRAPSMPRSGGYGRSYGGGGYGRGYGRGGGMGFPFIIPIFGFGGGGLFGFLVLAAIVGVLVNAVRNGSGGGSPAIGGGYPAPRELSTGPVSMLQMQIGLLASAKSLQTDLRQLAASADTSSSSGLQRVLQETTLALLRQPELWVYANVESGSVPFNASESTFNRLSMTERSKLRAEITTNVGGVRNNNEAESSSSGEADATNEFIVVTVLVASRQSVKLKQVNSGEDLRETLRILGSTSSSDLMALEVIWQPDGSGDVLSADELVMAYPNLQHL

SEQ ID NO: 46321 - protein, 293 aa, Bacillus licheniformis ATCC 14580
MSKICVIGSSSMDLVVTSPKRPAAGETVLGESFKTVPGGKGANQAVAAARLGAEVHMIGCVGDDHYGKAILDNFQANGVLTDYVEPVTGQESGTAHIVLADGDNSIIVVKGANDHVTPEYVQKALPAIKQADIVLIQQEIPEETVDYVSGLCSSLGIPLLLNPAPARPLRPETVEHAAYITPNEHEASVLFQGMSREEALKRYPEKLFITEGKNGVRYHNGLEERVVPSFPVNAIDTTGAGDTFNAGFAVALSEGQSIESALRFANRAASLSVLKFGAQGGMPKRDEVERELS

SEQ ID NO: 46322 - protein, 362 aa, Triticum aestivum
MGSTAVEKVAVATGDEEACMYAVKLAAASILPMTLKNAIELGMLEILVGAGGKMLSPSEVAAQLPSKANPEAPVMVDRMLRLLASNNVVSCEVEEGKDGLLARRYGPAPVCKWLTPNEDGASMAGLLLMTHDKVTMESWYYLKDVALEGGQPFHRAHGMTAYEYNSTDPRANCLFNEAMLNHSTIITKKLLEFYRGFDNVETLVDVAGGVGATAHAITSKYPHIKGVNFDLPHVISEAPPYPGVQHIAGDMFKKVPSGDAILLKWILHNWTDDYCMTLLRNCYDALPMNGKVVIVEGILPVKPDAMPSTQTMFQVDMMMLLHTAGGKERELSEFEELAKGAGFSTVKTSYIYSTAWVIEFVK

SEQ ID NO: 46323 - protein, 502 aa, Zea mays
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 46324 - protein, 280 aa, Oceanobacillus iheyensis HTE831
MVNQIPNVTLHDGLTIPKVGFGTYRLNGNDGVQAINNAIDHGYRLIDTAYNYENEGTVGEAVRRSSTPREQLLITSKLPGRYHHYDKAVTTIQESLYRANLDYYDLYLIHWPNPIQDIYVEAWQALIEAKRRGYIRSIGVCNFLPEHLERLKQETGELPTINQIELHPFFNQEDQRKWHQEHQIATESWSPLARTNDVLDHPVLQKLASNHNRTVSQIILRWHYQLDAIAIPKSATPSRQLENISIFDFELSDEEMSIINQLSKVDGRMKDQDPAVYEEF

SEQ ID NO: 46325 - protein, 233 aa, Xanthomonas campestris pv. vesicatoria str. 85-10
MALLHFSELPMQPTAIAPSILSADFARLGEEVNNVLKAGADWVHFDVMDNHYVPNLTIGPMVCQALRKHGITAPIDVHLMVEPVDRIVPDFADAGATTISFHPEASRHVHRTIQLIKSHGCQAGLVLNPATPVDILDWVLPELDLVLVMSVNPGFGGQAFIPSALDKLRAIRRKIDATGKPIRLEIDGGVKADNIGAIAAAGADTFVAGSAIFNAPDYAQVIAQMRAAVDAVR

SEQ ID NO: 46326 - protein, 628 aa, Oceanobacillus iheyensis HTE831
MIACSIQNIKKMYGGNLIFERISLEINENERIGIVGRNGSGKSTLLRLMAKIEDPDEGKIHWRKNTEVGYLEQIQAEMNGLTVYHVLKSAFETLNDLEIQMQEYEEKMQDTLENVSDLVIQYGEIQERFSFLGGYERDAQIEKVCRGINIISLLELTFQQLSGGEKTKVALATILLKQPDFLLLDEPTNHLDISAVEWLASFLNDYPGTVVIVSHDRYFLDETVTKIIDLEDGEAVMYETNFSNHIKEKESRLLKEFQDYQEQQKKIKKMREAIKRLREWANRANPPNEGLHKRARNMERAIERMEKIDKPLLHRNKMGLDIETADRSGKDVVRLEDVKKRFEEHLLFENVNMHIRYQERVAIIGENGTGKSTLIKILLQSQQPDVGTVYIGNNVKIGYLSQHVFQDINPTKTVIEVFREQIAVEEGRARYILAQFLFYGYAVFRKVSELSGGEKMRLRLAQLMYEDINTLVLDEPTNHLDIDSREVLEEALENFQGTIIAVSHDRYFLDKIFRRIYWIEDKTVYDYDGNYSWAREKMNDNRIKRKEILDIRNNSKQYATISQPIIPVPSKNKEQENLLEQIEKLEQELVTIEGKMEKTMDVDQLMVLQKNKEEIEQLWEHYFLLIEE

SEQ ID NO: 46327 - protein, 501 aa, Campylobacter jejuni subsp. jejuni NCTC 11168
MMANLYLMRSRSDELNTIISTNLLKNYSKIYKNIAIYCPVIYIHRVPVLQGWLEEFNINQTVKSAYGFTFREAMEEFSKDPHNFFNVILEEYEELKRKYDFVLVNSFCEFGILDGFDLSIKLAKNLNTPIAAIINDEDKLIAQKYFDHALDGRNYVLINENFNFEEVQKLKEYDFITPHRFKYELIKQSIKNKKTVVLPESNDERILKAAEILLKSKVVDLILLGDEEKIKQDATRLSLDLSAMQIMNPLNSEYNQKFTSILYEARKSKGMSLEEAKMLVQDKTYFGTLLIHTGKADAMVSGASTTTAETIRPALQLIKTKEGISSVSGIFFMGLEDQVLAFADCAVNPSPTAEQLATSAYVSAMTAKSFGLEPRIALLSYSSGDSGKGESVDLVKEALKIAKEKYPELNIDGPMQFDCAYDPKTAAKKMPNSKIAGHANVYIFPDLNAANICYKAVQRTANALAIGPILQGLKKPVNDLSRGCLVDDIVDTVILSAIQAQ

SEQ ID NO: 46328 - protein, 527 aa, Bacillus licheniformis ATCC 14580
MEKLKIGSKQMVVSPHYLASLAGSIIMEKGGNAFDAAVAVSACLAVVYPHMTGLGGDAFWLMYHNGSGEIKGYNGSGRSGRKADRDQYKGERAIPVRGPRSAITVPGMVDSWAEILAAYGRLSLREVLKPAIMYAEKGFPVSPDQCQNTVKNAEWLSCMPITADIYLPGGKPPSPGERFVQKELARTLTLIAEKGRDTFYKGEIAQALAAYLQNNGGILNLEDFGLHRGEWVSPLSSTYRGYAIYQMPPNSQGFTGLMTLNILENYDFGMIEHGSFEYYHLLIEALKLSFSDCNKVLTDPEFSQIPLGRLLDKEYARELAAKIGLPALQAESRPLGSDTSYAAAVDEDGNAVSFIQSLYFEFGSGVTAGDTGVILQNRGAFFSLDPDHVNTLEPGKRTFHTLMPAMAFRGGKPKFLYGTQGQGGEGQPQTQTALITRMVDYGMDPQTAVHEPRWVWGRTWGERVEGVRIESRVAPEVIAKLRKHGHHVTVVGEFDGVMGHAGIIEIDDQGFLRGGSDPRSDGAAIGI

SEQ ID NO: 46329 - protein, 338 aa, Erythrobacter sp. SD-21
MTQIPVRERTLDLIGNTPLVRLAGPSEEAGCDIYGKCEFANPGASVKDRAALYIIRDAEARGELKPGGCVVEGTAGNTGIGIALVANALGYRTIIVMPDNQSREKMQTLRALGAELVTVPPTKYADPQHFQHVSRRMAEETDGAIWAGQFDNIANRKAHIEGTAKELWEQLEGRIDGFTCAAGTGGTIAGVGMGLKELDETVTIALTDPHGAALYNYYANGELKGEGSSVAEGIGQGRITGNLEGAPIDTQFRISDEEGLNWVSRLLREEGLCLGLSSGINVAGAVALGRHLVAEGRENSRVATILCDTGFRYLSTLYNADWLRSKDLPVFDWLEDSD

SEQ ID NO: 46330 - protein, 487 aa, Corynebacterium efficiens YS-314
MSPPHPQRVRLVDVERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 46331 - protein, 476 aa, Coccidioides immitis RS
MANNTVPLIVDNKDVVTSTAFDVNSPGTGKAIYQCSSATVDDATRAVDSAHTAFKSWSKTKPAVRQDIMLKAAEIYLRRKDELIGYCAEETGASGPFPEITFGIGYQMFKDVAGRAANIEGVVPQLLEDGQSAIVYRVPYGVILSIVPWNAPFPLGLRAILLPLMAGNTVVLKASELSPKTFWGIADVLREAGLPAGCLNVVYHRPADAAEITTALIAHPAVRKVNFTGSTVVGSIIASTAGKYIKPVLLELGGKASSIVLDDADLDKAATQCILGAFLNSGQVCMSTERIIVQQAVAVKFRSALVETMKNMYHDDAPSPILINATPVAKNKKLISDAVSQGAGIVHGDLHREESSATRMKPVIIENVTPDMDIHATESFGPTVSLFVVETEEEAIALANDTEYGLTSAVFTTNLGRGLRVAKQIESGAVHINSLTIHDEPALPHGGMKKSGFGRFGGISGLNEFLTTKSVTWMDI

SEQ ID NO: 46332 - protein, 906 aa, Kluyveromyces lactis NRRL Y-1140
MELVNSNSEKKKQQLEVFSKYASVLTAEQKKLGEPYASDVSDSGETGESVLRYDDFIRLISNSQSLYSKFTDHSFNLNQIPKNVFGCIFFAMDEQNKGYLTINDWFHFNNILEFNNYHLIVLYEFFRKFDVARIRARQTSNIDDQRVKYINYGNKFLSFDELYLNVDQFKSTISFLQKCVNDEFIMKNDLALNWNEFRWFPFYQCSPFGKSSGTYFSLNSLVTILQSDLKDEKMFVGFNKLCHLNPSKNCRTLSKNQLSYLLKLFYSHRVSSDVFNSLDLSNTKLIKCDNNYIQYNVIKDIFYLFENFDLLNQVLIRYAQYYEFDENDVREQVITKRDFMEFLNKEYNKVTNIVEFSPSQINLLFSIVSNSKQSRHQCLTSMHHSDETIDDFIHSQVQMGPHINKGTIKEFNENYNSTVDEFSQASSLQEHNERKQSQRVSLLDRLWASKTPKDTAESRNLTMEDFMKILNPNYLNDIVHSMELKRIRSESWYSNFYFYPIFDSIHNFTLGSIAGCIGATVVYPIDLVKTRMQAQRNSVQYKNSIDCVVKIFQTKGIRGLYSGLGPQLIGVAPEKAIKLTVNDFMRQYFMNKSRTIKWYQEILSGATAGACQVVFTNPLEIVKIRLQMRSDYVGENARPQLGAVGIIRQLGLRGLYKGAAACLLRDVPFSAIYFPTYAHLKKDVFNFDPNDKNKRNKLKTWELLLAGGIAGMPAAYLTTPFDVIKTRLQIDPRKGETTYTGVIHAARTILKEESIKSFFKGGPARVLRSSPQFGFTLAAFEMFQGLFPSHFKNHETNSNNDSNNNSSSFGGPKKHSDVEDDTPIVTGLFTTFYKNFKNNHYSHEPVPIEFYGPSVDPYSSNFLNYYYKSCQISKVFIDLDYNFAKFDFNVYRKFQDELKRIGPKSN

SEQ ID NO: 46333 - protein, 352 aa, Bacillus anthracis str. Ames
MYKGLLNQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAEEEPITLVNSVNPYRIEGQKTAAFEICDQLQRAPDVLAIPVGNAGNITAYWKGFCEYEKEKGYKKPRIHGFEAEGAAAIVKGHVIDEPETIATAIRIGNPASWSYAVEAAEQSHGEIDMVSDEEILHAYRLLAKSEGVFAEPGSNASLAGVMKHVQSGKIKKGETVVAVLTGNGLKDPDIAISSNTLDIASVSNNIEQIKEHIKGVIMS

SEQ ID NO: 46334 - protein, 388 aa, Arabidopsis thaliana
MMMPHLSEDLVEEILSRVPAISLKRLRYTCKQWNALFNDQRFSKKHRDKAPKTYLGLTLKDFRIYSMSSNLHGLLHNNNIDLLMEFKGKLSSLNDLNDFEISQIYPCDGLILCSTKRNTRLVVWNPCTGQTRWIKRRNRRMCDTFAFGYDNSKSSCLNNYKILRVCEKIKGQQFEYEIFEFSSNSWRVLDVNPNCIIEGRSVSVKGNSYWFATITKTHYFIRRFDFSSETFQKLPLPFHIFDYNDSRALSAFREEQLSVLHQSFDTEKMDIWVTNKIDETTDWSWSKFFTVRLINRLDYPISMMMKSPLSFFIDEKKNIILCYDKHRENTYKSLVLIVGKDKVYREFYFPESYELGRTYLCNYVPSLVQIKQSGLISTRKRKRKDFSS

SEQ ID NO: 46335 - protein, 299 aa, Triticum aestivum
MEDLSVEELASNLSTYKDQLREVRKFIKEKKDDAGISEYVDMEKELQEVITLTEELLATANPSESAQNDVGLSPPNYSAGVHSEALDDLSQSHEKFAVGTKVQAVYSEDGEWYNATIEGLTPIGYFVSYEGWGNKEEVDPANVRALDVEAADALGQAEKEAEATKMALKRKVEQAATSDYQIRSLPTKLKIDPNDPEDVKAAKRKKIHAFKSKARFEQLDFTQNKRQNAWQQFQTTKGKAKKVGFFSGRKKESIFKSPEDHRGKVGVTGSGKGLTDFQRREKHLHLKDGSSGDTLDYEE

SEQ ID NO: 46336 - protein, 403 aa, Legionella pneumophila subsp. pneumophila str. Philadelphia 1
MVDLFMDKYQYTFSLPKKLQISPMIKVGVAGSGNLEVIIKPNSNFDKTDIIVNTVISGFRNTWDAVIERFVEDYPYGGLSITLNDAGATPPVVSLRLRQAMETYQTGYHKKDSYTEAAARNRIYSLVDENSFTEFLLDKDTPSPTLPQLNMQVETDDGVIIGIAKMNGIDIAIASQQKDFIGGSVGEIHGAKINGLIKYAIKHQLPAIIFLIDSGGVRLQEANVGEIEISEIIRSILDARSAGIKTIGVICGNNGAFGGMGIISGTLDYLIVNQGARIGISGAEVIQAVKGVEVFDSSNRPLVWRVYGGRTRFLKDDVQGYTTNKTMDIRQEIKTALKTLATTPSLSLNSILAEHEQLQKRITSAKNCREEGEWLKNNRPELYQQDIFSVSDQQFLELTNKGK

SEQ ID NO: 46337 - protein, 300 aa, Zea mays subsp. mexicana
RPEIAHAHQPVMSPSHHGWDGNGATAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDRDLDLDLDVTVPSDQEVEKMEEVVRGLATLKGPTLRPRDIAEAVLFLASDEARYI

SEQ ID NO: 46338 - protein, 353 aa, Setosphaeria turcica
MGCGMSTEEKEGKQRNEEIENQLKRDKLMQRNEIKMLLLGAGESGKSTILKQMKLIHEGGYSRDERESFKEIIFSNTVQSMRVILEAMESLELPLDDQRAEYHAQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQHETKQIYTHFTCATDTMQIRFVMAAVNDIIIQENLRLCGLI

SEQ ID NO: 46339 - protein, 341 aa, Prosthecochloris aestuarii DSM 271
MNKILVTGAAGFIGFHVSRRLLERGDEVVGIDNLNSYYDVALKEARLEELEPFGQFRFIRMDLADREAMEDLFAIEKFDYVVNLAAQAGVRYSLQNPHAYIDSNIQGFINILEGCRHNHVGHLVYASSSSVYGANETMPFSVHDNVDHPLSLYAATKKANELMAHTYSHLYQIPTTGLRFFTVYGPWGRPDMALFLFTKAIVEGKPIKVFNYGKHRRDFTFIDDITEGVIRTLDHVAAPNPEWSGLSPDPGSSRAPWRVYNIGNSKPVNLMDYIDALERELGKTAEKEFLPMQPGDVPDTYADVDQLIQDVDYQPKTPVAEGIGRFVEWYRGYYGCSVPGD

SEQ ID NO: 46340 - protein, 115 aa, Triticum aestivum
MADLALGAGPEEIWRRRPKTKIVCTLGPASRSVEMCSRLLRAGMCVARFNFSHGSHEYHQETLDNLHKAMDITGILCAVMLDTKGPEIRTGFLKDGKPVKLNQGQEITITTDYTI

SEQ ID NO: 46341 - protein, 509 aa, Zea mays
  misc_feature (72)..(72): Xaa can be any naturally occurring amino acid
SSRQAGKSLPPFPIPPPATTAFVSSSQIPPQPQIELRVDGPCRTALQFPNPPPPKIRRRTGPADGVTQLGFXKPAMEAQWLAEYPHQGADKRPRKRARLAWDVAPTLFQPPKAIPMLYCGQELINGNFTTAFLPPPSIYYTGPPRNISPPWRPDDKDGHYVFAVGENLTPRYRILNKMGEGTFGQVLECWDLENQEAVAIKIVRSLQKYREAAMIEIDVLQRLGKHDFTGSRCVQIRNWFDYRNHICIVFEKLGPSLYDFLRKNSYRSFPIDLVREFARQILESVAFMHDLRLIHTDLKPENILLVSSESIRVPDYKVSIRPPKDGSFFKNLPKSSAIKLIDFGSTTFESQDHNYVVSTRHYRAPEVILGLGWNYPCDLWSVGCILVELCSGEALFQTHENLEHLAMMEKVLGPLPKHMIVRADRRAEKYFKRGVRLDWPEGAASRESMKAVWKLPRLQNLVMQHVDHSAGDLIDLLQGLLRYDPNERLKAHEALQHPFFTRCIRRCGF

SEQ ID NO: 46342 - protein, 437 aa, Saccharomyces cerevisiae
MAVSKVYARSVYDSRGNPTVEVELTTEKGVFRSIVPSGASTGVHEALEMRDEDKSKWMGKGVMNAVNNVNNVIAAAFVKANLDVKDQKAVDDFLLSLDGTANKSKLGANAILGVSMAAARAAAAEKNVPLYQHLADLSKSKTSPYVLPVPFLNVLNGGSHAGGALALQEFMIAPTGAKTFAEAMRIGSEVYHNLKSLTKKRYGASAGNVGDEGGVAPNIQTAEEALDLIVDAIKAAGHDGKVKIGLDCASSEFFKDGKYDLDFKNPESDKSKWLTGVELADMYHSLMKRYPIVSIEDPFAEDDWEAWSHFFKTAGIQIVADDLTVTNPARIATAIEKKAADALLLKVNQIGTLSESIKAAQDSFAANWGVMVSHRSGETEDTFIADLVVGLRTGQIKTGAPARSERLAKLNQLLRIEEELGDKAVYAGENFHHGDKL

SEQ ID NO: 46343 - protein, 324 aa, Pseudomonas syringae pv. phaseolicola 1448A
MSRIYADNAHSIGNTPLVQINRIAPRGVTILAKIEGRNPGYSVKCRIGANMIWDAESSGKLKPGMTIVEPTSGNTGIGLAFVAAARGYKLMLTMPASMSIERRKVLKALGAELVLTEPAKGMKGAIAKAEELLAGDPEKYFMLAQFENPANPAIHEKTTGPEIWADTDGAIDVLVAGVGTGGTITGISRYIKYTAGKPILSVAVEPDGSPIITQAMAGEEIKPSPHKIQGIGAGFIPKNLDLSIVDRVERVTDEESKAMARRLMQEEGILCGISCGAAMAAAVRLAEKPEMQGKTIVVILPDSGERYLSSMLFSDLFTDQELSQ

SEQ ID NO: 46344 - protein, 311 aa, Desulfitobacterium hafniense DCB-2
MAKQATRDAYGKTLVALGAENKDIVVLDADLSKSTKTADFAKHYPERFFNMGIAEANLMGTAAGLAAAGKIPFASTFAIFATGRAFEQIRNSIAYPKLNVKIAATHAGVTVGEDGGSHQAVEDVAIMRAVPNMTVLVPADGVETQQAIRAAAAYEGPVYIRMGRLDVPLLFDDQYQFEIGKANVLREGSDCVVFANGVMVAAALEAAQDLEQENIRVAVVNVASVKPLDVQTIVACAQKTGAAVTAEEHNIIGGLGSAVAEALSEQAPTPLVRVGIKDTFGESGRPLELLEKYGLTKKEVVAAVKVAIARK

SEQ ID NO: 46345 - protein, 110 aa, Paxillus involutus
MPAEDIKSKAHFDELINSGKTIFIDFHATWCGPCKVISPLFQKLSNEHQGDNVAFYKVDIDDQAEIAQEVAITAMPTFKVYKDGALVGNLIGANQSRLTELVGEHAPKTV

SEQ ID NO: 46346 - protein, 235 aa, Zea mays
MKQEAATSIVVTQEDVLHHYKEPPPRREDDPPALAASLSLPSSLSEDDGDAMPQPSSYAVLPRREGELVSAEELLLVPPLNFAMVDHGVYRSGFPDASNLPFLETLRLRSVLCLCPEPYPEANLEFLRAHGIKLFQFGIDGSKEPFVNIPEDRIREALEVILDASNHPVLIHCKRGKHRTGCVVGCFRKLQRWCLTSIFDEYQRFAAAKTRVSDLRFMELFDVSSIKHLAFESSV

SEQ ID NO: 46347 - protein, 335 aa, Glycine max
  misc_feature (241)..(241): Xaa can be any naturally occurring amino acid
MLDGWVCAFLLVLYCSVEVIDASAGDADPRYRVCITQCQETGCVAQRCFPNCKFSSDGEFIDRPWYMQQEPLYLQWKKWDCQSDCRYYCMLDREKERESHNLGPVKYHGKWPFRRIYGMQEPASVAFSALNLAMHFHGWVSFFILIYYKLPLKDGKKAYYEYAGLWHMYGLLSLNSWFWSAVFHSRDVDITEKLDYSSAVVLLGYSLILATIFSYIHYGFTASILMRGILCASERNISFNXWNMIVCVVMAMAQLSMWAVWAGVSNHPSRWKLWLVVISGGLAMLLEIYDFPPYEELFDAHALWHVTTIPLTYIWWSFIRDDAEFRTSNLLKKAK

SEQ ID NO: 46348 - protein, 276 aa, Erythrobacter sp. SD-21
MTEYQVIDSDQTVYRDGTIKLHGPEGFEGMRKAGRLAAEILDELTGFVKPGVTTGQIDDKAREMMLDAGAVPATMGYRGYAHSCCTSINHVICHGIPSDKALKDGDIVNIDVTPLLDGWHGDTSRMFFAGEPALKARKLVDVTYECLMLGIEAARQPGARLGDIGAVIEAHARQHRYGVVQEFCGHGLGRLFHDAPEVIHTGRKGTGPLLKPGMFFTIEPMINLGRPHAKMLSDGWTAVTRDKSLSAQFEHSIGITEDGVEIFTTSPKGLHKPPYA

SEQ ID NO: 46349 - protein, 256 aa, Shigella flexneri 2a str. 2457T
MKCFTLSSQRRRIIGIPIFCTSIFLIFFSVCCFFTLFAAIAHKTVLFCILKDLHKANNAPKVISKSFIAEVSMSDVLRPYRDLFPQIGQRVMIDDSSVVIGDVRLADDVGIWPLVVIRGDVHYVQIGARTNIQDGSMLHVTHKSSYNPDGNPLTIGEDVTVGHKVMLHGCTIGNRVLVGMGSILLDGAIVEDDVMIGAGSLVPQNKRLESGYLYLGSPVKQIRPLSDEEKAGLRYSANNYVKWKDEYLDQGNQTQP

SEQ ID NO: 46350 - protein, 526 aa, Leptosphaeria maculans
MAVLATVAGPLGDFTAKSSNFVLAITGFASFILVAVVLNVLKQLLFKKANEPPVVFHWLPIIGSTVTYGMDPYAFFFRNQKKYGNVFTFILLGRKMTVCLDTTGNNFILNGKIKDVNAEEIYSPLTTPVFGKDVVYDCPNSKLMEQKKFVKFGLTQEALRSYVVIITQETEDFLKRHKAFKGQKGTFDVTKVMAELTIYTASRSLQGEEIRRSFDSKFAELYHDLDMGFSPVNFMLSWAPLPHNRARDHARETMIELYSNIVRKRRAGVAKDSHDMIWHLMDCKYKDGTPVPEHEIAGIMIALLMAGQHSSSSTIAWILLRLAQNPHIIEELFEEQNTVLGADLPALTYEDLQKLPLHAQVVKETLRIHAPIHSIMRRVKQPLVVDGTNFVVPTSHTLMSSPGFSAQLDSHFANPSHWDPHRWDAGNSQYDEEADEKDDEKIDYGWGVVSKGTNSPYLPFGAGRHRCIGEQFAYLQLQTILVAFVREFKLRNVGGSRDIIGTDYTSLFSRPLAPGIIEWERREKVE

SEQ ID NO: 46351 - protein, 577 aa, Neurospora crassa
MLNRFRPARLVAQSSRCLPLTRARAGPLPVNNARTLATRAAAVNTKEPTERDNITTLSNGVRVASEDLPDAFSGVGVYIDAGSRYENDYVRGASHIMDRLAFKSTSARTADEMLETVEKLGGNIQCASSRESMMYQAATFNKAIPTAVELMAETIRDPKLTDEELEGQIMTAQYEVNEIWSKAELILPELVHMAAFKDNTLGNPLLCPKERLDYINRDVIQTYRDAFYRPERLVVAFAGVPHERAVKLAEKYFGDMKASDAPGLSRTGSETSVDSLVSESSEASSESSSSSSDSSESSGGLLSKLFSPKAKKATPNPFLTRVPISTEDLTRPAHYTGGFLTLPSQPPPLNPNLPTFTHIQLAFEGLAISDDDIYALATLQTLLGGGGSFSAGGPGKGMYSRLYTNVLNQHGWVESCVAFNHSYTDSGLFGIAASCYPGRTLPMLQVMCRELHALTTDHGYSALGELEVSRAKNQLRSSLLMNLESRMVELEDLGRQVQVHGRKIPVREMTRRINELTVKDLRRVAKRVVGGMANNAGQGSGAPTVVLQEATVQGLKTTELGWDQIQDTIAQWKLGRR

SEQ ID NO: 46352 - protein, 329 aa, Schizosaccharomyces pombe 972h-
MSNLLVQVSKTGPSSVLQVITKEIPKPAPNGLVIKNAYAGLNYIDTYLRTGLYTAPLPYIPGKEAAGVVAAVGDKVEADFKVGDRVVYLTPFGAYAQYTNVPTTLVSKVSEKIPLKIASAALLQGLTAYTLIEEAYPVKTGDTVVVHAAAGGVGLLLCQMLRARNVHVIATASTAAKRRIAIKNGAEIACSYEDLTKVVADYTNGKGVDAAYDSVGIDTLSSSLDALRNGGTMVSFGNASGAIDAIPLKFLSARCLKFVRPSLFGYITGHAVFEGYVSRLWKEILDNNLNIAIHHIFKLSEAKEAHDAIESRATTGKLLLLCNEDLADA

SEQ ID NO: 46353 - protein, 469 aa, Erythrobacter sp. SD-21
MASAKDVLERIKDEEIEWVDLRFTDPKGKWQHLTMVAKTLDEDQLEDGLMFDGSSIAGWKVINESDMILKPDLERVYVDPFSAEPMLIMFCDIVEPSTGEWYARDPRTTAKRAEAFLKSTGLGDTIYVGPEAEFFMFDDVRFEDGYAGSGYAIDDIELPTNSGKEYESGNLAHRPRAKGGYFPVAPVDSAVDIRGEMVSTMIEMGLNCDKHHHEVAAAQHELGLTFGTLVETADNMQIYKYVVHQVAHIYGKTATFMPKPIKDDNGSGMHTHMSIWDGGKPTFAGNQYGGLSENCLYYIGGVIKHAKALNAFTNPTTNSYKRLVPGFEAPVLLAYSARNRSASCRIPYGAGDKAKRVEFRFPDAMANPYLAYAALLMAGLDGIQNKIHPGEAMDKNLYDLPPAELADVPTVCGSLREALEALEADHEFLLKGDVFTKDQVDAYAELKWDEVLRVETTPCPAEFDMYYSA

SEQ ID NO: 46354 - protein, 298 aa, Zea mays subsp. parviglumis
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMALRRAGSIVSVASVAAVLGGLGPHAYTASKHAIVGLTKNAACELGAHGVRVNCVSPFGVATPMLINAWRQGHDDATADADRDLDLDLDVTVPSDQEVEKMEEVVRGLATLKGPTLRPRDIAEAVLFLASDEARYI

SEQ ID NO: 46355 - protein, 717 aa, Ginkgo biloba
MAMLMASTAILRPNSKQSPSMFFGLLPCGLRQQIKPGNLEFEQSRRKVGKAYAAALSEKGEYYSEKPPTPLLDTINYPIHMKNLSLRELKQLADELRADLIFDVSRTGGHLGSSLGVIELTVAIHYVFNAPEDKIFWDVGHQAYPHKILTGRRDKMPTLRQTNGLSGFTKRSESEYDSFGAGHSSTSISAGLGMAVGRDLKGRNNHVISVIGDGAMTAGQAYEAMNNAGYLDSNMIVILNDNKQVSLPTANLDGPIPPVGALSSALSRLQSSRPLRELREVAKGVTKQLGGSMHELAAKVDEYARGMISGSRSTLFEEMGLYYIGPVDGHNIDDLVTILREVKATHTTGPVLIHVVTEKGRGYPYAERAADKYHGVVKFDPATGKQFKGKAQTQSYTTYFAEALIAEAEVDKNIVAIHAAMGGGTGLNMFLKRFPSRCFDVGIAEQHAVTFAAGLACEGLKPFCAIYSSFLQRAYDQVVHDVDVDLQKLPVRFAMDRAGLVGADGPTHCGAFDVTYLSCLPNMVVMAPSDEAELFHMVATAAAIDDRPSCFRYPRGNGIGVQLPIGNKGVPLEVGKGRILAEGDRVALLGYGTVVQNCLAAGALLEEQGLSLTVADARFCKPLDRDLIRSLAREHEVLITVEEGSIGGFGSHVSQFLSLDGLLDGKLKWRPLVLPDRYIEHGAPIDQMADAGLTASHIAASVLNILGRTRDAPQIMS

SEQ ID NO: 46356 - protein, 298 aa, Zea mays subsp. parviglumis
RPEIAHAPQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDASEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDRDLDLDVTVPSDQEVEKMEEVVRGLATLKGPTLRPRDIAEAVLFLASDEARYI

SEQ ID NO: 46357 - protein, 338 aa, Legionella pneumophila subsp. pneumophila str. Philadelphia 1
MLRQYSKNINKLLIYKELIMGILIDGIWHDENNINTDKEGRFVRAESGFRQHITANGESGFKAEPDRYHLYLSYACPWACRTLIMRKLKGLEKIISVSFSDPVMGKNGWSYGESGNETADHINHIHYLKELYLVARKDYTGRVTVPVLWDKKKKTIVNNESSEIMRMLNSEFNAFSSTDHDYYPKQWRQKIDEINQLVYENINNGVYKCGFAKSQKAYEEAFDALFNTLNQIENLLATQRYLLGEQLTEADWRLFTTLIRFDAVYHGHFKCNLQRIADYPHLSNYLRELYHFPGIKETVNFNHIKQHYYRSHLSINPTGIVPKGPKLNLDEPHNRYEF

SEQ ID NO: 46358 - protein, 414 aa, Debaryomyces hansenii CBS767
MRFIRSFIPGIRCSNSLIFKRRASIDYLVSSLNRAEETNKEEHPSQKCNINILKPSEIPPKDSTKLVISPNELTDHFRYKEYPKPTRRQISETQALFNNSSFKLEWTLDKYDEIPYMRYKRLKEEKTEKLSKVEPYRKTEYHLTQLNSKKTFGIQPEHLKPMPEVLLLGNTNVGKSSLINSLLVNREENKSANLSTEHAFVSKRAGYTKTLNCFNIGNKLRIMDSPGYGEFGELSQGEVITDYITKGQSLRRVFVLIDSVKGFQEEDLHIIDFLISEGISFDLIFTKVDQVIQKFMPKKLINSKHANKPKSVEERVNNATLIKQCNKKVIDYFGSMIEESNMSNLVTLPKLFFNNVQTNKFVPGRQGYKEIRYEILLSCGLVKEDTVGSGAAIQEETMMKQNALRRKTKVQRLM

SEQ ID NO: 46359 - protein, 400 aa, Rickettsia akari str. Hartford
MSVKIIVPLLGESVTEATIAKWYKKEGDSVKTDELLLEIETEKVTLEVNAPCNGTIGKISKTDGANVAVGEEIGDINEGAAVNTAGTHTESAKAQEVTQPTSEKPVDRPAMVNNILAPSVQKLVTENKLDPNNIKGTGKDARITKSDVLETINTKSAATSTTVNKTNEERVQRVRMSRLRKTIAQRLKDSQNTAAILTTFNEIDMSKVIALRNQYKEEFEKKHDVKLGFMSFFVKATIEALKLIPSVNAEIDGDDLVYKNYYDIGVAVGTEQGLVVPVVRDADQMGFAEVEKAIGTLAKKAREGKLSMADLSGGTFSISNGGVYGSLLSTPIINPPQSGILGLHKTEERAVVIDGKIEIHPMMYIALSYDHRIIDGKEGVSFLVKIKQLIENPEKLLLNL

SEQ ID NO: 46360 - protein, 2110 aa, Candida albicans SC5314
MFTIMTKFQKTNHGLLLCQWLKVYINPELEKDACGVGFTCHLKGVPSHKIVSDAKSLLCNMTHRGGELNPQDGDGAGLLSSIPHKFLKREFQYYCNVELPAKGQYGVGNVFFKKDDAVFEKSKKTFESIADSLGLKVLGWREVPHDSSILGAAALSREPYILQPAVVYKEIWGQEVSDDEFDSKYRKDFEKRLFILRKQASHTIGLHNWFYICSLSNKTIVYKGQLAPKQVYSYYHDLVNAEYESHFALVHSRFSTNTFPSWDRAQPLRLAAHNGEINTLRGNKNWMRAKEGVMKSKLFGDEMDKLFPIIEEGGSDSAAFDNVLELLVINGVVSLPEAVMMMIPEAWQNDENIDPKKKAFYEWAACLMEPWDGPALFTFADDRYCGANLDRNGLRPCRYYVIDDDRMICASEVGVIEIQPEKVIQKGRLQPGRMLLVDTKEGRIVDDRELKSKVASRYDFKSWVLANMISLQDLNEKLASRKIDINAKPIDVNVNVQSDPRLIAAGYSHEQILFVLAPMAEGNEALGSMGNDNALACISEQPKLLYEYFRQLFAQVTNPPIDPIREKIVMSLECYVGPQGNLLEMKPDQLNRLLLKSPILTSSELLAIKNIQTVYPSWSVANIDITFEKSEGIQGYINTIDRICQAASQAIADDNQIIILSDVATSAERLPISALIAVGAVHHHLVRQKQRSKVALIIETQEAKEVHHACCLVGYGADAINPYLAMETLVRMKHQGLLKNESLTEEKIIQNYKGSIDAGILKVMSKMGISTLASYKGAQIFEALGIDNSVIDRCFAGTASRIKGVTFEYIAQDAFTLHERGYPTRDTIKPIGLPETGEYHWRDGGDAHINDPAAIASLQDAVRNKNERAYEAYAKKENEAVRNCTLRGLLDFEFESSTEVPIDQVEPWTEIVRRFFTGAMSYGSISMESHSTLAVAMNRLGGKSNTGEGGEDAARSQVLENGDTMRSAIKQVASGRFGVTSYYLADADELQIKMAQGAKPGEGGELPGHKVSAEIGKTRHSTPGVGLISPPPHHDIYSIEDLKQLLYDLKCANPRARTSVKLVSEVGVGIVAAGVAKAGSENILVSGGDGGTGAAKLTSIKYAGLPWELGLAESHQTLVLNDLRGRVILQTDGQIRTGRDIAIACLLGAEEWGFATSPLIAMGCIYMRKCHLGTCPVGIATQDPELRKKFEGTPEHVINFFYYLANDLRKFMAKLGFRTINEMVGRTEKLKVRDDLRNTKNANIDLSPILTPAHTIRPGVATHCVRKQDHKLHIRVDNKLIDESELTLAKGLPVTIDCEVVNTDRSLGTTLSYRVSKTFGEQGLPHDTIHVNVTGSAGQSFGAFLASGVTLELEGDANDYIGKGLSGGRIIVYPPRESKFKAEDQIIAGNTAFFGATSGSAFIRGIAAERFAVRNSGAIIVTEGTGDHGCEYMSGGRVVVLGATGRNFASGMCGGIAYVLDMAQDFSEKVNRAQVELSQVTETEEIAFLRNLIEDHRHYTGSEVADNILNDFNRYLPRFVKVLPNDYKKVLEKEKKLAEEAKKKELSSFLKSIKEDPESDVTNGEAYKIKKGHVHHPNKGKNEPKVADVEDTIFNTEFEKKAPVKLDKLRGFMKYKRRNEKYRDAKARTKDWNEMTSRLTKEELKYETARCMDCGVPFCTSDTGCPISNVIPKWNELVFNDRWYDALQRLMMTNNFPEFTGRICPAPCNGACVLGINEDPVNIKSVECAIIDHGFEQGWIKPTPPAHRTGKTVAVIGSGPAGLAAADQLNKAGHLVTVYERSDRPGGLLMYGIPNMKLDKGIVKRRTDLLAAEGIEFICNTTVGEDITVSELKSQFDAVVFAVGSTIPRDLRIPGRELKNINFAMQLLHSNTKALLDDQLEDIRKNLAGKNVVVIGGGDTGNDCLGTSTRHGAKSVTNFELLPNPPNARPKDNPWPQWPRIFRVDYGHTEVATHYGKDPREYSILSKEFVGDEEGNVKGIKTVRVEWKRSDSGAWQMAEVPGSEEFFPAEVVLLSMGFLGPEADNLEVQKTKRGTITTVDPNVYKVDKDDNVFAAGDCRRGQSLVVWGIQEGRQCAREVDEYLMGSTRLPGNGSVEQRNYKLLEELAEKV

SEQ ID NO: 46361 - protein, 174 aa, Sulfolobus tokodaii str. 7
MKMKLSPGKKAPDEVNVLIEIPLGSNIKYEYDEEEEVVKVDRILYTSMVYPFNYGFIPGTLEEDGDPLDVLVISNYPLLPGTAIEVRPIGILYMRDEEGEDAKIIAVPKDKVDPTFSNIKDIIDLPQAIKDKINHFFEHYKELEPGKWVKISGWGGVSEAKTRINEAIKRANSK

SEQ ID NO: 46362 - protein, 298 aa, Zea mays subsp. parviglumis
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDRDLDLDVTVPSDQEVEKMEEVVRGLATLKGPTLRPRDIAEAVLFLASDEARYI

SEQ ID NO: 46363 - protein, 261 aa, Triticum aestivum
  misc_feature (186)..(186): Xaa can be any naturally occurring amino acid
  misc_feature (204)..(204): Xaa can be any naturally occurring amino acid
VTLQKSLYKKAGCHRSGIPGISSTHASALQAGFDSSYSDYGMLDDLSAFPCAQDKSLPTADEQFNDNYPFNEQKNVDVYGEQAYQGGAMELLSTDQICNEDGNLDMIGERYSSENALQQLEDRKFSVPSGSQLSSSQNLLKQKHHSDKTSPSNITSDCYSHRNCQFSPSGSFAQRNLMVQKQVANXKPGQLINDEGKLGQQTCXKSSYPLGEHEVEKKAFGKRRKNPWGTSITGEGFLWGDLFLLEIPLQNTASRQPSVGS

SEQ ID NO: 46364 - protein, 281 aa, Mycobacterium avium subsp. paratuberculosis K-10
MTGESGSAAPSIALNDENTMPVLGLGVAELSDDETERAVSAALEVGCRLIDTAAAYGNEAAVGRAIAASGIPRAELFVTTKLATSDQGFKGAMDACEASLERLGLDYVDLYLIHWPAPALGTYVNSFGGMIQSRGNGHARSIGVSNFTEEYLTTVIDLTFVTPAVNQIELHPLLNQEALRKTNAEHNVVTQSYTPLALGKLNDHPTVNSVAAEYGKTASQVLLRWNLQLSNAVIFRSANAEHIASDFDVFDFELAAEHMDAINALNDGTRLRPDPDTYEGS

SEQ ID NO: 46365 - protein, 362 aa, Zea mays
  misc_feature (163)..(163): Xaa can be any naturally occurring amino acid
  misc_feature (213)..(213): Xaa can be any naturally occurring amino acid
  misc_feature (221)..(221): Xaa can be any naturally occurring amino acid
MPLRPLPVCTASINQQARSISHLTPPLPLQNLSIPRLAIHPSRIYTTGKSLLQKSLGQPGPPFSRHFHNTTSLQTAKTMTDTNVEAAKRAAAQQAVADHFDPAATHVGIGSGTTIVYVVEAIKQRSTNPNILFVPTGFQSRQLVVNAGLTAISFDSLPDHVIXDVAFDGADEVDAELNCIKGGGACLFQEKLVAERARKFVCVADYRKRQNRXLTNWPTIXIEVAPLSQLKVAGALRMLGSTGPKLRTTLLEKSGPLKTDQDFYIIDAPFPPLLTSADVAAGKGKGDGTDGTWEVNTLSRAIKGLTGVLEVGIFSGLNGIDAQALREQDQSMKTVRGGQKPVAVYFGMQDGSIKVRTIEGET

SEQ ID NO: 46366 - protein, 489 aa, Saccharomyces cerevisiae
MSADFGLIGLAVMGQNLILNAADHGFTVCAYNRTQSKVDHFLANEAKGKSIIGATSIEDFISKLKRPRKVMLLVKAGAPVDALINQIVPLLEKGDIIIDGGNSHFPDSNRRYEELKKKGILFVGSGVSGGEEGARYGPSLMPGGSEEAWPHIKNIFQSISAKSDGEPCCEWVGPAGAGHYVKMVHNGIEYGDMQLICEAYDIMKRLGGFTDKEISDVFAKWNNGVLDSFLVEITRDILKFDDVDGKPLVEKIMDTAGQKGTGKWTAINALDLGMPVTLIGEAVFARCLSALKNERIRASKVLPGPEVPKDAVKDREQFVDDLEQALYASKIISYAQGFMLIREAAATYGWKLNNPAIALMWRGGCIIRSVFLGQITKAYREEPDLENLLFNKFFADAVTKAQSGWRKSIALATTYGIPTPAFSTALSFYDGYRSERLPANLLQAQRDYFGAHTFRVLPECASDNLPVDKDIHINWTGHGGNVSSSTYQA

SEQ ID NO: 46367 - protein, 469 aa, Pseudomonas fluorescens Pf-5
MSQIEDTTVPAQSTADAAQPQLKAARPLAANIKIKDGFPVMPGKIPLLGHVHKIGKDALGELRQAEAACGPMFWTYFGSQLPVLQIVDEAGLAILQNKYTDNSFLREQMPVITGEAMNAFDGPRHRNARKASTDAFTPKGLTRAKVGQFIMETIDQRLKHWSRENQLAIFPQTKDIALEVVFRILGIATHELELWRHQYEEFFLGMIPLKINLPGFPAWRCRKARGWLEQRVAQIVATTRANNDHDSLVGAMILGRDEQGNGLSEVELVHNILGLGFAGSETTAAVMAWSALMLSQHPDVWQQLCEQVAGLESLPVTHEELVRQVPLAEGIFRETMRLYPPAPFEMRKVHTEFELLGQRIPAGVMAGVSLLHVSRNPERYPDPDSWRPERWLGLDRALNQVETCQFGGGPHACLGRHVAALEITLFIAMLARELGPKGNVPRLVGKMPPPAYLPFLRPSNKAFLDFSGA

SEQ ID NO: 46368 - protein, 643 aa, Synechococcus sp. CC9311
MSQAYQPLHHKYRPQRFDQLVGQEAIAATLGHALTSGRIAPAYLFSGPRGTGKTSSARILARSLNCLSHDGPTPQPCGTCELCNTIARGTALDVIEIDAASNTGVDNIRDLIERSRFAPVQARWKVYVVDECHMLSTAAFNALLKTLEEPPPQVVFVLATTDPQRVLPTILSRCQRFDFRRIPLEALNSHLAWIAEQESIPIQPEALHVVAQRAQGGLRDAESLLDQLSLLPGPIKADAVWDLLGAVPEQELLNLAEALAEGEPLTLLEASRRLLDRGRDPGAVLQGLAGILRDLVLMAVAPDRPELTGVSPQFREQLPALAKRLGRQRLLYWQAQLKGSEQQLRQSVQPRLWLEVLLLGLLAEAELPVAKPSSAAPGSNPPSSAQASIPPAISTPALTSTDPAAETTAPPPVSLPNTSPQPVVSSEPAPTPQSVQDPDPDSHNLAELWQQILASLELPSTRMLLSQQAQLVRLDPHRAVVQVAGNWMGMVQSRASLLEQAIKRSIGGNRQLVLENHGGAAPMASTPAAATQSTPSTPITAPTASQAQPSQPKPASPAPVAVPAVQPSSITPVAAPTTNSPPASAKPPSVVSAEGSGPGSPSMGSPTPPPQADVSPPSIMDEKVKRFADFFNGQVLDVELDND

SEQ ID NO: 46369 - protein, 337 aa, Prosthecochloris aestuarii DSM 271
MASSAIQIGLTQDQVETKYKEYHKRINDALAGCFTKSTPETLYAPARYILEGKGKRIRPFLTLLAAESVCNSSDDALNAALGVEILHNFTLMHDDIMDQADLRHGRPTVHLKWDENAAILSGDMMIAFAYECALNTKTDRHAELVHILNDANITICEGQALDMELEQRAEATIADYLDMISKKTGRLISAALEAGGVVGNADALQLQALVTFGEKIGRAFQVQDDYLDIMADDGKSGKIPGGDVINGKKTYLLLRSIELTEGNERKLLQSIIANKGIEPERVPEIRAIFEQCGVLEEARQLINRDTEEALSAIDPLPFGEGRDHLKGFALKLMKRDF

SEQ ID NO: 46370 - protein, 328 aa, Idiomarina baltica OS145
MVYWRPDFAPGQQIVLAQPYRRDVWRQSARPARKCIESLAQLLRQYHPICLLTPQTVSYDDIWMRDILPLWYQEESGEWRGLLMEFDGWGDVQQTIEQDSQLPEQLFAEQLYPVSKLIGEGGMLTHNGQVALMGLAALKSRQPELTVKQLSRRVEKNLAGLEVYFFDGKLSADETSGHMDNLALFIADDVLLYCATEDPTHPDFLTCQKLAEVIEQLPPEITKVPLPLPKPQQPLAQDRAGIISDSQSLVRDLSLPICCSYTNLIATDKVIVVPQFDLSTDEPALDVIQRYAGNRKVVSHPARELVLGGGGLHCVSHQVPADIALPVI

SEQ ID NO: 46371 - protein, 385 aa, Oceanobacillus iheyensis HTE831
MSECIGMLLAGGEGKRLGMLTKQGAKPAVPFGGKYRIIDFTLSNCTNSGIQTVGILTQYAPLELNKHIGNGKPWDMNHQHGGVSILPPYTGTKGGDWYSGTADAIYQNMNFIHQYEPEYVLIISGDHIYQMDYQQMLEQHKRTNADVTISVIEVPWAEAGRFGILHANDEQIIYEFEEKPKNPSSNLASMGIYIFNWKTLKKYLIEDANKPNSSRDFGKDIIPSMLNNQHRLYAFKFNGYWKDVGTIQSYWEANMDVLKDNNGYFSLHDRNWRIYTHDSNLPPHFIGTNGKAVNSYINSGSIIYGHIKNSIVFRNVSVQQGSYINQSIIHPNVKIGKDCVLDRVIVMENTTIPEGTIFRSDKEIEPFIINNEILNSMLAPAGGDV

SEQ ID NO: 46372 - protein, 368 aa, Oceanobacillus iheyensis HTE831
MERMMGLVNLEHEHHLLNELAYFRNPASIPFGGRYRLIDFTLSNMVNSSIQEVAIFVRNKYRSLLDHIGTGENWELDRRNGGLFILPPDWNDPTDRSRGDLKFFHNNRDYFNRSNSKYVLISGSQFISNTDYKEALEQHIKEQADVTLITVREEELSNEHESNLRVECDYIHRVQALTNDKNNPEIFTGVYIINKDLLIELVDNCIAYHKDHFFHAAIMERLGDLRVFRFRQEGYHAFINSVESFYKHNMKLLQEDSYQQLFLNNHFVRTKISNNAPVKYGEKAEVVNTLVANGCKVNGCIEGSILFRGVQLHEGATVKNSIIMQRCTIGSGVHLENVILDKDVVVTTGQRIIGSKEKPYVVAKRQVI

SEQ ID NO: 46373 - protein, 81 aa, Triticum aestivum
  misc_feature (11)..(11): Xaa can be any naturally occurring amino acid
QKNQLFPVKPXTKVFKAIPLISDQGFGPLPVISGPQIIGMVSLGPLVGAVVTEPKEEFNRVNAFIQGGVLGPPVFQGVPFS

SEQ ID NO: 46374 - protein, 276 aa, Zea mays
MIGSFITGMLTLVLGYAYPAYDCYKTVELNRPEVEQLRFWCQYWILLAFLTVLERVGESFVSWLPMYSEAKLAFIVYLWYPKTRGTAYVYESFFKPYIAKHETEIDRNLLELRTRAGDMAVLYFQRVTNYAQTRSYEILQYIASQSPTQRQAHQQQQRPPPPRTRQVNPAPPPIPAPSAPPMPPQPAQAQVPPTPPRPLVPVVPPGAVPPAPPPTAPEATATNGLQDTETMQVDPPRASLSGPPLPPEETLIEEAIRLTRGRLRRRLAGGSGPPQN

SEQ ID NO: 46375 - protein, 422 aa, Streptococcus thermophilus
MTVTIENIHAREIFDSRGNPTVEVDVRLTDGTLGRAAVPSGASTGDREAVELRDGGARLQGKGVSKAVANVNGEIYEALKGQSPFNQAKLDHLMIELDGTENKSCLGANAILGVSMAIFRAAANSEKIPLYRYFGGVDLELPQPFFNVINGGVHADSGIDVQEFLITPVKRDSFRDGLKKIANIYHTLKKILSDKGLKTPVGDEGGFAPKLGTTENAIAILYQPIDSAGYFPGEKIAIAIDSSSIEFYDDKKKFYRFEGKNLTSKELLTYYDNLVEKYPALISIEDGFSEHDWEGFAAQTKARGQKIQLVGDDIFVTNPTIFKEGIKKNVANAILIKLNQIGTVTETIETISLARKAGYKTMISHRSGETVDSYIADFSVAMHAGQIKSGSMARSERVEKYNQLLRIEEDLGKDVALAQFPG

SEQ ID NO: 46376 - protein, 358 aa, Pseudomonas putida
MSQFHSLTIKQVRNETRDAVSIAFDVPEHLQAQFRFTQGQYLVMRTQLDNEEVRRSYSICSAVQDGELRVAVKRVPGGRFSAFANEVLKAGQQLEVMPPAGSFFVPLDAARQGNYLGVAAGSGITPILSIIGTTLDSEPHSCFTLLYGNRSSSGALFRDKLEDLKNRYLDRLNLIFVFSREQQDVDLYNGRVDADKCGQLFSRWLDVPGLDAAFICGPQAMTETVRDSLQANGLGKERIHFELFAAAGSETRREAREAAHQVDSALSHITVISDGRALTFDLPRNTQNVLDAGNAIGAELPYSCKAGVCSTCKCRVIEGEVEMDSNHALEDYEVAAGYVLSCQTYPVSDKVVLDFDQL

SEQ ID NO: 46377 - protein, 199 aa, Pseudomonas putida
MPCYRLDGLTPVVHPTAYVHPSAVLIGDVIVGPRCYIGPLASLRGDFGRIVLEEGANLQDTCVMHGFPGGDTVVERNGHVGHGAVLHGCKVGEDALIGMNAVVMDGAHVAPRCIVAATAFVKAGFACEAQSLVMGSPAQVKRPLSEQELAWKQRGTAEYQHLAQRCMNSMVECPPLAEAEPGRPRMEDTGVRPKGQASA

SEQ ID NO: 46378 - protein, 545 aa, Arabidopsis thaliana
MTNVSLFYASLSILFCCFLFFFNLSPSFFFLRLSRSVTTSFNILNIHLSHFAIRLSSTLVMSRHFLFLGIIILLFSAFVASAPSSTSPAKIVNSFISNHGTSLLKWLWSLSFKTTTKTAVPTKSMVKFENGYSVETVLDGSKLGIEPYSIQVLSNGELLILDSQNSNIYQISSSLSLYSRPRLVTGSPEGYPGHVDGRLRDARLNNPKGLTVDDRGNIYVADTVNNAIRKISEAGVTTIAGGKMVRGGGHVDGPSEDAKFSNDFDVVYLGSSCSLLVIDRGNQAIREIQLHFDDCADQYGSGFPLGIAVLVAAVFFGYMLALLQRRLSSIVSYHTDQEVFEAVPDQDPIKPVRPPLILTGDEQEKQEESFLGTLQIFISNAWVFSVELFSGMFPGLRKKQTVGLNFNHQETKHSAFSTTSWPIQESFVIHNKDEPPPVESRNATPGKIYPFMSKDATEKMQQLRQSRALYRSLDAEFLQEQQQEKHQQYHHRHHSTIPYTLYEQSSEKTNEIVFGPGQEQDQMNTHQNIHHRAHQFVSYPYGYYS

SEQ ID NO: 46379 - protein, 549 aa, Shigella flexneri 2a str. 2457T
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHISEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 46380 - protein, 466 aa, Arabidopsis thaliana
MEPPFERSKRLHNFSLPQLRWGQQRFLRCVNLPSPPPSSSSPDHAATNRSVSIAGVSLTRGGGGGAKNGEVVAAAKPWNLRMRRAACSEPGEEIEIGDNKRRSIIDNEDGGGDKKNEKSKFSIALSRDEIEQDFSFVFGKKPPKRPKKRPRLVQKKLNTIFPGLWLNEEEVTIDSSLTQILLLEYVSWLASVVCFTNGTLSYVSGGLEQAFLYTTSHISEALQRISFSSDLGQSDKAPPPVIEPSGLIRRDETLLDSSNSDFEFHISNSFDPGDSSPADEIFADGMILPFHVTAASTVPKRLYKYELPPITSSLSPSPLSPQPLPTKHSEKETNGRASGANSDSEAEKSSKSFWSFKRSSSLNCDIKKSLICSFPRLTRSNSTGSVTNSKRAMLRDVNNHRPSSRSSCCNAYQFRPQKHTGKKGEGGGSFSVIPVLNGPSTFGLGSILRHSNSKDKTKTKKKKNKK

SEQ ID NO: 46381 - protein, 114 aa, Triticum aestivum
  misc_feature (64)..(64): Xaa can be any naturally occurring amino acid
VAIGCTKSDYFLDFRCATQPLTVMLPRYNDHPLTLCYGEEKASGKYWCDICERESNPKTWLHTXCKELWRSHLHVFCVVGDVIYTNPGAMIKCYIEKLSNNSSSRPLCHRCHCR

SEQ ID NO: 46382 - protein, 327 aa, Burkholderia mallei ATCC 23344
MAHAIRFHETGGPEVLRREETQVGAPGPGEVRVRHAAVGLNFADIYFRTGLYPAKLPSGIGVEAAGIVTAVGGNVAGLAVGERVTYTGSPLGAYSTERVMPADSLIRLPDAIGFDTAAAMTMRGLTSAYLMRRIHAWQAGDTFLLHAAAGGVGLIVCQWAKLLGLNVIGTVSSDEKADIARAHGCDHVIVHRREDVAKRVRELTNGVGVAVVIDSVGKSTFAASLDSLKRRGLLVGVGTASGPFPPIDAMQLAIKGSLFFTRPALADYIADPAEKAALAGELFDHVAAGRIRIEINQRYELNDAVQAHRDLEAGRTTGSSIFVVDGD

SEQ ID NO: 46383 - protein, 233 aa, Schizosaccharomyces pombe 972h-
MEEYETDIKQILGTVDRQTVSAKQVRQLLEERRKVDLSAHKKDLNALILKCFDETAAPSEKESLEKQAPARKTKGKRATENGTEEGKKPAKRTRKRKEDGEEGGKRKRNQDPANNPLNKPMKLSPKLAEFLGLEQLSRPQTVKKLWEYIKAHDLQDPNDKRTILCDDKLKSVFEVDTLHMFTMNKYLTNLMTKIPDDQLPKPQPKNEEPAAPNDLPKQEEKELVEPPTAESTA

SEQ ID NO: 46384 - protein, 649 aa, Schizosaccharomyces pombe 972h-
MFSIFKRRSVQAALAASGLVGGAVFYSDFIKRPAPSHFNPQFTPFTKSLAPPPSRETLLKNVEDISKFDVLIIGGGATGTGVAVDASTRGLNVCLLEKTDFASETSSKSTKMAHGGVRYLEKAVFQLSKAQLDLVIEALNERANMLRTAPHLCTVLPIMIPVYKWWQVPYFFVGCKIYDWVAGSKNLRASTIFSKETTVAIAPMLDDSNLKASCVYHDGSFNDTRMNTTLAVTAIDNGATVLNYMEVKKLLKSKDNKLEGVLAIDRETGKEYQIKATSVVNATGPFSDKILEMDADPQGEPPKTAQFPRMVVPSAGVHVVLPEYYCPPNIGILDPSTSDNRVMFFLPWQGKVIAGTTDKPLSSVPTNPTPSEDDIQLILKELQKYLVFPVDREDVLSAWCGIRPLVRDPSTVPPGTDPTTGETQGLVRSHFIFKSDTGLLTISGGKWTTYREMAEETVNELIKDHDFGKALKPCQTKKLILVGGENYYKNYSARLIHEYHIPLRLAKHLSHNYGSRAPLILELYSKTDFNKLPVTLADKEVFAPSSDASSDKSVSYASFDEPFTVAELKYSIKYEYTRTPTDFLARRTRLAFLDARQALQAVAGVTHVMKEEFGWDDATTDKLAQEARDYIGGMGVSSDRFDVKQFEVK

SEQ ID NO: 46385 - protein, 289 aa, Zea mays subsp. parviglumis
RPEIAHAHQPVMSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDASEFDRVLRVNALGAALGMKHAARAMAPRRAGSIVSVASVAAVLGGLGPHAYTASKQAIVGLTKNAACELGAHGVRVNCVSPFGVATPMLINAWRQGHDDATADADRDLDLDVTVPSDQEVEKMEEVVRGLATLKGPTLRPRDIAEAVLFLA

SEQ ID NO: 46386 - protein, 614 aa, Staphylococcus aureus subsp. aureus MW2
MEFLSLVIVVLAAFLTPIIVNRLNINFLPVVVAEILMGIVIGNSFLNIVERDSILNILSTLGFIFLMFLSGLEIDFKAFKKDKRARQGQNNDESSIPGHLNLALTVFAFIMIISILLAYVFKWLGLVDDVLLMVIIISTISLGVVVPTLKEMNIMRTTIGQFILLVAVLADLVTMILLTVYGAINGQGGSTIWLIGILVVFTAISYILGVQFKRMSFLQKLMDGTTQIGIRAVFALIILLVALAEGVGAENILGAFLAGVVVSLLNPDEEMVEKLDSFGYGFFIPIFFIMVGVDLNIPSLIKEPKLLIIIPILIVAFIVSKLIPVMFIRRWFDMKTTIASAFLLTSTLSLVIAAAKISERLNAISAETSGILILSAVITCVFVPIIFKKLFPVPDEFNRKIEVSLIGKNQLTIPIAQNLTSQLYDVTLYYRKDLSDRRQLSDDITMIEIADYEQDVLERLGLFDRDIVVCATNDDDINRKVAKLAKAHQVERVICRLESTTDDTELVDSGIEIFSSYLSNKILLKGLIETPNMLNLLSNVETSLYEIQMLNYKYENIQLRNFPFGGDIIFVRIIRNNESIVPHGDTQLRYGDRLIVTGAKEYVDELKQELEFYF

SEQ ID NO: 46387 - protein, 316 aa, Bacillus cereus ATCC 10987
MPKKVLIFCDPGIDDTMALLLAFFIDEIEIIGIVADYGNVPKEMAVQNAHFLKNETMNRNIKIFGGSERPLTGAPPAFFTDVHGKQGLGPIIPKGNVTNGEMENFFEVIPLIEQYKDEVIIVSLGRLTSLAILFIVCKQLMKQIKSYYIMGGAFLHPGNVTPISEANFYGDPAAANIVLQSSPNMYIYPLNVTQYSIITPEMAEYIEAKGKAPLVKPLFDHYYYSYYKNALPHLKGSPFHDTMPILALLDNSMFTYHKSPIVIMTESYAQGASIGEFRSLEESKPFIDRPIHQIAIDFDYNRFFKHFMSLMTGEEF

SEQ ID NO: 46388 - protein, 87 aa, Prunus armeniaca
SVTESIEAVRMSKKAGWGVMASHRSGETEDTFIADLSVGLATGQIKTGAPCRSERLAKYNQLLRIEEELGAEAVYAGAKFRVPVEPY

SEQ ID NO: 46389 - protein, 431 aa, Bacillus cereus ATCC 10987
MSTIIDVYAREVLDSRGNPTVEVEVYTESGAFGRAIVPSGASTGEHEAVELRDGDKSRYLGKGVVNAVNNVNEIIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERLGSKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 46390 - protein, 509 aa, Bacillus cereus ATCC 10987
  misc_feature (489)..(489): Xaa can be any naturally occurring amino acid
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSDGEPMTAHTTNPVPFIVTKNDVELREGGILGDIAPXMLTLLGVEQPKEMTGKTIIK

SEQ ID NO: 46391 - protein, 444 aa, Saccharomyces cerevisiae
MGKLLQLALHPVEMKAALKLKFCRTPLFSIYDQSTSPYLLHCFELLNLTSRSFAAVIRELHPELRNCVTLFYLILRALDTIEDDMSIEHDLKIDLLRHFHEKLLLTKWSFDGNAPDVKDRAVLTDFESILIEFHKLKPEYQEVIKEITEKMGNGMADYILDENYNLNGLQTVHDYDVYCHYVAGLVGDGLTRLIVIAKFANESLYSNEQLYESMGLFLQKTNIIRDYNEDLVDGRSFWPKEIWSQYAPQLKDFMKPENEQLGLDCINHLVLNALSHVIDVLTYLAGIHEQSTFQFCAIPQVMAIATLALVFNNREVLHGNVKIRKGTTCYLILKSRTLRGCVEIFDYYLRDIKSKLAVQDPNFLKLNIQISKIEQFMEEMYQDKLPPNVKPNETPIFLKVKERSRYDDELVPTQQEEEYKFNMVLSIILSVLLGFYYIYTLHRA

SEQ ID NO: 46392 - protein, 251 aa, Bacillus cereus ATCC 10987
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLEAVK

SEQ ID NO: 46393 - protein, 394 aa, Bacillus cereus ATCC 10987
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPAVQEMVAAMNEGDVLVLENVRFYAGEEKNDAELAKEFAALADIFVNDAFGAAHRAHASTAGIADYLPAVSGLLMEKELDVLGKALSNPDRPFTAIIGGAKVKDKIGVIRHLLDKVDNLIIGGGLAYTFVKALGHEIGLSLCEDDKIELAKEFMQLAKEKGVNFYMPVDVVITEEFSETATTKIVNIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 46394 - protein, 547 aa, Debaryomyces hansenii CBS767
MGLTDFYKKLSSAEETNDNSETVSYNSSNDKEAAVVQLDQNKKEIGYLSATSLCLNRMLGAGVFSTGSTIFSLSGSVGTSLIMWAAGSIIAFTGLYVYMEFGSAIPRNGGEKNYLEYMYKKPRFLITAMYASYAFFLGWASGNSIVVGEYLLNAAEVEVTQWNSRAIGIGVITFAFIVNGINVKFGLFLGNILGLFKIVIVLLITVTGWVALGGGIHTNGFQAPDNFSNAFEGESPSGFGIVNALYNVIWSYVGYSNINYALGEVKNPVKVLRIAAPTAFISLAIIYMFVNIAYFAVVPKEEIANSGRILAASFFRYAFGKTAETASSVFVALSALGNVMSVIFSQGRIIQQLGREGSLPFSRFFATQKPFNTPFVGLMQHWIVCIVTIVAPPPGDAYNFILNLISYPLNVVNTAVAFGPSYIHWQKRRGLVEWDPPIKASIPIIVFFAFSSLYLIVAPYIPPTDGQTVYQDLPYWIHPVVTWGVFGVGAVYWLLWAKVLPHFGGYRLVAKEVLGEDGFWRNKFYKISRDETNAVDEDGDEIAERII

SEQ ID NO: 46395 - protein, 384 aa, Mycobacterium tuberculosis CDC1551
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPLPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 46396 - protein, 334 aa, Bacillus cereus ATCC 10987
MTKIGINGFGRIGRNVFRAALNNPEVEVVAINDLTDAKTLAHLLKYDTVHGTLNAEVSANESSIVVNGKEIKVIAERDPAQLPWSDYGVEIVVESTGRFTKKADAEKHLGGSVKKVIISAPASDEDITVVMGVNHEQYDAASHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 46397 - protein, 174 aa, Saccharomyces cerevisiae
MSAIPENANVTVLNKNEKKARELIGKLGLKQIPGIIRVTFRKKDNQIYAIEKPEVFRSAGGNYVVFGEAKVDNFTQKLAAAQQQAQASGIMPSNEDVATKSPEDIQADMQAAAEGSVNAAAEEDDEEGEVDAGDLNKDDIELVVQQTNVSKNQAIKALKAHNGDLVNAIMSLSK

SEQ ID NO: 46398 - protein, 333 aa, Mycobacterium avium subsp. paratuberculosis K-10
MGAGAWGTALAKVLVDAGGPGTEVTLWARRPELAERINATRSNPDYLPGTSLPPGIHATADAGEALRDATTVLLGVPAQAMRANLERWAPLLRDGATLVSLAKGIELGTLMRMSQVIVSVTGVDPAQVAVISGPNLASEIAACQPAATVVACSDSGRAVALQRMLNSGYFRPYTNSDVVGTEIGGACKNVIALACGMAAGVGLGENTAAAIITRGLAEIMRLGIALGAKGATLAGLAGVGDLVATCSSPHSRNRSLGERLGRGATIGSVLAGSPDGGDGHVVEGVTSCQSVLALAASYDVEMPLTDAVHRVCHKGLSVDEAMALLLGRRTKPE

SEQ ID NO: 46399 - protein, 377 aa, Streptomyces coelicolor A3(2)
MKAVVYKGPFSVAVEDVEKPDIRHPNDVIVRVTSTAICGSDLHMYEGRTAAEPGIVFGHENMGIVDQVGQGVTGLKKGDRVVMPFNVACGFCTNCAAGYTGYCTTVNPGFAGGAYGYVSMGPWQGGQAEYLRVPYADFNCLKLPEGDAHETDFILLADIFPTGYHGCELADVRPGESVAVYGAGPVGLMAAYSALLRGAKKVFVVDRVPERLQKAEEIGAVPVDFSAGDPVEQIKEQTEGAGTDKGVDAVGYQATAGGTGKEEPATVLNSLVNTVRPTGALGVPGLYVPADPGGPDEQAKQGMLLVAIGKLFEKGLRVGTGQCNVKRYNRQLRDMIIEGRAEPSFVVSHELPLDQAPSGYDKFDKRIEGYTKVVLHP

SEQ ID NO: 46400 - protein, 102 aa, Brassica napus
  misc_feature (82)..(82): Xaa can be any naturally occurring amino acid
MTAIYSLYITNKSGGLIFYKDCAPHGRIDTNNSLRVASLWHSKHANSQQLPPVRGSAGIELHQTDTFDLHCVQSHTGTKYFXVREPETLHIESLLTYIYELY

SEQ ID NO: 46401 - protein, 160 aa, Arabidopsis thaliana
MHSSLKTMAPAKLERLCVLSFFLFCATVFGTESLESLPEDKLILRGLKFYGFHGVLPEERELGGLFIVDINLWLSLKKAIESDNLADTVSFADTFRLVKKIVEGPPRNLYETVADDIASEMLETFPKINVIRVKFGKPNPSLVNSTVDFLGAELFRKRNH

SEQ ID NO: 46402 - protein, 454 aa, Magnaporthe grisea 70-15
MEDILLALSNGTWHKDPGTISILLLTVLAFLVPMIYVYPPFPPRESDALAETHSKVGLEPSAAKPGLRAAQALPSDVLSAGPPRVQSLWIYPVKSCAGIELDRSVVLPSGLEFDRLFTLAQLKSPFPVRLDSDADEKSRHGWEFITQRQFPALANVRVELWRPDRAKCERRGEKIRESYLILRFPWMEEGFRGTLAWVAAKTLRGVDARPEKEIMLPVEFPSEADIRNKDYKYENVKIWKETVTALNMSSELSDELQRYLGVSNKLALFRIDPDKLREVYRGAPTSEVAGYQPVTGFQDAFPLHLLNLSSVRDLNEKVSQDENLKTLDARRFRANIILTGLPPYEEEKWKSIQLVSDGKSSEETAEFDVSCRTVRCKMPNVNPDNGIKHEKEPDHALRKYRNVDEGAPLNGCLGMQLTPMFKMTGSRVLELESTVKIGMEVKVKGLGSHKYIKQ

SEQ ID NO: 46403 - protein, 596 aa, Zea mays
MGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVTDEDIAVLVRARGHMLQVLKLDKCSGFSTDALRLVARSCRSLRTLFLEECIIADEGSEWLHELAVNNSVLVTLNFYMTELKVEPADLELLARNCKSLISLKMSDCDLSDLIGFLQTSKALQEFAGGAFFEVGEYTKYEKVKLPPRLCFLGGLTFMGKNEMPVIFPYSASLKKLDLQYTFLTTEDHCQLIAKCPNLLVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPA

SEQ ID NO: 46404 - protein, 132 aa, Triticum aestivum
  misc_feature (21)..(22): Xaa can be any naturally occurring amino acid
  misc_feature (37)..(37): Xaa can be any naturally occurring amino acid
  misc_feature (43)..(43): Xaa can be any naturally occurring amino acid
  misc_feature (52)..(52): Xaa can be any naturally occurring amino acid
  misc_feature (56)..(56): Xaa can be any naturally occurring amino acid
  misc_feature (62)..(62): Xaa can be any naturally occurring amino acid
  misc_feature (66)..(66): Xaa can be any naturally occurring amino acid
  misc_feature (70)..(71): Xaa can be any naturally occurring amino acid
  misc_feature (76)..(76): Xaa can be any naturally occurring amino acid
  misc_feature (78)..(79): Xaa can be any naturally occurring amino acid
  misc_feature (86)..(86): Xaa can be any naturally occurring amino acid
  misc_feature (89)..(89): Xaa can be any naturally occurring amino acid
  misc_feature (105)..(105): Xaa can be any naturally occurring amino acid
  misc_feature (110)..(110): Xaa can be any naturally occurring amino acid
  misc_feature (112)..(112): Xaa can be any naturally occurring amino acid
  misc_feature (114)..(114): Xaa can be any naturally occurring amino acid
  misc_feature (117)..(118): Xaa can be any naturally occurring amino acid
  misc_feature (120)..(121): Xaa can be any naturally occurring amino acid
  misc_feature (123)..(125): Xaa can be any naturally occurring amino acid
  misc_feature (128)..(128): Xaa can be any naturally occurring amino acid
MKLNIANPTTGCQKKVEIDDXXKLRNLYDKRISQEVXGDLLGXEFKGYIFKXMGGXHKQGSXMKQXVLTXXGRFPXLXXKGTPCFXGFXKRNGLTQGGILPWVAXQPILXGXNXGIXXKXXNXXXRLXTLGT

SEQ ID NO: 46405 - protein, 105 aa, Oryza sativa
HPLRVGAEVERTLRAGNLKYRRGNPTVDVDLVARDGRLHRSVEPSGAYTEIYEALELRHGDGTGYAWKGELNALRNINEVIEPKLLHLDDRNQSDVHASMLDIAG

SEQ ID NO: 46406 - protein, 682 aa, Oryza sativa Indica Group
MAGQERRTIDLEEGWAFMQKGITKLKNILEGKPEPQFSSEDYMMLYTTIYNMCTQKPPHDYSQQLYDKYRESFEEYITSMIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 46407 - protein, 387 aa, Oceanobacillus iheyensis HTE831
MKQSNRLKQLPPQFFASLVQKVNQAISEGRDVINLGQGNPDQPTPAHIIKALQSAVEDPITHKYSPFRGTDDFRKAAATFYKREYQVDLDPDTEIAVLFGSKIGLVELPLALMNPNEWMMLPNPGYPDYLSSIPLADIQYDTMPLLEENNFLPNYEQLTLSQKERTKLLYLNYPNNPTGATANNAFFNETVALGKNHDIGIVHDFAYGAIGFNEEKPISFLQTKGAKEVGIELYTLSKTYNMAGWRIGFAAGNKEMIEAINILQDHLFVSVFPAIQRAASEALLSDQSSVQDLVTLYQKRRDALITECKRIGWDINAPQGSFFAWLPVPNGFTSETFADYLLNEVDVAVAAGNGFGTFGEGYIRVGLLVDEQRIVEAIKRIEGLKLF

SEQ ID NO: 46408 - protein, 307 aa, Triticum aestivum
MASRCAARLPHPPCAAPQHGWASSRVSARPAQSGASRGRAVACAVSFRPCIDIHKGKVKQIVGSTLRDASDDGTALVTNFESDKSPAEFANIYKEDGLVGGHVIMLGGDPASRSAALEALHAYPGGLQVGGGINLENAMSYLNEGASHVIVTSYVFSDGKMNIERLTQLVELVGKQRLILDLSCRKKDGRYAIVTDRWQKFSDVFVDGPTLERLAAYADEFLVHGVDVEGKRLGIDEELVELLGSHSPIPTTYAGGVSTMDDLERIKKAGKGRVDVTVGSALDIFGGDLPYDTVVRWHKEQNLVSQR

SEQ ID NO: 46409 - protein, 99 aa, Triticum aestivum
  misc_feature (37)..(37): Xaa can be any naturally occurring amino acid
TTASAPTTTRGTQQLVDCYPLSSTEKSREILVDFFFXRGIMVDFFDIWQETLSKKSLPGRFIHVESEFPEYGFSDRHSFQHTAVQHATCLQQLMAAVRV

SEQ ID NO: 46410 - protein, 472 aa, Salmonella choleraesuis
MITPIIMAGGNGSRLWPLSRTLYPKQFLCLDGSQSMLQTTITRINNLNASDPIVICNEQHRFIVAEQLKELSKSSGDIILEPVGRNTAPAVALAALKCLKKNALLLVLAADHIIKDEETFCKTIQDARKYAEAGKLVTFGIVPTMPETGYGYIRRGQALFSAENDCSLAFRVAEFVEKPNLETAQSYLDSGEYYWNSGMFLFFRADRYIEELKIRPDIYKACSLAMESAVTDLDFIRVDEDSFCACPDESIDYAVMEKTNDAVVVPLNAGWSDVGSWSSLWEISDKDSNGNVTKGDVLSHNADNCYLHAETGLVTAVGVKDLIVVQTKDAVLVANTNCVQDVKKIVEKIKLENRHEHITHREVYRPWGKYDSIDFGERYQVKRITVKPGEGISEQQHYHRAEHWIIVAGTAKITIKGEVKILTENESVYIPVGVKHCLENPGKIALELIEVRSGAYLGEDDIVRFSDKYGRN

SEQ ID NO: 46411 - protein, 251 aa, Oceanobacillus iheyensis HTE831
MLNTKLESEAFALLKDKIQLIQQNDHAIYLVGPIQLPINLDGETTVFQWYCWLNFDEITEDYENMIEKLSSANLAEYQQSSVLVYGDFAHAEEALIRMHSICHTGDIFGSKRCDCGFQLKESMKKIREHGTGALFYLANHEGRGIGLFSKAMAYVLQENGYDTVEANESLGYVNDARDYEDAISVLRTLRSKPVTLITNNPLKVDALENAGLQLSGRTPLWGDRSEYNKKYLDTKVIKSGHLREDGKCSND

SEQ ID NO: 46412 - protein, 210 aa, Campylobacter jejuni subsp. jejuni NCTC 11168
MTLEQILEKTKNVRLVAASKYVDASIIEKLFDQGIVEFGENQVQALAQKKENLDEKKLDIKWHFIGTLQSNKINLLIKQKPILWHSCNGIKIAKAMDKRLDYKLNTLLEINSANENSKSGLDPNQAVEEYLQIQEECSNLNLCGVMSIGSHSQDKENIIKSFETTFKIYEILQKHGAKICSMGMSNDFEIAIKCGSNLVRLGSILFKNLK

SEQ ID NO: 46413 - protein, 592 aa, Salinibacter ruber DSM 13855
MWNQAWAWLRDTLPLLQWLPDYTTEALRGDATAGLTVGVMLIPQGMAYAVIAGVPPIYGLYAGLVPLLVYPLIGSSRHLALGPVSIDMLIIAAGVGAIAQAGTERYVALAILLTAMVGLLQMAMGAMKLGFVANLLSRPVIAGLTTAASFIIAISQIGSLLGVELGRSQYIHVLLIEAVQNAGNTHLLTLGIGTASIVLLMGLPRWLPKVPEALIVVVAGTLAGWGFGLREKGVSVVGSIPQGLPAPELWTLSFSDLNTLLPAAITLALVQFMKDISLDRIFAARHGYTIDANRELIGVGAGNFFGSLFQSIPASGSFSRSAVNEQSGAQTALANVFAAGVIALTLLFLTPLFYHLPTPVLAAIIIVSGFGLFDLRELRSLFKARRRDGYIALFTAGCTLFIGIQEGILLGIGTSVVAMLYRISRPNVAELGHVPGTRLFRDLDRFEQAARLRDIMVLRVDAAFSFANAEYFKDFILEKSEREGRPVKVVIVDGSSINGLDTTAIDALFSVTESLEEEGIELHLTGLIGPVREVVRRSGLHALLGENKFHLDPHQAVVSVLERWDAAEGTDRVTHYFNMADSEETEATPAAS

SEQ ID NO: 46414 - protein, 226 aa, Triticum aestivum
  misc_feature (221)..(221): Xaa can be any naturally occurring amino acid
MLAIRALRTPASRQALRTAAPRAAIFYNRCYSTSGDRVAKYNGTKDAKGNFLVSLIEGDGIGPEIAQSVKDIFAAAKTPIAWEPVDVTPIIKDGKTAIPDAAIDNIKKNKIALKGPLATPIGKGHVSLNLTLRRTFNLFANLRPCRSVAGYETPYDNVNTVLIRENTEGEYSGIEHVVVDGVVQSIKLITREASERVLRFAFQHAESIGRKKVRVVHKPTXMKLSD

SEQ ID NO: 46415 - protein, 453 aa, Neurospora crassa
MFSRLAARLPKASALNGVAARQVRNLSQPAITGSKGRNMPAREPRTTAAATGAEATFTIRDGPVFQGTAFGANTNISGEAVFTTSLVGYPESMTDPSYRGQILVFTQPLIGNYGVPSNERDEFNLLSTSSLPTSSAPVSLSPMSLPSTATGLLFRAWASGAPARAFPPLSGVDTRAIVTYLREQGSSLARISIGDEYDADEDEGFIDPGQINLVKRVSTKAPFVVTNPNAKFHVALIDCGVKENILRSLVSRGASVTVFPYNYPIHKVAENFDGVFISNGPGDPTHCQETVYNLAKLMETSPIPIMGICLGHQLLALAVGAKTIKLSMVIRAHNIPALDLTTGQCHITSQNHGYAVDISTLPSDFKEYFVNLNDGSNEGMMHKTRPIFSTQFHPEAKGGPMDSSYLFDKYMENVELFKSNSQVYRDNRPTQFMIDILSKERVGVEPTPLSNAA

SEQ ID NO: 46416 - protein, 610 aa, Burkholderia mallei ATCC 23344
MTERERAARGRNDARRGGGDSGGDDEAWRRWLPGIATLRTYRRAWLARDLYAGVALTAVLVPVGMSYAQAAGLPVIAGLNASIAALVGYAIFGPSRILVLGPDSALAALIAGAIAPLAHGEPAHAVALAAALALMSGGFCVLAGLLKLGFVTDLLSKPIQYGYLNGLALTLIASQLPSLLGTVPLGGTFVDQVASLAATVAQGRIDFASLALGGGCLAGIALLRRVAPAWPGMLIAVAGASIVAAWLGAAPDAGGAHAHVAYAHVANAHVALVGSLAGTLPPLGLPSISLADASRLIAGALAIAMVSVADISVLSHVFAQHDGSETDRNQELCALGAANLLAGMLRGCAVSSSASRTPVALAAGARTQLTSLVAAACIALLLIAPTLLARVPLAALAAVVVYSANALVDVRAIVRLYRVRRGECAVSVLCFAGVVLLGVVPGILLAVGLSLLSFVWRAWHPYDAVLGRVEGMHGYHDVSRHPGATLTRGLVAFRWDAPLFHANATIFRDHVRDAIAEAGAPVRCVVIAAEPITDVDVTAADMLATLRDELAARRIALVFAEMKGPVKDRLRTYGLFEKIGADHFFPTVTDAIEHFTRMRKDVATARRARR

SEQ ID NO: 46417 - protein, 331 aa, Glycine max
NSYIVAMARFSLDEISDTGAFVRSASTFRNWISRDLNSQFPPESGRYHLYVSYACPWASRCLAYLNIKGLNKAISFSAVKPIFERTNESDDYKGWVFPESETEVPGAEPDMLNGAKTIRELYEIASANYTGKYTVPVLWDKKLKTIVNNESSEIIRMFNTEFNSIAENPTLDLYPTDLKPQIDDTNEWIYTSINNGVYKCGFAKKQEPYNEAARQLYGALDKCEDILSKQRYICGNTLTEADIRLFVTLIRFDEVYAVHFKCNKKLLREYPNLFNYTKDIFQIPGISSTVNMEHIKLHYYGSHPSINPFGIVPVGPNIDYSAPHDRERFSA

SEQ ID NO: 46418 - protein, 370 aa, Schizosaccharomyces pombe 972h-
MGQTLSEPVLDKHSSSGGDRWLHFGVSHMQGWRISMEDAHCALLNFTDSNSSNPPTSFFGVFDGHGGDRVAKYCRQHLPDIIKSQPSFWKGNYDEALKSGFLAADNALMQDRDMQEDPSGCTATTALIVDHQVIYCANAGDSRTVLGRKGTAEPLSFDHKPNNDVEKARITAAGGFIDFGRVNGSLALSRAIGDFEYKKDSSLPPEKQIVTAFPDVVIHNIDPDDEFLILACDGIWDCKSSQQVVEFVRRGIVARQSLEVICENLMDRCIASNSESCGIGCDNMTICIVAFLHGRGLEDWYNWITQRVNSGEGPCAPPSYAELRGPNTIADARNLQLEYDHIASHEYGSGDTYDSDSDDETIAYDRYYLH

SEQ ID NO: 46419 - protein, 261 aa, Zea mays
  misc_feature (234)..(234): Xaa can be any naturally occurring amino acid
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLAEVRKVLGEHAKSXIMLMSKVENQEGVANFDDILANSDAFM

SEQ ID NO: 46420 - protein, 464 aa, Francisella tularensis subsp. holarctica
MIDFQYTYSQLSEQFYSRQAVYKYPNAKLLILNDCLVTELGLDLANKSEQQLLEFLLGYSSKKPISQAYAGHQFGNFTMLGDGRAILIGEYKKPNGELVDFHLKGAGLTKFSRGGDGKAALAPMLREYIVSKAMYNLGIPTSRILAVITTGENIQRNQLKQGAIAVRVASSHIRVGTFQYAAMLGESYSQELLDYTITRHNIPHNDNKALSLLDYVIAKQTSLITEWERVGFIHGVMNTDNMTISGETIDYGPCAFMDSYDPDTVFSSIDRHGRYAFANQASIAGWNIARLAESLLKLISADEEEAIKLAQDKLQSYSETYKNKWQKMFLAKLGLSINKAHNDEMISDLLIEMFKFKLDYTNTFYNLTYKNFGALKDCGLGEWLEKYITKNEINFANMKKINPVIIPRNHQVEKALKSAEDTKFGNLYNLVAALKTPYEFNILTEKYITEPVEEEKIRFTFCGT

SEQ ID NO: 46421 - protein, 349 aa, Anabaena variabilis ATCC 29413
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPVGRYTLLYDPIDGSSNTDTNLSLGSIFSIRQQEGDDSDGQAKDLLTNGRKQIAAGYILYGPSTMLVYTMGKGVHSFTLDPSLGEFILSEENIRIPDHGAVYSVNEGNFWQWEESMREYIRYVHRTEGYTARYSGAMVSDIHRILVQGGVFLYPGTVQNPEGKLRLLYESAPLAFLIQQAGGRATTGLVDILDVVPKKLHQRTPLIIGSKEDVAKVESFIQNGH

SEQ ID NO: 46422 - protein, 301 aa, Oryza sativa
  misc_feature (156)..(156): Xaa can be any naturally occurring amino acid
  misc_feature (174)..(174): Xaa can be any naturally occurring amino acid
  misc_feature (188)..(188): Xaa can be any naturally occurring amino acid
MATQIHHLEQEAYCSVLRAFKAQSDAITWEKEGLITELRKELRVSDVDHRELLNRVNSDDIIRSIREWRSAGGPQAMLPNNAQPMHDLAPSPTTSGRKRQKTSQSFPALPAPPPVMHSQQLALQGPPSSSTAKKGASSGAKGKKTKPGQKVPGGPXSVKAMTSSAGPTGRGHLXRNFPGGPGSFETSXALIIIPLFNRKVLNRGGGPVPKFPPKRESEITPPSRAPAFLKRPGRGEKPRGGSPNFNSPFCNTISPLFFPPVGGGKKKARKKRPPPPPRFPPPPFPPPKKIFCRPPHPTPGK

SEQ ID NO: 46423 - protein, 612 aa, Pseudomonas fluorescens Pf-5
MAKHLGESKQKLLQLMALSCPIRLNNAPRRLAKQARSQRIKRNISKGPGMSLSRCLSGLSNLLHYRREWLRADLRAGLSVAAIQIPIAIAYAQIVGLPPQYGLYACVLPMIVYALIGSSRQLMVGPDAATCAMLGGAVAPLAMGDLQRTVELSMIVTVLVGLMLIAAGIARAGFIASFFSRPILIGYLNGIGLSLIAGQMGKVVGFKIEGDGFILGLADFLQRLGEIHGLTLAVGLASLGLLIWLPRRYPRVPAALLTVALFTLLAGLLGFDRLGVAILGHVPAGMPELSWPKTTLEESKSLLRDALGIATVSFCSAMLTARSFAARHGYAINANHEFIALGLSNLAAGASQGFAISGADSRTAVNDMAGGKSQLVGIIAALAIALILLFFTAPMAWIPQPALGAVLLMAGWGLLDVKSLKQIYRLSRFEFWLCLLTTVSVLGLGVLPGIMFAVTLAILRLLYSIYQPTDAVLGWMPGIEGQVDIRQYPQARTVPGLVVYRFDDAILFFNADYFKMRLLDTVQRESQPEVVLFDAEAVTDIDVSGIAVLREIRETLAAQGIYFAIARARGTFLAMLERSGMTREMDSQLLFGSVRSGIRTYRIWRNSMRGKQ

SEQ ID NO: 46424 - protein, 294 aa, Glycine max
MEQYEKVEKIGEGTYGVVYKGRDRSTNETIALKKIRLEQEDEGVPSTAIREISLLKEMQHRNIVRLQDVVHDEKSLYLVFEYLDLDLKKHMDSSPEFAKDPRQLKMFLYQILCGIAYCHSRRVLHRDLKPQNLLIDRSNNALKLADFGLARAFGIPVRTFTHEVVTLWYRAPEILLGSHHYSTPVDIWSVGCIFAEMVNQRPLFPGDSEIDELFKIFRIMGTPNEDTWPGVTSLPDFKSAFPKWQPKDLKIVVPNLKPAGLDLLSSMLYLDPSKRITARSALEHEYFKDIKFVP

SEQ ID NO: 46425 - protein, 509 aa, Anabaena variabilis ATCC 29413
MVSLLENPLRVGLQQQGMPEPQIIVIFGASGDLTWRKLVPALYKLRRERRIPPETTIVGVARREWSHEYFREQMQKGMEEAHSSVELGELWQDFSQGLFYCPGDIDNPESYQKLKNLLSELDEKRGTRGNRMFYLSVAPNFFPEAIRQLGGAGMLDDPYKHRLVIEKPFGRDLASAQSLNAVVQKYCKENQVYRIDHYLGKETVQNLLVFRFANAIFEPLWNRHFVDHVQITVAETVGVEDRAGYYEKAGALRDMLQNHLMQLYCLTAMEAPNSMDADSIRTEKVKVLQATRLADVHNLSRSAIRGQYSAGWMKGQQVPGYRTEPGVDPNSSTPTYVGMKFLVDNWRWQGVPFYLRTGKRMPKKVSEISIHFRDVPSRMFQSAAQQRNANILAMRIQPNEGISLRFDVKMPGAEFRTRSVDMDFSYGSFGIEATSDAYDRLFLDCMMGDQTLFTRADEVEAAWQVVTPALSVWDLPTDPATIPQYEAGTWEPAEAEFLINQDGRRWRRL

SEQ ID NO: 46426 - protein, 151 aa, Picrophilus torridus DSM 9790
MATAVLETNFGNIEIELFEDDMPVTAGNFRKLVESGFYNGTIFHRVIKDFVIQGGDPTGTGMGGPGYTIKDEFTNHNRNDRGTISMANAGPNTGGSQFFINLVNNNYLDKKHPVFGKVINGMDVVDKIGNLKTDENDRPVERAYIKRAYIK

SEQ ID NO: 46427 - protein, 380 aa, Arabidopsis thaliana
MSMDFSPLLTVLEGDFNKDNTSSATEIDTLENLDDTRQISKGKPPRHLTSSATRLQLAANADVDVCNLVMKSLDDKSEFLPVYRSGSCAEQGAKQFMEDEHICIDDLVNHLGAAIQCSSLGAFYGVFDGHGGTDAAHFVRKNILRFIVEDSSFPLCVKKAIKSAFLKADYEFADDSSLDISSGTTALTAFIFGRRLIIANAGDCRAVLGRRGRAIELSKDHKPNCTAEKVRIEKLGGVVYDGYLNGQLSVARAIGDWHMKGPKGSACPLSPEPELQETDLSEDDEFLIMGCDGLWDVMSSQCAVTIARKELMIHNDPERCSRELVREALKRNTCDNLTVIVVCFSPDPPQRIEIRMQSRVRRSISAEGLNLLKGVLDGYP

SEQ ID NO: 46428 - protein, 605 aa, Sulfolobus tokodaii str. 7
MGVTQFIPLIEVLGAVGITIVLLVLLFRKQTQKFILSDKALQIQQKSQKKKEEVKEKITWDMIGGYDDVKKEIKEYIEIPLKYKEIAKKYGLRPPKGILLFGPPGCGKSLMMRALANEAKINFIYVNVSDIMSKWYGESEARLRELFANARKNAPCILFFDEIDTIGVKRESHTGDSVTPRLLSLMLSEIDGLQSEDGVIIVGSTNVPHLLDKALLRAGRFDKLIYIGVPDKKSRKEIFLIHCKNMPLGEDVDFDKLAEMTERFTGADIANVCQEVARMAAVEALEKGVERKITLQDFINVIKRYKPSVTLQMLDEYEKFRLDYERKFRGPELPESEDAEKITLNDIGGYEEIKKELYDLLEMQFKYYNLMEQMKIPSIRGILLYGPPGVGKTMMAKALARTLGVRLIMLSGAEILYKGYEGAVSAVKEVFNRARENKPSILLLDELDAIAPKRENQKSEASKIVNQLLTEMDGIRSLKEVVVIGTTNRLEDIDPALKRPGRFDRIIYMPLPNKDERKDIFEKYLGKDICEQVNCDKLADITEGYSGADIAAVTREAKLKVLKEIIRGNKERKLTYEDLLEAIAKVKPSVKKEQLNSTSSDLKKE

SEQ ID NO: 46429 - protein, 336 aa, Shewanella sp. ANA-3
MSKRTITVIPGDGIGPSIIDSALKILDKAGCDFEYEFADAGLTALEKQGELLPQRTLELIEKNRITLKGPLTTPVGEGFTSINVTLRKKFGLYANVRPVLSFKGTQARYENIDIITVRENTEGMYSGHGQKVSEDGTTAEATSIVTRQGAEQIATFAYELARKENRKKVTIVHKANIMKSTSGLFLKVAREVSQRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKADLIRKAVSAVIEEGDRTTRDLGGTHGTTDFTQAVLDRLS

SEQ ID NO: 46430 - protein, 784 aa, Streptomyces coelicolor A3(2)
MSSLALYRRYRPESFAEVIGQGHVTDPLQQALRNNRVNHAYLFSGPRGCGKTTSARILARCLNCEQGPTPTPCGECQSCRDLARNGPGSIDVIEIDAASHGGVDDARDLREKAFFGPASSRYKIYIIDEAHMVSPQGFNALLKVVEEPPEHLKFIFATTEPEKVIGTIRSRTHHYPFRLVPPGTLRDYLAEVCGREGIAVEEGVLPLVVRAGAGSVRDSMSVMDQLLAGAGADGVTYDMTTSLLGYTDGSLLDSVVESFVSGDGSAAFGVVDHVIEGGHDPRRFVTDLLERLRDLVILAAVPDAAEKGLIDAPADVVERMQEQARSFGAAELSRAADIVNEGLTEMRGAHSPRLQLELICARVMLPAAYGDERSVMARLDRIERGVQFSGGAGAPAMGYVPGPEAHAGAGAAAPVAAPVPGGGPAAARAAVRGQGAGTPPGGDPSADVAAGAGDGAGAGTGPASDAGGAPPGGGHPQAAPSSADVAPVPAPPSPATPSPAAAPAPAPASAPGAWPSAAPAGGGRRPGGWPTATPAGGGQPRTPAAPASGPAATAAQAPAPAAAAPAPVSPPSGASGVDPRSLWPNILEAVKNRRRFTWILLSQNAQVTGFDGTSLQLGFVNAGARDNFVSSGSEDVLRQALAEQFNVQWKIDAVVDPSGGGAAPPPAGGPSGPSGGLGGSGGGGFGGGSAGAGGFGGGGGFGGGAPAQRPSASASTPAAPPQAPASAPAPAPAPRPSAPEPPPVSPEDDIPEDDDPDLDESALSGKELLVRELGATVVEEITNE

SEQ ID NO: 46431 - protein, 342 aa, Glycine max
MDHQADTNRTDLMTITRFVLNEQSKYPESRGDFTILLSHIVLGCKFVCSAVNKAGLAKLIGLAGETNVQGEEQKKLDVLSNEVFVKALISSGRTCLLVSEEVEEAIFVPSSHRGKYIVVFDPLDGSSNIDCGVSIGTIFGIYMVKNEAEVSLEDALQPGNQMLAAGYCMYGSSCTFVLSTENGVNGFTLDPSLGEFILTHPNIKIPSKGKIYSVNEGNARNWDEPTTKYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 46432 - protein, 469 aa, Zea mays
MMMQLGARSLVRRFSRLAAAGAPAETTSAGVPRMPAFDHVPLPYDGPSAADIARKRAEYLSPSLFHFYSKPLNIVEGKRQYLYDEHGRRYLDAFAGIATVCCGHCHPDVVDAITRQAKRLQHSTVLYLNHVIADFAEALASKLPGDLKVVFFTNSGTEANELAILMARLYTGSHDIISLRNSYHGNAAGTMGATAQKNWKFNVIQSGVHHAVNPDPYRGAFGSDAEKYVRDVQEIIEFGTTGQVAGFISEAIQGVGGIVEVSPGYLPLAYDKVRKAGGLCIADEVQAGFARVGSHFWGFETHGVVPDIVTMAKGIGNGIPLGAVVTTPEVAQVLTRRCYFNTFGGNPLCTAGGLAVLEVLEKERLQENAFVVGSYLKDRLRGLQEKHEIIGDVRGTGFMLGIELVTDRQLKTPAKDEICHAMEHMKDMGVLVGKGGFYGNVFRITPPLCFTKEDADFFVEVMDIALSKL

SEQ ID NO: 46433 - protein, 87 aa, Brassica napus
  misc_feature (10)..(10): Xaa can be any naturally occurring amino acid
MATAPRRLLXALLKALAPAGARGLSTEKAVGAAAVAVVGSHTAKWMQDTSKKSPMELINEVPPIKVDGRIAVCEGAAEGVGLGQGRS

SEQ ID NO: 46434 - protein, 282 aa, Oryza sativa Japonica Group
PEAKFNPSPNVPANPTPPHRRRHRRHPPLTCSIPGADPDDERCLSSLQQSLSGLRNWSKASFSAPCEGFISHLQGVTCNNGRVYKLSLPGLSLAGTIPPDLSNCTNLQSLDLSSNALSGAIPPELSGLLNLAVLNLSANRLSGAIPRDLARCAYLNVIDLHANQLTGSIPDELGLLVRLSTFDVSYNRLSGPIPVLLANRSGTTGRFNATSFVGNKDLYGYPLPPMRGHALSVLAIVGIGLGSGLLSLVLSFSAVCLWLRATDRTATMPGEEGKISHLMPDY

SEQ ID NO: 46435 - protein, 190 aa, Bacillus licheniformis ATCC 14580
MNTIPYVIEKTAAGERSYDIFSRLLKDRIIMIGSEFNDDLANRVTAQLLFLSAEDNEKDISIYINSPGGSTSAGYAILDTMDYVKPDVRTICVGMAASMGAILLAGGAKGKRYALKNSEIMIHQPLGGVKGQATDMEISAKRIIKLREKIERFFHERTGQPIEKLKADMERDYFMDADEAKAYGVIDAVL

SEQ ID NO: 46436 - protein, 436 aa, Corynebacterium efficiens YS-314
MSATHVSEKSPGVIDSGMEPIRAADIQMAQARISSVIAPTPLEYCPRLSEETGVEVYLKREDLQDVRSYKIRGALNSGSQLSREQRDAGIVAASAGNHAQGVAFVCKSLGVQGRIYVPVQTPKQKRDRILVHGGEYVTLVVTGNNFDEASAAAHEDAERTGATLIEPFDARDTIIGQGTVAAEILSQLTTLGKSPDHVMVPVGGGGLLAGVVSYMADMAPRTAIVGVEPAGAASMQAALKAGGPVTLENADPFVDGAAVKRVGDLNYQVVEKNLGRVHMMDVSEGAVCTEMLELYQNEGIITEPAGALSVAGLRDMKFAKGSVVVCIISGGNNDVLRYNEIVERSLVHRGLKHYFLVNFPQKPGQLRSFLEDILGPEDDITLFEYLKRNNRETGTALVGLQLGEASGLDSLLARMDASAIDCRRLEPGTPEYDFLT

SEQ ID NO: 46437 - protein, 383 aa, Daucus carota
MGSLCSKQRHNPADSEENAQTAEIERRIELETKAEKHIQKLLLLGAGESGKSTIFKQIKLLFQTGFNEAELKSYITVIHANVYQIIKILYDGAKELAQNEEESSNYALSDEIKEIGEKLSEIGGRLDYPRLTKELAQEIETLWKDDAIQETYSRGNELQVPDCTLYFMENLQRLAVADYIPPKEDVLYARIRTSGVVEIQFSPVGENKKSGEVYRLFDVGGQRNERRKWIHLFEGVTAVIFCAAVSEYDQTLFEDENRNRMMETRELFEWVLKQPCFEKTSFMLFLNKFDIFEKKVLDVPLNVCDWFKDYQPVYSGKQEVEHAYEFVKKKFEELYFQSTAPHCVDRVFKIYRTTALDQKLVKKTFKLVDETLRRRNLFEAGLL

SEQ ID NO: 46438 - protein, 320 aa, Oryza sativa
  misc_feature (16)..(16): Xaa can be any naturally occurring amino acid
SRASSTCGGSSGFRRXKDGKEVKAVVSPGAAAGANSGSPILASPHPPLPRRRAEIRTREGDPEDFKEDSVGASQDVGSSDHESPLHSPVSYNPPIGCLQQKHCSGNGGGRSFSSGSSAWSSSRSVTDSDDDTGGSPENDDDGVLDDWEAVADALSVDDNHNHQDPVPADPPVVPASCPVPANAATRQEPIKSSTRAWSPDDAFRPQSLPSLSKQVSFPASMGNCWVAMGIGSAQKGVPSKPTSCPICYEDLDPTDSSFLPCPCGFHLCLFCHKRILEADGRCPACRKQYISASSGGETVGSEREMGNLRLSRSCSMGPRY

SEQ ID NO: 46439 - protein, 265 aa, Triticum aestivum
PRSSSGGSHLPAHLRPRKPHRPDHPPRGVVKIMLQFCKENSLHQTFQTLQNECQVSLNTVDSMDTFIADINAGRWDAVLPQVAQLKLPRKKLEDLYEQIVLEMAELRELDTARAILRQTQVMGVMKQEEPERYLRLEHLLVRTYFDPNEAYQESTKEKRRAQIAQAIASEVSVVPPARLMALITQALKWQQHQGLLPPGTQFDLFRGTAAMKQDEEEAYPTTLSHQIKFGKKTHPECARFSPDGQYLVSCSVDGIIEVWDYVSGK

SEQ ID NO: 46440 - protein, 339 aa, Shigella flexneri 2a str. 2457T
MQKINQTSAMPEKTDVHWSGRFSVAPMLDWTDRHCRYFLRLLSRNTLLYTEMVTTGAIIHGKGDYLAYSEEEHPVALQLGGSDPAALAQCAKLAEARGYDEINLNVGCPSDRVQNGMFGACLMGNAQLVADCVKAMRDVVSIPVTVKTRIGIDDQDSYEFLCDFINTVSGKGECEMFIIHARKAWLSGLSPKENREIPPLDYPRVYQLKRDFPHLTMSINGGIKSLEEAKAHLQHMDGVMVGREAYQNPGILAAVDREIFGSSDTDADPVAVVRAMYPYIEHELSQGTYLGHIIRHMLGLFQGIPGARQWRRYLSENAHKAGADINVLEHALKLVADKR

SEQ ID NO: 46441 - protein, 117 aa, Zea mays
EFGTRAVQRVAKAINFKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 46442 - protein, 439 aa, Saccharomyces cerevisiae
MVTKHQIEEDHLDGATTDPEVKRVKLENNVEEIQPEQAETNKQEGTDKENKGKFEKETERIGGSEVVTDVEKGIVKFEFDGVEYTFKERPSVVEENEGKIEFRVVNNDNTKENMMVLTGLKNIFQKQLPKMPKEYIARLVYDRSHLSMAVIRKPLTVVGGITYRPFDKREFAEIVFCAISSTEQVRDYGAHLMNHLKDYVRNTSNIKYFLTYADNYAIGYFKKQGFTKEITLDKSIWMGYIKDYEGGTLMQCSMLPRIRYLDAGKILLLQEAALRRKIRTISKSHIVRPGLEQFKDLNNIKPIDPMTIPGLKEAGWTPEMDALAQRPKRGPHDAAIQNILTELQNHAAAWPFLQPVNKEEVPDYYDFIKEPMDLSTMEIKLESNKYQKMEDFIYDARLVFNNCRMYNGENTSYYKYANRLEKFFNNKVKEIPEYSHLID

SEQ ID NO: 46443 - protein, 336 aa, Mycobacterium avium subsp. paratuberculosis K-10
MKLAVIGGDGIGPEVTAEALKVLDAVLPGVDKTEYDLGARRYHATGELLPDSVIDELRAHDAILLGAIGDPSVPSGVLERGLLLRLRFELDHHINLRPGRLYPGVSSPLAGNPDIDFVVVREGTEGPYTGTGGAIRVGTPNEVATEVSQNTAFGVRRVVVDAFERARRRRKHLTLVHKTNVLTFAGKLWSRIVAEVGRDYPDVEVAYQHIDAATIFMVTDPGRFDVIVTDNLFGDIITDLSAAVCGGIGLAASGNIDGTRTNPSMFEPVHGSAPDIAGQGIADPTAAIMSVALLLAHLGEDAAATRVDRAVERYLATRGNERPATTEVGERIAAAL

SEQ ID NO: 46444 - protein, 351 aa, Arabidopsis thaliana
MSSQDSIKMVLKCMLRGAADYLIKPMRKNELKNLWQHVWRRLTLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 46445 - protein, 79 aa, Triticum aestivum
  misc_feature (58)..(58): Xaa can be any naturally occurring amino acid
MVPYSFWQFPSPNEHSSFMGDFSTATGLATFMMMLLGWITFQRFGWGVASIITLIVLXVTGVGFFSDFQQVQFIAAEQS

SEQ ID NO: 46446 - protein, 634 aa, Ralstonia metallidurans CH34
MTQHDFRAEQPIASATDAFATPADAASPLDKLDAMLNADAAPAVEASENGFAKLGLDAAILRALAEANYNTPTPVQAQAIPAFLAGRDLLVSSQTGSGKTAAFMLPAIQRISEKPATHRPTEPAKRMKGKRPRPSPAQPSLLVLTPTRELALQVTEAAAKYGRHLRRIVCASILGGMPYPKQLAMLARMPDILVATPGRLLDHIEAGRIDLSALEMLVFDEADRMLDMGFADDIDAIVAATPASRQTLMFSATLDARIAQLASRQLRDPQRIEIAAARADHSNIEQRLHFTDDMSHKERLLDHLLRDASLKQAIVFTATKRDADSLAERLSDTGFSAGALHGDMTQGARNRTLTALRRGNLRVLVATDVAARGIDVPDITHVVNFDLPKQAEDYVHRIGRTGRAGRSGVAINLVNHGDMFQWRRIERFTNNRIDASVIEGFEPRRSPKPRSNFGGKPGGRDGFRGNGGTGGGYRGNNGSGGYRGNREGSGDRNFGERRFSSDNRGFGDRAPRPFGDDNRGGFGDRGERGFGDRSNGNSNGGYRGQGQGQGQGQAQQRSFGGERSFGNRDFAQRDGNRDATQRDGNRSFGGNRDGQRDGNRSFGDRSFGDRKFGDRGGDRGGFGGQRNSRSRYER

SEQ ID NO: 46447 - protein, 589 aa, Anabaena variabilis ATCC 29413
MQLRDSVRRTKIVATIGPATSSPEMLKAIIEAGATTLRLNFSHGSHADHQRSIRLIRQTAFELNQPVAILQDLQGPKIRLGKFENGSIVLAKGDRFTLTNRPVVGTQEISCVTYDYLADEVPVGAKILLDDGRVEMVVEDINRDKGDLHCRVTVAGKLSNNKGVNFPGVYLSIKAMTDKDREDLMFGLDQGVDWVALSFVRNPQDIIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSYPVEAVATMARIAERIEQEEAMASKLRQMRDNRRSIPNAISQAVGQIAEQLGAAAIMTLTQTGATARNVSKFRPQTPILAVTPHVNVARQLQMVWGVKPLLVLELPSTGQTFQAAINVAQEHSLLFEGDLVVMTAGTLQGVSGSTDLIKVEVVTAVLGQGIGLGQGLVSGCARVAHTGMDVGNFNSGDILVAPRTGADFVEAIRKAGGIITEDESLTSHAAVIGLRLGVPVIVGVKKATQVIRDGAILTLDLQRGLVYSGAVGTP

SEQ ID NO: 46448 - protein, 258 aa, Vitis vinifera
MSQEQPPRPQSDQEPIKYGDVFPVAGSLADKPVAPQDAALMQSAETAVLGQTQKGGPAATMQSAATRNERAGLVGHTDITNAAGDEGVTVTETDVPGRRIITESVAGQVLGQYVEPTPVSQMNLTVTARQAAITIGEALEATAQTAGNKPVDQSDAAAIQEAEVRATGSTIISPTGVAAAAQSAASMNTGLTRDEDKIKLTDVLSNATARLPADKAVTRQDAEGVMSAEMRNNPNLATHPGGVASSVAAAARLNESVV

SEQ ID NO: 46449 - protein, 168 aa, Mycobacterium avium subsp. paratuberculosis K-10
MSPQTHTLSVLVEDKPGVLARVAALFSRRGFNIESLAVGATEQKDMSRMTIVVSAEETPLEQITKQLNKLINVIKIVELEDGNSVSRELALIKVRADAGTRSQVIEAVNLFRAKVIDVSPEALTIEATGDRGKIEALLRVLEPFGIREIVQSGVVSLSRGPRGIGTAK

SEQ ID NO: 46450 - protein, 321 aa, Picea sitchensis
MISVFTRRGGRFIEEAAAALSVSAMAAAIGGGGPQVSASASECCSTPQALQQQKIDISRRRRGIEGGRRRCLSSIASTSTTETKEMSGGGEQEWYDKYRRSLYGGLTHKALLVDAVGTLVLPSQPAAQIYRNIGLKYGVCYSEDEILSRYRWAYQQPWPNTRLRFMDDARPFWQFVVQNATGCSDSRYFEELYEYYTTDQAWHICDPEAGKVFEALRRAGIKLAVVSNFDTRLRPLLQALKCEHWFDALAVSAEVEAEKPNPTIFWKACEFLGVEPEDAVHVGDDRRNDIWGARDAGCDAWLWGADVHSFKEVAQRIGVVV

SEQ ID NO: 46451 - protein, 293 aa, Shewanella sp. ANA-3
MLVNAIKEYQLRVDDQLKQRFSTLEDTAPQLKAAMTHGALLGGKRIRPFLVYSVGQMFGVPLEKLDASAAAIECIHAYSLIHDDLPAMDDDDLRRGQPTVHIAFDEATAILAGDALQTLAFEIVTEAVPGISSEQHIAMVRALAKASGYRGMCGGQAIDLASTDKLIDLKALTQLHNMKTGALISCAVELALIAANAPKDEYQTMMEFAHAVGLAFQVQDDILDIIATTEELGKPQGSDAESNKSTFPQLLGLQGAKDTAAQLIQEALSALAKLPYNSQLIADFARYIIERRI

SEQ ID NO: 46452 - protein, 622 aa, Shewanella sp. ANA-3
MSLDISQFPVLAQANTPNELRQLPQALLPQLADELREFLLKSVGMSSGHFASGLGTVELTVALHYVYNTPFDRLIWDVGHQAYPHKILTGRRDRMHTIRQKNGLHPFPWREESEYDTFSVGHSGTSISAALAMAVAAEKEQAGRKVVAVIGDGAMTGGMVFEAMNHAGDLHNDMLMVLNDNEMSISENVGALNNHLAQLMSGRLYTTIRESSKKVLKGMPVIKEMAKRTEEHLKGMVVPGTLFEELGFNYIGPIDGHDVDALVETLRNMRSLKGPQVLHIMTKKGRGYEPAEKDPIGWHAVPKFDPSQFKKPATKPGLPTFSQVFGKWLCDIAEQDEKVLGITPAMREGSGMVEFSQRFPKQYFDAAIAEQHAVTLGAGFACEGFKPVVAIYSTFLQRGYDQLIHDVALQRLPVLFAIDRGGIVGADGPTHQGAFDLSFMRCIPNMVIMAPSDENECRQMLYTGYCYDAGPSAVRYPRGSATGATQVEAMTALPIGKGVIKRLGKGIAMLNFGTTLAAALTAAESLDATVVDMRFVKPLDVDLVKEMAQTHDVLVTVEENAIMGGAGSGVLELLQKLKMPKPVLQIGLPDEFIKHGSPEEVTHDLQLDAEGMLAQINAFLAD

SEQ ID NO: 46453 - protein, 406 aa, Thermus thermophilus HB8
MFREAELRNGLRVIAEVVPGARSVALGYFVKTGARDETKEESGVSHFLEHMVFKGPEDMDALAVNRAFDRMGAQYNAFTSEEATVYYGAVLPEFAYDLLGLFAKLLRPALREEDFQTEKLVILEEIARYQDRPGFMAYEWARARFFQGHPLGNSVLGTRESITALTREGMAAYHRRRYLPKNMVLAATGRVDFDRLLAEAERLTEAWPEGEAERAYPPLTPAFGVEERPYEKARALYLVALFPGVAYQEEARFPGQVLAHLLGEEGSGRLHFALVDKGLAEVASFGLEEADRAGTFHAYVQADPARKGEVLAVLQEELDRLGREGVGEEEVERAKTPLATGLVFAGETPMQRLFHLGMEYLYTGRYLSLEEVKARVQRVTSREVNALLERGFLEKGLYYLVLPHGA

SEQ ID NO: 46454 - protein, 403 aa, Thermus thermophilus HB8
MSRVERLPNGLVVALEERDFPGVAFQLLVPAGAVNDPEGMEGAAALLEGWLWKGAGDLDARALAQALDALGVRRSSGAGLEYTAFAAAFLPEVLDEVFRLYALLLTRPRLPEEGLEAVRSVALQALLSLEDQPARKLLSELRRKVFRSPHGREPLGREEGLKGARAEALKADYRRRYTPKGAILAVAGGVSWERLRAALEPFLAWEGEEALYPAPELSEPHRFVLRRPTAQVQIGLAYPDVGPEDPGFYAARLALEVLSGGMSSRLFTEVREKRGLVYAVSAFPAGVKGQGLLMAYAGTTKERAGETLEVLRAEVERLAEGVTEEELSRAKVGLKTALVMADESIRSRAASMARDLYMLGRVRSLSEIEAAIEGTSLEAVNAFLRAHPYRDPWVGLLGEVEDV

SEQ ID NO: 46455 - protein, 312 aa, Streptococcus pneumoniae
MAEIYLAGGCFWGLEEYFSRISGVLETSGGYANGQVETTNYQLLEETDHAEAVRVICDEKGVSLREILLYYFRVIDPLSINQQGNDRGRQYRTGIYYQDEADLPAIYTVVQEQERMLGRKIAVEVEQLRHYILAEDYHQDYLRKNPSGYCHIDVTDADKPLIDAANYEKPSQEVLKASLSEESYRVTQEAATEAPFTNAYDQTFEEGIYVDITTGEPLFFAKDKFASGCGWPSFSRPISKELIHYYKDLSHGMERIEVRSRSGSAHLGHVFTDGPRELGGLRYCINSASLRFVAKDEMEKAGYGYLLPYLNK

SEQ ID NO: 46456 - protein, 406 aa, Oryza sativa Indica Group
MVSVFFLLSLLLLLFSSSPPRLRLPGPAAAAPSLADDLRCGHGAPPCLAYLLVGARGDGARLLRLLLAVYHPRNRYVLHLSADASDSERRDLAAWVAAATPAVGAFRNVAVVGAPTAGTPVGSSGLAGTLRAAAVLLRLHPDWDWFITLNAADYPVVTQDDLIYVLSNVSRQFNFVDHTSDIGQKESEKVQSMIVDAGIYLAGRTNFFRASEKRPTPDAFKFFTGISCCLCFCFGSPWVILNRQFIEYCILGWENLPRILLMYFNNIMLPQEGYFHSVICNSLEFRNFTVNNDLRYKAWDNPPQTEPVFLDMTHYDKMVDSGAPFARRFRENESLLDKIDGNVLGRWGHGPVPGAWCSGRKSWFSDPCSQWSDVNIVRPGPQGIKLRQYINRALEEGEFGSKSCRR

SEQ ID NO: 46457 - protein, 327 aa, Shigella flexneri 2a str. 2457T
MATRIEFHKHGGPEVLQAVEFTPADPAENEIQVENKAIGINFIDTYIRSGLYPPPSLPSGLGTEAAGIVSKVGSGVKHIKAGDHVVYAQSALGAYSSVHNINADKAAILPAAISFEQAAASFLKGLTVYYLLRKTYEIKPDEQFLFHAAAGGIGLIACQWAKALGAKLIGTVGTAQKAQSALKAGAWQVINYREENLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDAQRAHEILESRATQGSSLLIP

SEQ ID NO: 46458 - protein, 410 aa, Yersinia pestis KIM
MGVCMNFPIERVRADFPLLSRQVNGQPLVYLDSAASAQKPQAVIDKELHFYRDGYAAVHRGIHSLSAEATQQMEAVRTQVADFIHAASAEEIIFVRGTTEAINLVANSYGRHFLAAGDSIIITEMEHHANIVPWQMLAQDLGVEIRVWPLTATGELEITALAALIDDTTRLLAVTQVSNVLGTVNPIKDIVAQAKAAGLVVLVDGAQAVMHQPVDVQALGCDFYVFSGHKLYGPSGIGILYGKSALLQQMPPWEGGGAMIKTVSLTQGTTFADAPWRFEAGSPNTAGIMGLGAAIDYVTELGLLPIQQYEQSLMHYALAQLSQIKSLTLYGPTERAGVIAFNLGQHHAYDVGSFLDQYGIAIRTGHHCAMPLMAFYQVPSMCRASLALYNTREDVDRLVAGLQRIEKLLG

SEQ ID NO: 46459 - protein, 333 aa, Corynebacterium efficiens YS-314
MQPDTTGQGTVDSLDPMSETSPESTSVSKIAVITTGGTIACTADADGHLLPTVSGEELLRPIAARFDASQFTFEIHELNRLDSSSMTFADIDELNTRIHQVLEDPEVVGVVVTHGTDSMEETAVAVDTFHTDHRPVIFTGAQKPADHPEADGPGNLFEACLIASDASARGIGVLVVFGHAVIPARGCTKWHTTDELAFATNGPEEPERPDPLQLAPLADVTVEIIPAYPGASGASVQAALDAGAQGLVVEAMGSGNVGTAMGAALGRALDDGIPVVMTTRVPRGEVSGTYGGAGGGATLAARGAIGSRYFRAGQARVLLAAAIATGQHPATLF

SEQ ID NO: 46460 - protein, 453 aa, Salinibacter ruber DSM 13855
MNDPSQARLASSLSTVDVVALTVGVVIGASVFETPALVAGNTGSGWAALLAWTLGGGVSIVGALCYAELTTAYPHAGGDYFYFQRAFGDWLAFLFAWARLVVIQTGSIALLAFVFGDYATELWPIGAQYSPSIYAALAVAGLTLLNALGVRQGKHVQRGLTVATIVGLLVLIGAGLFLVPESAGQAAATGASDGGASDGGGGSFGMAMVFVLLTYGGWNEAAYLSAEVRDLPRNMTRGLLGSLGLIAGLYLLVNWAYLQGLGLAGMAGSEVVAADLMRAASGAPGAKLISLLVVAAALSSTNATIFTGARTSFALGRDVRFFRFLGRWDADTETPANALLVQGAVALGLVGVGAWTRQGFEAMVDYTAPVFWLFFGLAGAALFVLRRIEPETDRPFRVPLYPAVPLLFCAACLYMLWSSVAYAGAGALLGVGVLLAGIPLLALRTARSQEASS

SEQ ID NO: 46461 - protein, 545 aa, Glycine max
MATSLSVSPSLSLNTLFIAKALPLSRPSFLSLPLPKSLLSLSTRRRTFIVRAESQNGRDPVPAHYDFDLFTIGAGSGGVRARRFAANYGASVAICELPFSTISSETTGGVGGTCVIRGCVPKKLLVYASKFSHEFEESNGFGWRYDSEPKHDWSSFIANKNAELQRLTGIYKNILNNAGVKLIEGHGKMIDPHTVDVNGKLYSAKHILVAVGGRPFIPDIPGKELAIDSDAALDLPTKPVKIAIVGGGYIALEFAGIFNGLKSEVHVFIRQKKVLRGFDEEIRDFVEEQMSVRGIEFHTEESPQAITKSADGSFSLKTNKGTVDGFSHIMFATGRRPNTQNLGLESVGVKLAKDGAIEVDEYSQTSVYSIWAVGDVTNRINLTPVALMEGGALVKTLFQDNPTKPDYRAVPSAVFSQPPIGQVGLTEEQAVQQYGDIDIFTANFRPLKATLSGLPDRVFMKLVVCAKTNEVLGLHMCGEDAPEIVQGFAVALKARLTKADFDATVGIHPSAAEEFVTMRTPTRKIRKSESSEGKSGSQAKAAAGV

SEQ ID NO: 46462 - protein, 576 aa, Schizosaccharomyces pombe 972h-
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSFPFLDLCAMLVCKLFSA

SEQ ID NO: 46463 - protein, 557 aa, Schizosaccharomyces pombe 972h-
MAIPILDALTSSSGKKNSAEFSIHSTSNPTNPEEPNITSEADNAEDLAALGYKQEFQRGLSLFSVFSVSFSLLGLLPSVATTLPYSIGYTGTPGLLWGWLIAMVFIICIALSMAELCSAMPTSGGLYYAAAVLAPEGWGPLAAWFTGWSNYIAQLVGGPSINYSTAAMLLGAVNIGNPNYEVQNYQLFLVSIAIQFIHFILASMPTKYIAKLNSVGTYLNTLFLFISMIVILAMSSKNHGFNETSKVWSHIENYTDWPDGFAILMSFCGVIWTMSGYDAPFHMSEETANASVNAPRGIILTAAIGGIMGWVMQIVIAYTVVDQTAVVTGSDSMWATYLSQCLPKRAALGILSLTIVSSFLMGQSNLIASSRIAYSYARDGVLPYSEWVATVNPITKTPIRAVFVNFVIGVLILFLAFAGAITIGAVFSVTAIAAFTAFVAPVAMRVFFVKDADFRTGPFNLGKFSKPIGFCSVSFVALMIPILCFPSVKNPTPAEMNWTCLVFGAPMLAVLIWYAISGRKWFKGPRINLASEGDNSTLEGVELYTGSEELPQKKEKE

SEQ ID NO: 46464 - protein, 336 aa, Sinorhizobium meliloti 1021
MTVKVAINGFGRIGRNVLRAIVESGRTDIEVVAINDLGPVETNAHLLRFDSIHGRFPADVKVDGDAIVINNGKPIKVTAIRNPAELPHKELGVDIAMECTGIFTARDKAAAHLEAGAKRVIVSAPADGADLTVVYGVNHDKLTKDHLVISNASCTTNCLVPVAKVLHDAVGIDHGMMTTIHSYTNDQPSLDQMHKDLYRARAAALSMIPTSTGAAKAVGLVLPELKGKLDGISVRVPTPNVSVVDLKFVAKRETTKEEINAAIKAAADGPLKGVLGYTLAPNVSIDFNHDPRSSVFHMDQTKVMEGKFVSILSWYDNEWGFSNRMSDTAVALSKLI

SEQ ID NO: 46465 - protein, 627 aa, Arabidopsis thaliana
MISLTPSLFLNKTVVPGCSTRLSLRQPRTIITPPASLRVFSSLGSNQDPTGSVLIETTATSSSSLETSAADIVPKSTVSGGVQDVYGEDAATEDMPITPWSLSVASGYTLLRDPHHNKGLAFSHRERDAHYLRGLLPPTVISQDLQVKKIMHTLRQYQVPLQKYMAMMDLQETNERLFYKLLIDHVEELLPVIYTPTVGEACQKYGSIFLRPQGLFISLKEKGKIHEVLRNWPEKNIQGMGIPVGKLSLYTALGGVRPSACLPVTIDVGTNNEKLLNDEFYIGLRQRRATGEEYSELMHEFMTAVKQNYGEKVVIQFEDFANHNAFDLLAKYGTTHLVFNDDIQGTASVVLAGLIAALRFVGGSLSDHRFLFLGAGEAGTGIAELIALEISKKSHIPLEEARKNIWLVDSKGLIVSSRKESIQHFKKPWAHDHEPIRELVDAVKAIKPTVLIGTSGVGQTFTQDVVETMAKLNEKPIILSLSNPTSQSECTAEEAYTWSQGRAIFASGSPFAPVEYEGKTFVPGQANNAYIFPGFGLGLIMSGTIRVHDDMLLAASEALAEELMEEHYEKGMIYPPFRNIRKISARIAAKVAAKAYELGLATRLPQPKELEQCAESSMYSPSYRSYR

SEQ ID NO: 46466 - protein, 1090 aa, Pseudomonas fluorescens Pf-5
MFQSLLIANRGEIAIRIARACADLGVRSVAVFAEDDAASLHTRKADLALPLKGRGVAAYLDRQQLIALALQQGCQAIHPGYGFLAENPDFARGCLEAGLTLIGPGPEVLQLFGDKAAARALAEDCGVPLLEGINRAVSLEQAAAFLERHGAVMLKALAGGGGRGMRAVTEAGQLQQAFIRCQSEAQAAFGNGALYVEQLLQRARHIEIQVLGDGSGAVSHLWERDCSLQRRHQKLVEIAPSPDLAPQLRQQLIDAALALAARVRYQGIGTFEFLLDQEHPGRFYFMEANPRIQVEHTVTEAITGVDLLHTQLRLGAGASLASLGLSRPPEPQGFAVQARINLEQPLADGGMGPVAGTLSAYEAPSGPGLRVDGYGYAGYPVNPGYDSLLAKLIAQGTDFPAALGRAYRGLCEFRLEGVPSNLGLLLNLLRQPAVLDYQVDTRFVEAHWAQLLQDCAGQHRPMFFARQAATAQSTRSDVQAPPGTAALNAPSTGVLVSLEVAVGDELRIGQRVAVLEAMKMEFEVKAQSSGIVRALAVQVGEALGEGQPLLFLEPAEFADQGQRSEEQLDLALIRADLAEVRERHALLEDAQRPEAVAKRRRNGQRTARENLEHLLDPGSFMEYGAMALAAQRRRRSVEELQALSPADGLVGGIGTVNAGLFDGQDARCLALAYDYTVFAGTQGVMNHKKTDRLLSLAQEWRLPVVLFAEGGGGRPGDSDFVGVAGLDCHTFAAMARLSGWVPTVGIASGRCFAGNAALLGCCNLIIATRNASIGMAGPAMIEGGGLGSFTPEQVGPVSVQGPNGVIDVLVADEAEAVQVAKQYLSYFQGPLKDWHCADQRELRHLIPENRLRVYDIRRVIETLADRDSVLELRRQFAPGLITALIRVEGRAFGLLANNPAVLGGAIDAAAGDKAARFMRLCEAFGLPLVSLCDTPGFMVGPESEQQATVRHVSRMFVSAASLTVPFFTLVLRKGYGLGAQAMAAGSFHSPLFTVAWPSAEFGAMGLEGAVRLGFSKELAAQPDPQSQQALFDKLVAKAYARGKALNMASYLEIDAVIDPLESRAWLLRGLQAAPRPVPWAERAQGFVDTW

SEQ ID NO: 46467 - protein, 399 aa, Sinorhizobium meliloti 1021
MTFKTLDDLTDIAGKRVLVRVDLNVPVKDGQVTDTTRIERVAPTIRELSEKGAKVVLLAHFGRPKGEPVADMSLKAIASAVEEILDQRVYFAADCIGDKAANAIAELNDGEVLLLENTRFHKGEEKNDSDFVTALAANGDIYVNDAFSAAHRAHASTEGLAHHLPAYAGRTMQAELEALEKGLGNPKRPVVAIVGGAKVSTKIDLLQNLVKKVDALVIGGGMANTFLAAQGVDVGKSLCEHDLAETAKAILAAASEAGCAIVLPVDGVVAREFKAGADNEVVDIKAIPADAMVLDVGPKSIEAINEWISRAETLVWNGPLGAFEIAPFDRATVAAAKHAAARTRAGSLVSVAGGGDTVAALNHAEVADDFTYVSTAGGAFLEWMEGKPLPGVDVLRQRN

SEQ ID NO: 46468 - protein, 190 aa, Anabaena variabilis ATCC 29413
MAVFEGTFTQTEPLRLAIVIGRFNDLVTTKLLAGCQDCLKRHGVDPDPHGNQVDYVWVPGSFEVPLVARQLALTHRYDAIICLGAVIRGQTPHFDYVSAEVSKGIAAASFQTGVPVIFGILTVDTMQQALERAGIKANHGWDYAMNALEMASLMRQLRSNVTDSYTQTQSLPAAFPNASIGKLTAESEEV

SEQ ID NO: 46469 - protein, 412 aa, Anaplasma phagocytophilum HZ
MKNNEDKGAKLPVFFDYQATTKLDDRVLEAMIPYFQQFSNPHSRSHCYGWRAESAVEIAREQVAQSIGADPKEVIFTSGATESNNLAIKGVARFYKNRGNHIVTVSTEHKCVLDSCRHLETEGFEVTYLGVKKDGLIDLEVLKKAIREDTILVSVMMVNNEIGVIQPIREIGEICKSEGRDVFFHTDAAQAFGKLLIDVNEMGIDLLSISGHKIYGPMGIGALYVRKRNPRVRLVPLLSGGGQERGMRSGTVPTPLAVGLGEAARIALEEMDSESERIKKLRDVLYERIMNGLPHVVLNGSYSSRIAGNLNLSFSYVEGESLIMSVSDLAVSSGSACTSASLESSYVLRALNVEQDLEHSSIRFGIGRFTTLEDVERAADLIISSVRRLRDISPLWEMVQEGTNLSTIKWDV

SEQ ID NO: 46470 - protein, 442 aa, Oryza sativa Japonica Group
MGIMGKWERCIGGRSKPMSRQRTQEALRRAPGDSEVDRKEKPWAARWKASLIATCLVALPALVFLAVGGGMPSAVTVLGGAGAARAMAECDVSRGRWVREPRGPSYTNVTCSTVADYVNCQKFGKDPGYLYWRWRPDGCELPRFSPATFLAAVRGKRLAFIGDSLARNHMESLLCLLSQVETPTDMHAGAFVDAFRRWRFPEHDFMLMAVWTEFLVHAVPSSPAGGTGPFDVHLDRINAEWTRRLPLLDYAVISNGNWFFRANYLWEGGRRVGCVDCGEPGLAHFPMAYAVGRVVGAALDAIAGCADCKRELVALVRTYTPDHFEHGSWFSGGYCNRTRPLEEDEVSSGVIAWELRAAQIEEVRKAREKVTTTMRTRRRFGVVDVTPAMMARADGHPGEHHRRWRGRNANDCLHLCLPGPINMWNDVLLRRLAELSPPSDAR

SEQ ID NO: 46471 - protein, 556 aa, Ralstonia metallidurans CH34
MLLTSQAPILASVRDDRARAVMVESKSLIFRAIHPLSGLSSRRVSDCDGFAPCTDTSTMTMTTTQDQAPAAEQTFESFGLDPRILRALTEQGYTKPTPIQAQAIPVVLLGKDVMGAAQTGTGKTAGFALPIIQRLLPLANASASPARHPVRALMLTPTRELADQVYDNVARYAKHTDLRSTVVFGGVDMNPQTDALRRGVEILVATPGRLLDHVQQKSVNLSQVQMLVLDEADRMLDMGFLPDLQRIINLLPAQRQTLLFSATFSPEIKKLASSYLKQPVTIEVARSNSTNENVRQVVYQVQDGHKQAAVVHLLKQRANEQQSRQCIVFVNSKIGCSRLARHLEREGINAAAIHGDKTQTERMQTLDGFKNGTIDALVATDVAARGLDIPAMPCVINFDLPFSAEDYVHRIGRTGRAGASGDALSIFVPGNDDRLLADIEKLIKRSIPRGSLDGFDPTGERARQEDSDRRRARTEVRRVRDNGEGEEQQRRRRTEPNGRQAFRPSDDPFFSRPYEPSGSYTPAPKTEEQLAAALTRGRQAPKRPVAALLGGVPRKS

SEQ ID NO: 46472 - protein, 474 aa, Oryza sativa
MNLAGFLATPATATATRHEMPLNPSSSASFLLSSLRRSLVASLRKASPAAAAALSPMASASTVAAENGAAKAAAEKQQQQPVQSTLGPGVTVAKRLEKFKTTIFTQMSMLAIKHGAINLGQGFPNFDGPDFVKEAAIQAINAGKNQYARGYGVPELNSAIAERFLKDSGLQIDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 46473 - protein, 308 aa, Streptomyces avermitilis MA-4680
MADWNTSDIPDQRGRVVVVTGANSGLGYVTARELARKGARVVLACRSEARGAEAGDRLAAELPGAEVELGRLDLGDLGSVRDFAAWFPYERLDLLVNNAGVMALPYGTTADGFETQFGVNHLGHFALTGLLLPTLLGTPGARVVTVSSGMHALANIDIHDLNGERRYRRWIAYARSKTANLLFTHELTRRLAAHGSEVLAAAAHPGYAATNLQTAGVRMEGRRAAERIVELGNRVLAQPAEAGALPVLYAATAPEVRPDSFTGPSFAGWRGAPAPSWRAPWTLNDAMGERLWSASEQLTGVTYEALKV

SEQ ID NO: 46474 - protein, 365 aa, Sphingobium yanoikuyae
MEAYAAIIERQGGEFVLDNVSIEDPRDGEVLVKVAAAGICHTDLTVRDQYYPTPLPAVLGHEGSGVVEKVGRGVSTVKPGDKVVLSFSYCGTCPACLKGHQAYCPSLFPLNFMGRRLDGSTPITRNGEDVNACFFGQSSFATYSIASENNCVKVADDAEIELLGPLGCGIQTGAGAILNSLRPAPGASIAIFGVGSVGLSAVMAAKSSGCLKIIAVDRNPARLEVARELGATDVIDASTTNAQEAIVAMTGGGTDFAMDTTAIPQVLRSAVESTHNMGETAVVGGAKLGTEFSLDMNNILFGRKLRGVVEGSSTPQVFIPQLIAMQKAGLFPFEKLCSFYDFDQINQAVEDTEKTGSAIKAILRM

SEQ ID NO: 46475 - protein, 279 aa, Pseudomonas aeruginosa
MIKKYLFPAAGYGTRFLPATKAMPKEMLPVVNKPLIQYGVEEALDAGLNEISIVTGRGKRALEDHFDISYELENQIKGTDKEKYLVGIRKLLDECSFSYTRQTQMKGLGHAILTGRPLIGDEPFAVVLADDLCVNLEGDGVLTQMVKLYQKYRCTIVAVMEVNPTETNKYGVIAGDDIGDGLIRVRDMVEKPAPEDAPSNLAIIGRYILTPDIFKLIEETEPGKGGEIQITDALLKQAKDGCVIAYKFKGQRFDCGGAEGYIEATNFCYEHFYKTGKAY

SEQ ID NO: 46476 - protein, 575 aa, Oryza sativa Japonica Group
MAAAAALRCNPRPSAAVALRGAAAAPQVGNEAAFELLVGATEPCLRGRRRGAGIRCQRSAAASAVVVEKKSRAVEPAREGANAGHTESELTVVMKFGGSSVASAERMREVADLILSFPEERPVIVLSAMGKTTNKLLMAGEKAVGCGATNVSELDELTFIKELHFGTIDQLGLDRSIVSGLSDELEQLLKGIAMMKELTLRTRDYLVSFGECMSTRIFAALLNKLGVKARQYDAFEIGFITTDDFTNADILEATYPAIAKRLHGDWVTGPAIPIVTGFLGKGWKTGAITTLGRGGSDLTATTIGKALGLREIQVWKDVDGVLTCDPNIHPNAKPVPYLTFDEAAELAYFGAQVLHPQSMRPAREGDIPVRVKNSYNRRAPGTLITKARDMSKTVLTSIVLKSNITMLDIVSTRMLGQYGFLAKVFSIFEDLGISVDCVATSEVSISLTLDPSKLWSRELIKQANELDHVIEELEKIAVVHLLQHRSIISLIGNVQRSSLILEKAFNVLRTNGVNVQMISQGASKVNISLVVHDSEAKQCVQALHSAFFESGFLPEVNDILQDDSVAHSNGTVYRH

SEQ ID NO: 46477 - protein, 888 aa, Sphingobium yanoikuyae
MKTVYTFGPGIAHDDSRARDKAVVGGKGANLGEMARIGLPVPPGFTITTEECLHFLRDRHSQSARLDGEVRSALTHIERTVGKRFGDRHDPLLVSVRSGARVSMPGMMDTILNLGLNDQTVRGLAASSGDERFAWDSYRRFVQMYASVVLGIDHARFEDALEKAKEDRGVSQDVDLSATDLRDLIGEFFGIVEAERGAPFPQDVDEQLASAIAAVFESWESDRAKVYRRLNGIPGEWGTAVNVQAMVFGNLGETSATGVAFTRNPATGDKAYYGEWLVNAQGEDVVAGIRTPQYLTLAARTAAGAKLPSMEEALPAVFTELARLFELLELHYQDMQDIEFTVERGKLYILQTRSGKRTAKAALKIAVDMVEEGLIAEEAAIRRIDPASLDQLLHPTLDPDAPRTLLGSGLPASPGAASGAVVFDADTAAVRAELGENVILVRQETSPDDIHGMHVARGILTAKGGMTSHAAVVARGMGRPCVSGASSLSIDYQARSAEIGGVHIAEGDLITIDGSTGEIFQGALPTVMPELDREFATVMAWADRHRRMNVRTNAETPADCEVARQFGAEGIGLCRTEHMFFDGERINFMRQMILAANVAERLVALDRLLPEQRSDFARIFEIMQGLPVTVRLLDPPLHEFLPHSESEFTELSAAVGIGVDQLRRRAEELAESNPMLGHRGCRLGVVYPEIYEMQARAIFEAACAVSRETGQPVVPEIMIPLVGTARELDMLKRIVIGVSEAVFAEQGLTVEFTVGTMIELPRAALVADEIAKVGEFFSFGTNDLTQTTLGISRDDAGRFLGSYIDKGIFATDPFVSIDVEGVGKLIAMAARLGREARPDIKLGICGEHGGDPASIAFCDRVGLDYVSASPFRVPIARLAAAQSALAAT

SEQ ID NO: 46478 - protein, 382 aa, Thermus thermophilus HB8
MRIQVNAKGAARLLSRHLWVFRRDVVSGPETPGLYPVYWGRRFLALALYNPHTDLAVRAYRFAPAEDPVAALLENLAQALARREAVLRQDPEGGYRLVHAEGDLLPGLVVDYYAGHAVVQATAHAWEGLLPQVAEALRPHVQSVLAKNDARTRELEGLPLYVRPLLGEVPERVQVQEGRVRYLVDLRAGQKTGAYLDQRENRLYMERFRGERALDVFSYAGGFALHLALGFREVVAVDSSAEALRRAEENARLNGLGNVRVLEANAFDLLRRLEKEGERFDLVVLDPPAFAKGKKDVERAYRAYKEVNLRAIKLLKEGGILATASCSHHMTEPLFYAMVAEAAQDAHRLLRVVEKRGQPFDHPVLLNHPETHYLKFAVFQVL

SEQ ID NO: 46479 - protein, 664 aa, Gibberella zeae PH-1
MDPLNSTSSGPGQDGLPKAPSQFAILDFIFPGFSTFSSIIHAYLGIDLNVYIPLLLIVSGIMFVWNYITEYSWSIIGQHLMSAVRIRTDDEIYNIVMAWVAKQRFSQGSRRFMVNTNINSRSWFLYCWNDDEDEDESESRKPLQYTPSVGSHFFWYKGHILLFERHENRDRSPFISSSSEELSISCFGRNPRIIKELLLDAQEQYIKKDEQQTVIYRGSLGSNGGDPTWQRCLSRASRPISTVILDEKTKSELIEDVTDYLNPNTRRWYSNRGIPYRRGYLLYGPPGTGKSSLSLALAGFFRMRIYMVSLSSILATEENLASLFAELPRRCVVLLEDIDSAGLTHTREEKKGDNSTEIDTVVPVPAAPAQPGAPPTTAPMPPGRLSLSGLLNILDGVASQEGRILIMTTNHLEKLDKALIRPGRVDKIVQFGLADDEMSASIFRAIYAPYEGEDVDVGAAKVKYLDIEEAQKHAALAEKTRLGTLERISALATKFAAKIPSLEFSPAEIQGLLLKNKRNPEAAIDAIDDWVVETRKERKQKEIEAAEKRRKEEADAIKAEAKKKRKEERKKAKKAKAKAKRKSNGESSGSDSDSDSDSDSEAETKSDNKKEDTDKKDDKPADKPKETEAEVDEKKDSKVEEESTGESKPKGTSDSGYDTPNPIS

SEQ ID NO: 46480 - protein, 448 aa, Salinibacter ruber DSM 13855
MPESSANQEELERTLGLVPALAIGTGTMVGAGIFVFPGLAAGRAGPAAMLSFAIGAVIALLVALPTSELATAMPESGGGYFFVSRALGTLLGCMVGVGQWLGLIFASAFYLIGFGHYLSDLARELGVTLPLPVVGLAFGMGILLTGVSVTGTENTGDLQNWIVGSLLAILAGFLGHGGLDALGVFGRQQTPEAFFPYGTMPVLTTAALVFTSYLGFVQIATVAGEIKAPSRNLPRSMIGSVLLVGTLYVLTIFISTSLLGSESLAEMGETAAVNVGRSIAGTFGAAALLGGGLLATLSSANASILSASRSIYALSRDELVPSQVERINRRYRTPHVALLLTGGIIVALILFGRVEVLAEVASLLHLFMYGLICVALLVLRQSPPSGYQPSFRCPGYPVVPVLGALTSFGLVAFMNPLSIAIGGGILLATAGWYLLYARAVTISEISSS

SEQ ID NO: 46481 - protein, 134 aa, Triticum aestivum
CRSTLEDHRDSYEDLVHFVEIVANAGCQRFTVHARKAWLQGLSPKENRTIPPLRYEDVYQLKKDFPQLLIEINGGITQTEQIQQHLSHVDAVMVGRAAYENPYLFATVDRDIYHKTNLVPSRAEIIERMLPYVE

SEQ ID NO: 46482 - protein, 387 aa, Staphylococcus epidermidis ATCC 12228
MQYYQPLLLTPGPTPVPEQILSAVQLPMVGHRSTDFEEIASEAFKGLKPVFGSKNEVLILTSSGTSVLEASMLNIANPDDHIVIIVSGAFGNRFKQIAQTYYNHVHVYDVNWGEAVIVDDFITYLKQLNVPVTAVFTQFCETSTGVIHPVHQLGHALKAFDNSLYFIVDGVSCIGAVDVDLTKDKIDVLVSGSQKAIMLPPGLAFVAYSDRAKKRFADVKTPRFYLDLNKYIKSQEQNSTPFTPNVGLFRGINAYVELVKKEGLNHVISRHFKIRNALRAALKALELELLVKDDAHASPTVTSFVPKNQEELNIIKNQLKSQFNITIAGGQGHLKGQILRIGHMGKISPFDILAVVSALEIILTSNRNVNYIGTGITQFMEVIRHES

SEQ ID NO: 46483 - protein, 341 aa, Sinorhizobium meliloti 1021
MSERLEDIAVAMVANGRGLLAADESTATIKKRFDSIGLESTETSRRDYREMLLRSDDAMREYISGVILYEETLFQKAADGTPLADVIRNAGSIPGIKVDTGAKPMAHFPNETITEGLDGLAARLARYHEAGARFAKWRGVIAISDALPTWGAIRANAHALARYAALCQEAKIVPIVEPEVLMDGAPGDHSIERSEEVTEWVLRTVFEELGELRVRLEGMILKPSMVIDGKKARKASVDEVAERTIKVLKRTVPAAVPGIAFLSGGQSTEEATAHLSAMNAAHDLPWKLTFSYGRALQQEALNAWGGKSENVAAGQRAFAHRAKMCSLAAKGSWTKDFEKAA

SEQ ID NO: 46484 - protein, 332 aa, Schizosaccharomyces pombe 972h-
MNSNFSYPALGVDGISSQISPIRDVWSTNLQQEMNLIMSLIERYPVVSMDTEFPGVVARPLGVFKSSDDYHYQTLRANVDSLKIIQIGLALSDEEGNAPVEACTWQFNFTFNLQDDMYAPESIELLTKSGIDFKKHQEVGIEPADFAELLIGSGLVLQEEVTWITFHSGYDFAYLLKAMTQIPLPAEYEEFYKILCIYFPKNYDIKYIMKSVLNNSKGLQDIADDLQIHRIGPQHQAGSDALLTARIFFEIRSRYFDGSIDSRMLNQLYGLGSTGSVLWHNNSSTPQIQFRDLPGAHPSPTPSNAGIPTTLTNTSSAPNFANSTFRFPPRVV

SEQ ID NO: 46485 - protein, 221 aa, Picrophilus torridus DSM 9790
MDEEWTPRTELGRLVANGEIKTISEALHSKLPLKEYQIVDYLIPDLKDEVINIERAQRMTDSGRRMNYSITAVVGNGNGYVGVGRGKAKEAAPAIKKAIDNAKLNIIEIKRGCGSWECGCGKPHTLPFLVNGKSGSVSVTLKPAPQGVGLAVGDVVKVILRMAGIDDAWGFAAGHTKTTVNYALATFDALKKTVSIKINPKINLSTPIYVGGIGNAGSNKD

SEQ ID NO: 46486 - protein, 323 aa, Pediococcus pentosaceus ATCC 25745
MKKILALHTGGTISMSASNDTVKTNEQNPLLDSQFINKNIDLVNEVILNKPSEHITPDDMLIIKKRVKKALDNNECDGIVITHGTDTLEETAYFLDLTIENKIPVVLTGAMRSSNELGSDGVYNFQSAILTAASDEASDKGVLVVMNDEIHTARFVTKTHTTNVDTFRTPTFGPLGIVYKRDIRFFQALVNQHVCDIDHLEKGVYLIKAYAGIPKEIFEIINRPGTKGIVIEGLGAGNLPVEVVEPIQALIDNDITVVMVSRCYNGLAEPIYDYVGGGIDLERMGVVFCQGLNGQKARIKLQVAVSAGMNSKDIAKYMHDAVS

SEQ ID NO: 46487 - protein, 416 aa, Oryza sativa Japonica Group
MAQQLSAPFRAAAAAGSRASAAAADPAKVSPSLPFLLCSLSLTFFPTPPPEFSRARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 46488 - protein, 323 aa, Burkholderia mallei ATCC 23344
MQAIEIRETGGPDVLEYVTRAAREPGRGELLVELAAAGVNFIDLYRREGRYPMPLPGTPGEEGAGRVLAVGPDVTRFKPGDRVAWTTVMGSYATRVVVPEDKAIAVPDGIDLRTAAAALVQGMTAHYLVNDSYRAREGDVVLVHAAAGGVGLLLTQWLKRRGVRVIGTVSTAGKAALARSNGADDVVLHGAFDDLAAEVRRLTDGRGVHAVYDGIGAATFDASLASLRTRGTLVIFGGASGPVPPVDVMRLLWGGSLTLTRPYLEHFRASVDEFLWRAGAVFDGILDGSLKIRIGGAYPLADARRAHADLAARRTTGKLLLVP

SEQ ID NO: 46489 - protein, 218 aa, Crocosphaera watsonii WH 8501
MTIAENLDKILSEIPSSVRLVAVTKKKPVTAIKEAYHYGIRDFAESRVQEAILKQEELQDHKDICWHFIGHIQTNKAKKILENFHWIHSVDSLKLAEHLDKLAAKTSIYPHVCLQVKLLPDPNKYGWEVMEFWQDLPKLEPLKHLKIEGLMTILPLGLSENECLETFEKTKELATKINEKSSLQLKELSMGMSNDYLLAVEKGATMIRLGSIIFGARN

SEQ ID NO: 46490 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYITVRFLIGFSLATFVSCQYWMSTMFSSKIIGTVNGLAAGWGTMGRRRHAAHMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 46491 - protein, 275 aa, Glycine max
MAERGGGERGGDRGGFGRGFGGRGRGGDRGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKATFDCLMKTYGFLTPEFWKETRFSKSPFQEYTDLLAKPTGKTLILEEERVDA

SEQ ID NO: 46492 - protein, 262 aa, Betula pendula
IAAGVQFGWALQLSPLTPYVQLLGIPHTWAPFIWLCGPISGLFVQPVVGYYSDRCTSRFGRRRPFIAAGSSLVAIAVFLIGYAADLGHVFGDPIDKTTKTRAIAVFVLGFWILDVANNMLQGPCRALLADLSGDDQRRMRTGNALYSFFMAVGNVLGFAAGSYTRLYKLFPFTSTEACDVYCANLKSCFFLSIALLLILTTIALTAVKEQILSPQPEPGTAGGEEKQVVPFFGEIFFALKGLQRPMRILLMVTCLNWIAWFP

SEQ ID NO: 46493 - protein, 188 aa, Sulfolobus tokodaii str. 7
MKIAVIYFGGQYNHLIVKDLKYLGLNAVLITPEKPVEILKDYDCIIFGGGPYSVITELNKMGNAVDYVLRTSQPKLGICLGHQLLAKVLGGEVTKATKPEYGLVKVNINDEDTILRGLSPSINAWESHTDEVISPPQGFRILANSENAKVQAMVNKDNTIFGVQFHPEVKHTEKGIEVFKNFIEACKK

SEQ ID NO: 46494 - protein, 167 aa, Synechococcus sp. RS9916
MCALLLGSWCLAAPVVALDTSAGVGLQDRALFQERVDYTLTNQSDGDFHGQVLTNTSFAGAVGRGADFSGADLHGAIFTQGAFAEADFSDADLSDSLMDRADFSGTNLTNALLNGVIASGSSFAGASIEGADFSDALLDRDDVVRLCRDAEGVNPITGMATRDSLGC

SEQ ID NO: 46495 - protein, 176 aa, Glycine max
  misc_feature (108)..(108): Xaa can be any naturally occurring amino acid
  misc_feature (138)..(138): Xaa can be any naturally occurring amino acid
KYTNGPLLSAEPCKSAQHACIQIVHRGGKITPGDVILSARSHTPVTAILPQQLRASTYLAQDEGVKVGNTYDQVREEGTPQELVPHKRFLGSRPTASILVGGAIGPAXPSALFVFWTPLTFTEGAILDLTSSVQWGVXLARVLAKYILKEHHEAGHGEGPNASTGGLIGAFNKYGI

SEQ ID NO: 46496 - protein, 282 aa, Zea mays
MESPFRADVVKDKAALVTGGGSGICFEIAAQLARHGAQVAIMGRRREAVGFDGDVRNQEDAARVLAATVAHFGKLDILVNGAAGNFLASPEDLTPKGFRTVLEIDTLGTYTMCYEALKYLKKGGPGKGPSTGGLIINISATLHYSASWYQIHVSAAKAGVDSITRSLALEWGTDYDIRVNGIAPGPIQDTPGLRKLAPEEMSKGLREMMPLFKFGEKRDIAMAALYLASDAGKYVNGTTLVVDGGLWLSHPRHIPKEEVRELSKVVEKKVRASGVGVTSSKL

SEQ ID NO: 46497 - protein, 201 aa, uncultured archaeon GZfos37B2
MEQEWIPQTKLGTLVREGKLTDIDAVLNSGLPLREVEIIEMLLPDLEEEVLDVNMVQRMTDSGRRVKFRAVSIVGNKDGYIGFGQGRDRQAGPAIRKSIANAKLHLTGIKRGCGSWECGCDDLHSVPFQVIGRAGSVGIELKPAPRGLGIASGATAKKVLEMAGIKDVWTRTWGLTRTTLNFAKATYTALKQTNTMRTGGR

SEQ ID NO: 46498 - protein, 241 aa, Cupriavidus necator
MHATEPNTGHGSQRAIRLAPSILSADFARLGEEVCAIEAGGADLVHFDVMDNHYVPNLTIGPLVCEAIRPLVSIPIDVHLMVEPVDALIPMFAKAGANLISFHPEASRHVDRTIGLIRDHGCKAGLVLNPATPLSWLDHTLDKLDLVLLMSVNPGFGGQAFIPGVLDKVRQARARIDRQVAAGGRPVWLEIDGGVKADNITEIARAGADTFVAGSAVFGAPDADGGYRGILHRLREAATIT

SEQ ID NO: 46499 - protein, 677 aa, Salinibacter ruber DSM 13855
MAIREPPHAHARPGRFGVLIQPGLPLRRTSTRGRRNRNGMCLVLRDAPGGVGSVFALRSSPYVTGPPTCRTCAPRPMRRLSPFPLLLCALLLAAPPALAQNGDGGGDRLTGPDFARSPVTAPHGMAATSQPLASQIAVDILKQGGSAVDAAIAANAALGLMEPTGNGLGGDLFAIVYDPETDSTYGLNASGRSPQGLSYDEMQQALGDRDQIPLLGHLPVSVPGTASGWGKLHERFGALPLREDLAPAIEYARDGFPLSQVIAYYWQGNVESFRENSDMLPDSENWKETYLIEGDDGQMRAPEEGEVFRNPDLASTLETIAENGTEAFYQGEIAQTIADYAERTGGYLRMEDLRQHEANWVDPVSVDYRGVEVFELPPNGQGIAALQMLQILKGYDVASMGHNSTDYLHVQAEAKKLAFEDRARFYADPAFADVPVQQLISEEYGAQRRQQIEMDEVLSAPDAGTPRSVTTSGLDPAMRERLNNGDTIYLTVADSSGMMVSLIQSNYAGMGSGLVPDGLGFMLQDRGALFTMEQGHPNVYEPGKRPFHTIIPAFATKDGEPFLSFGVMGGGMQPQGHVQVLSNIVDFGLNVQAAGDAARYRHYGSSSPTGEDMDGRGTLRVESGVSEDVVNALRGRGHSVSVGAGGYGGYQAIRWDPEEEVYWGGTEMRKDGYVVGY

SEQ ID NO: 46500 - protein, 1150 aa, Gibberella zeae PH-1
MGTRTASSAVADASLRGPGRTHSTRSSRSSRVPSFPPPSPSASAAPAAPAPATSTGTGANYNQSHTRQLSHSHSQSQSRSQSQSLSQAQSQAYASRSHSHSHSHSHSRSASNAANSHPPPHHSQHQRTSSSARTTSQNDHESSRLAANPKHHRTSSKDDRHPPPTRGPDPSRAHRRSSSSRSKNNNHNPPPEMAPSASAPSNGTSHASAAPPTNHADAPPRASTSKHARSRTVIPTQSGKWMLGKTIGAGSMGKVKLARKEDGSEQVACKIIPRGSTDDGHQSRADKERADQSKEIRTAREAAISTLLNHPHICALHDVVRTNHHWYMLFEYVNGGQMLDYIISHGKLKEKQARKFSRQIASALDYLHRNSIVHRDLKIENILISKTGDIKIIDFGLSNLFAPRGHLKTFCGSLYFAAPELLQARAYTGPEVDVWSFGIVLYVLVCGKVPFDDQSMPALHAKIKRGLVDYPAWLSSECKHLLSRMLVTDPKQRATMQEVLTHPWMAKGFNGPPDNYLPNREPLTTPLEPEVILAMQGFNFGTPESINAQLTKIIESDEYQRAIKLYQREKELPQPTKDAEKKRAFGFDFYKRRNSGNSRDTLSAPSSEALQMGNDPMNAFSPLLSVYYLVKEKQDRDHADMVPPAASQSREKEKEKEREREREREEKREREREREKEREREREREREAREKEKAREPELPEIAAPQAAHTNSSAYEMPGEKPTGGRSRPRARTHGEDDMPELPKQTPAPPPEPRVEQIQKKEGTAAGILRRFSTRKRREPERLDRDRSHPPVVQVHSPAEPSPLAPRKSFSIRRGRRDREDASDTQIRSSSNQGQHGELLSPPMSSGGNREGRRGSALGRSTSVNSAEMRRRKDHPATNESDQSVGNEESSSSRRAHGHSRSVSLRAKSIGHARRESIQQRRQRRDAAQEANVPEETDQELEQSGVSTERLDDTELSKPVFLKGLFSVSTTSGKSVPAIRTDIKRVLKQLNVDYTEIKGGFRCRHSPSIDLNKVQDPPMSPGNTPGHKRRFSFGGLIRGDDRDRDDFRDSDRPPTTPRTPGRSDRDRSFSNSETSFDSNSGRNAGPSRQVPGETSTQVQSDLGGSMVLEFEIFIVKVPLLSLHGIQFKRMAGNTWQYKSMADHILRELRL

SEQ ID NO: 46501 - protein, 365 aa, Vitis vinifera
MSLKAGIVGLPNVGKSTLFNAVENGKAQAANFPFCTIEPNVGIVAVPDPRLHVLSDISKSQRVVPASIEFVDIAGLVKGASQGEGLGNKFLSHIREVDSILQVVRCFEDNDIVHVNGKVDPKSDIDVINLELVFSDLDQIEKRMEKLKKGKAKDSQSKLKKSALERIREALMDGKPARSVTLTDFEKDAIKHLCLLTMKPIIYVANVAESDLAEPGSNPYVKEVMNLASELQSGIVTISAQVESELTELPSEERTEFLKSLGVSESGLGNLIRATYSLLGLRTYFTSGEKETKAWTILAGMTAPQAAGVIHSDFEKGFIRAETVAYDDFVAAGSLAAAREKGLLRSEGKDYIVQEGDVMLFRFNV

SEQ ID NO: 46502 - protein, 266 aa, Sinorhizobium meliloti 1021
MARSALLNVMVQAVFKAGKSLARDFGEVQNLQVSLKGPADYVSQADRKAERIIREELMKARPTYGFLGEEGEEIKGTDGAHRWIVDPLDGTTNFLHGIPHFAISVALERQGEIVGAVVFNPATDELYTAERGGGAFLNDRRLRVGARKALSDAVIGTGTPHLGRGNHGKYLVELRHVMGEVAGIRRMGSASLDLAYVAAGRFDGFWERDLAAWDMAAGLLLIREAGGWSTDAEGGGKPLEAGSIVCGNEHIAKALREVIQRPIPSK

SEQ ID NO: 46503 - protein, 242 aa, Vitis vinifera
MAIPRIPLMLSMMVMLLVFAESGDNNRVFSPCADTTVQKSDGFTFGIAFASRDKFSYNNTLLSPCDRRLALSSQNSQIAAFRPKVDEISLLSINTTSSFFPANYGGYMVAFAGRKYAARSSLAFVSNSTYTVTSFTLVLEFKKGRLQNLYWKRDGCSACSGDNKFVCLNNQDCAIKTTDCKGQGQGASVDCSLGIQLAFSGTDKHYSVLNSWYEVKNLRQYSLYGLYANLADSLTSQYNKIF

SEQ ID NO: 46504 - protein, 231 aa, Anaplasma phagocytophilum HZ
MATQAEVNRVFSSVASRYDVMNDIMSFGLHRLWKRELCSRIVKHSGTLLDVAGGTGDIALRALQQRGGLSITVCDINQEMLNVGRKKSIDCGQLSINWVCASGECLPFPDNAFDYYTIAFGIRNIPDRQAALKEAYRVLKPCGRFLCLEFSPILEDSAFKTAYDLYSFFVIPKIGKIVAGDIDAYSYLVESIRAFPTQKQFSSEVADAGFFKITHKNVCGGIATLYSAWKV

SEQ ID NO: 46505 - protein, 392 aa, Rhodobacter sphaeroides 2.4.1
MAFPERFSNLPDYAFPRLRKLLDPHAPGGEPVAMTIGEPKHPMPEFVGPVLAESLAGFGLYPPNDGTPELLSAIGGWLKRRYRVDLGPERIMVLNGTREGLFNAALALVPETKRGARPVVLMPNPFYQVYAMAALALGAEPVYVPALASNGFLPDYASLPAEILERTALAYLCSPANPQGSVASRDYWAGLMDLAETHDFRLFADECYAEIWRTAPPAGALEVADATGADPERIFAFHSLSKRSNLPGLRSGFVAGGPEGIARIRQLRAFAGAPLPLPVQRVSERAWADETHVEANRALYQEKFRIADEVFSGLQGYMGPEGGFFLWLPVPDGEEAALKLWTETGVRVLPGAYLAREVGGENPGKGYIRVAMVAPKDEMQRGLVRLRDCLYG

SEQ ID NO: 46506 - protein, 640 aa, Oryza sativa Japonica Group
MSLLSKLRLVTVDVTGTLIAYKGQLGDYYCMAAKSAGMPCPDYKRMHEGFKAAYTEMTVRHPCFGHASNMPNIDWWKMCVKDSFIRAGYEYDDATFEKIFRRIYSTFGSSAPYSVFPDAQQFLRWLRNNGCTVGIVSNAEYRYKDVVLPALGLNEGSEWDFGVFSGIVGVEKPDRRMYEAALEMAGGVAAAEALHIGDSMRKDYAPARRAGMHALLLDRVLWCCIIHNYTVLYSLARVVLKKGKTQIFRDGSPMVYSGAVDRIIGRPPPKTGDVVLVADGAEKPIGWGLYNSVSMFCVRLMQLEEEAKRDPTCALNMERLLEARILSAVDLRRSLGLPSVHTNAYRLINSEGDRLSGLIVDIFADVAVVASSAAWVEKYRHEIQFLVNKVSDVNHIKWRSSTDILKEEGLDVSEQKDPESSSHCGTVEVMENDVLYLVSLEGQKTGFYADQRENRHFISTLSKDQRVLDLCCYSGGFALNAAKGGANNVIGIDSSASALDLANKNIILNKLDTQRISFVKEDATAFMKGAISRNEVWDLVILDPPKLAPRKKVLQSASGMYRSLNALAMQVVKPGGLLMTCSCSGAMTQSGLFLRTIQGAASMTGRKVTVLRQAGAACDHPVDPAYPEGRYLSNYLLRVT

SEQ ID NO: 46507 - protein, 340 aa, Burkholderia mallei ATCC 23344
MRTPLTRRKHGNLAEPSLLPGGRLRKLGRAFLPMSKSARNWGLEQIVAELRESREKLHRTRHPRGIRELPSRDAVCTIVSGLRASMFPTHYGAPDLTDETVDYYVGHTLESTLRLLAEQIRRALRFLPEHAQTPLAVLEERAFEIAREFGTQLPRIRALLVSDIQAAYTGDPAAQHITEILLCYPGVLAMMHHRLAHALYRLGVPLLARFINEIAHSATGIDIHPGAQIGPSFFIDHGTGVVIGETAIIGERVRVYQAVTLGAKSFPADGDGMLVKGNARHPIVEDDVVIYAGATILGRVTIGKGSVIGGNVWLTHSVPPGSSVAQGKIRESDKDQAEKD

SEQ ID NO: 46508 - protein, 197 aa, Francisella tularensis subsp. holarctica
MNYSKAKYIMGAAKVSQLPEDTGVEVAFAGRSNAGKSSALNTLTDQKGLARVSKTPGRTQLINLFDLGNNNRLVDLPGYGYAKVSESIKRQWQSEMENYLTSRKCLNGIVLLVDSRHELKEFDSLMIEMAISFDLNLHILLTKADKLNNKERAQANRMIESFLKTFVSTDKISYQLFSSLTKMGLDKFKEKLDTWYQ

SEQ ID NO: 46509 - protein, 334 aa, Oryza sativa Japonica Group
MAARRRPGGTPGSPNSKFTQQELPACKPILTPKWVISVFVLVGVIFVPIGLVSLKASRKVVEIVDRYDDACVPANTTDKLAYIQNPTISKNCRRTLKVPKDMDAPIFVYYQLDNFYQNHRRYVKSRSDAQLRDPKKANDTSTCDPEGTANGMAIVPCGLIAWSIFNDTYGFVRNSKNLPVDKKNISWKSDREHKFGRDVFPKNFQNGSLIGGKTLDPNKSLSKQEDLIVWMRTAALPTFRKLYGRIHTDLKKGDTITVTLENNYNTYSFSGKKKLVLSTSTWLGGKNDFLGLAYLSVGGLCFFLAFAFTLLYLIKPRKMGDNNYLSWNRNPAGR

SEQ ID NO: 46510 - protein, 361 aa, Pediococcus pentosaceus ATCC 25745
MKRYLILEDGTTYEGKAIGANRESIGELVFNTGMSGYQESITDQSYNGQILMFTYPLIGNYGVNRDDLESVKSSCFGVVVHEVARRASNWQMNMSFEEFLAYQDLPGISGVDTRAITRHIREHGAMKAALVNEISDAKFEKFHATDLIQNQIEISSTHSPYPNPANGRKVVVIDFGLKYSILRELARRDCNVMVLPYNATAKEVLACNPDGVMFTNGPGDPESMDESVLEMIRTVEAAVPVFGICMGHQLFALANGAKTTKMKFGHRGFNHPVRNLATGRIDLTSQNHGYAVERASIANTDLEITHEEINDETVEGLRHKQYKAFSVQFHPDAAPGPHDADYLFDDFMEMIDEAKQTQEDK

SEQ ID NO: 46511 - protein, 555 aa, Oryza sativa Japonica Group
MAMAMAMRRAAALGARHILAASSTSSSGVLLRRHMSVDAGAAMEKVRAAGLLRTQGLIGGKWVDAYDGKTIEVVNMQFALGNPCEQFVELIYFLQDALYLVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVRKITFTGSTAVGKKLMAGSANTVKKVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANIMLGGKRHSLGMSFYEPTVVGNVSNDMLLFREEVFGPVAPLVPFKTEEDAIRMANDTNAGLAAYIFTKSIPRSWRVSEALEYGLVGVNEGIISTEVAPFGGVKQSGLGREGSKYGMDEYLELKYICMGNLN

SEQ ID NO: 46512 - protein, 119 aa, Mesorhizobium sp. BNC1
MYSIRLRNCAFYARHGLLDEEAALGQRFYVDAELLVEPEVPLEEASIGTTVDYGVAFSLIEKIVTGERCPLIETLALRIAKSLCARFPQIKHATITVRKPSAPIAGVLDYVEVTVDWPQ

SEQ ID NO: 46513 - protein, 525 aa, Rhodobacter sphaeroides 2.4.1
MRDFHLPGRSAVYAGNGLCATSHPLASKVAIDILQAGGNAADAAIAAAVLLGICEPQMTGIGGDCFVLLKPPGEDRIVALNGSGRAPAGLSAALMREKGHATVPLHGPEAVTVPGAVDAFCRLSADWGNLELAQVLAPAIQYAEEGVPVAPRTAFDWALAEEKLQGAARQYYLVDGAAPRAGQIFRAAGQAEVLRRIAQQGRAGFYEGEVAEDMVTSLRSVGGTHMLEDFAATACTYGEPISGTYKGVELVEHPPNGQGATAILMLNILSHFDVAGMDPFGTARAHLEAEAAKLAYDARNRFLADPDHVRRLDHMLSPQTAERLAALIDPTRAMPEAAPLSEAVHRDTVYLTVVDRDRMAVSLIYSVYHSFGSGLASARFGINFQNRGAGFCLTKGHANEAMGGKRPMHTIIPGMIRREGRVIVPFGVMGGAYQPAGHARFVSNLVDFGMDPQEAIDAPRSFSGPDGMLVERGYDERVRAELAAMGHDVRVPHEPIGGAQAILIGEDGVLVGASDPRKDGCALGY

SEQ ID NO: 46514 - protein, 377 aa, Thermotoga maritima MSB8
MVSRRISEIPISKTMELDAKAKALIKKGEDVINLTAGEPDFPTPEPVVEEAVRFLQKGEVKYTDPRGIYELREGIAKRIGERYKKDISPDQVVVTNGAKQALFNAFMALLDPGDEVIVFSPVWVSYIPQIILAGGTVNVVETFMSKNFQPSLEEVEGLLVGKTKAVLINSPNNPTGVVYRREFLEGLVRLAKKRNFYIISDEVYDSLVYTDEFTSILDVSEGFDRIVYINGFSKSHSMTGWRVGYLISSEKVATAVSKIQSHTTSCINTVAQYAALKALEVDNSYMVQTFKERKNFVVERLKKMGVKFVEPEGAFYLFFKVRGDDVKFCERLLEEKKVALVPGSAFLKPGFVRLSFATSIERLTEALDRIEDFLNSR

SEQ ID NO: 46515 - protein, 232 aa, Zea mays
MEDWDSEEFQPVVPVVKAEPLKNQWADEDVEEDDVKESWEEEEEEEKPKPAPVEKVAAKPSTKAPAKKGKQQALTSAEEPDEPPLSPTSQKIRQQRLVEEADFKSTTELFAKKGSEQKSLDTFIPKSESDFAEYAELIANKLRPYEKSFHYMALLKNVMRLSMTPLKGADAKDISSSVTAIANEKIKAEKEAAAGKKKQGARKKQLHIEKGDHDFIPGRGGGYDDPEEYDFM

SEQ ID NO: 46516 - protein, 420 aa, Shewanella sp. ANA-3
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDEMRILGFEEKPKHPKHSPGNPEKCLASMGNYVFNTEFLFEQLKKDAQNANSDRDFGKDIIPSIIEKHKVFAYPFKSAFPNEQAYWRDVGTLDSFWQANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 46517 - protein, 263 aa, Zea mays
IQKPPAPGQFLDRIATHPISMATSALAALSATAAAAGKRILLSRPVSSSSLSFASRRLAAGAPLRGFLGAPIRAVASSASARPAAAAKTIAVGDRLPDATLSKVNTETSSPRPIPRPHRHPPHLHGYLRDLTAGKKVVLFAVPGAFTPTCTQKHLPGFVAKAGELRAKGVDTVACVSVNDAFVMRAWKESLGIGDEVLLLSDGNGELARAMGVELDLSDKPVGLGVRSRRYALLAEDGVVKVINLEEGGAFTNSSAEDMLNAL

SEQ ID NO: 46518 - protein, 480 aa, Synechococcus sp. RS9916
MSDASFDFDVIVIGAGYGGFDAAKHAADHGLKVAILESRDMGGTCVNRGCVPSKALLAASGRVRELADADHLQGFGIHSAPVRFERQKLADHANQLVATIRSNLTKTLERAGVTIIRGKGRLEGPQKVGVREISGVDRVLSARDVIIATGSDPFVPPGIETDGRSVFTSDEAVNLEWLPRWIAIIGSGYIGLEFADVYTALGCEVTMIEALDRVMPTFDPDIAKLAARKLIDGRDIDARSGVLAKSIKPGAPVQIELVDMQTREPVETLEVDAVLVATGRVPSSKDLNLEAQGIETNRGFVPIDDSMRVLVNGQPVPHLWAVGDVTGKLMLAHTAAAQGTVAVDNILGKSREIDYRSIPAATFTHPEISSVGLSEADAKQLATDKGFELGVVRSYFKANSKALAELESDGLMKLLFNKTSGEVLGAHIYGLHAADLIQEVANAVARRQSVRQLATEVHTHPTLSEVVEVAYKQAAHALAA

SEQ ID NO: 46519 - protein, 337 aa, Aeromonas hydrophila
MKVLVTGGCGYIGSHTCLALQAAGMEPVVVDNLCNSKAGVLARIAAISGREPLFYQGDIRDPALLDRIFGEQQIAAVIHFAALKAVGESTRLPLEYYENNLGGTLTLLQAMKRAGVNSLVFSSSATVYGDPASTPIREDFPRSATNPYGRSKLIIEEILEDLQRAEPHWSMTLLRYFNPVGAHESGTLGEDPQGIPNNLMPFLTQVAIGRRDTLSVFGNDYPTIDGTGVRDYIHVMDLAEGHVKALQHCARQGGVHVYNLGTGQGQSVLQMVAAFEAASGRQLPYRIEPRRPGDIAECWADPAKAERELGWRASRDLATMCTDSWRWQSANPQGYEA

SEQ ID NO: 46520 - protein, 302 aa, Oryza sativa
  misc_feature (171)..(171): Xaa can be any naturally occurring amino acid
  misc_feature (260)..(260): Xaa can be any naturally occurring amino acid
MFRLFNRNLYAFSNRAFDLAVIGGGPGGYVAAIKAAQLGMNTVCIEKRGALGGTCLNVGCIPSKALLNISHKYHELTHDFKSFGLNVTGVTHDWNKTQENKNGVVTGLTKGIEGLFRKNKVTYIKGSGAFTDANTIEVTGIDGKNETITAKKTIIATGSEASAFPGLPFDXKIIVSSTGALSLPAVPKDLIVIGGGVIGLEMASVYQRFGTNVTVIEYLDEIVPSLDKEIAKTFNKILTKQGIQILTAHKVVSGKNHGTXREVTIEPLKGGKQRVLKAGPLLVATGKKTPTLEKLLLDRSWE

SEQ ID NO: 46521 - protein, 285 aa, Synechococcus sp. CC9311
MDDSLRVSVLSEALPYIQRFAGRRIVVKYGGAAMVHAELRDAVFRDIALLASVGVQPVVVHGGGPEINTWLKRLDIRSEFRDGLRVTDAETMDVVEMVLVGRVNKQIVNGLNRLGASAVGLSGSDGRLVEARPWGDGNHGLVGDVARVNPDVLEPLLARGYVPVISSVAANPEGESHNINADTVAGELAAALEAEKLILLTDTQGILRDRDNPNSLIRQLRLSEARQLIHDGVVAGGMTPKTECCIRALAQGVAAAHIVDGRVPHALLLEVFTDAGIGTMVLGCG

SEQ ID NO: 46522 - protein, 227 aa, Thermus thermophilus HB8
MERPLESYKKEAAHAAIAYVQDGMVVGLGTGSTARYAVLELARRLREGELKGVVGVPTSRATEELAKREGIPLVDLPPEGVDLAIDGADEIAPGLALIKGMGGALLREKIVERVAKEFIVIADHTKKVPVLGRGPVPVEIVPFGYRATLKAIADLGGEPELRMDGDEFYFTDGGHLIADCRFGPIGDPLGLHRALLEIPGVVETGLFVGMATRALVAGPFGVEELLP

SEQ ID NO: 46523 - protein, 280 aa, uncultured archaeon GZfos37B2
MITDWYEYRLINGAIVRMIDDLDESNLKRIVRHVFDSGGKKIRPIILILSSELFGGDADECVDAALAIELIHSASLIHDDILDVGLVRRGVPSVYNQFGLAAAILCGDFLISKSIELISKYDRAVIQDFGRAGMSMSEGEALDVNSNETNFSENDYFECISKKTASLFAASARMGSRIGGAPARSINRCTEYGTHLGMAYQIIDDILECKELQHEKKSENTATTLPHILKHDAIDLSVKAVQHHVDCSKQIINSFNDSDVRIKLQKIVDYMTFDLAGAVE

SEQ ID NO: 46524 - protein, 291 aa, Matthiola incana
QVPVVDLSCPDEELVARTVVKASEDWGVFQVVNHGIPTELIQRLQKVGREFFELPEAEKRSCAREAGSVEGYGRRIELDIKKRKGIVDQIYLSTWPPSSVNYRYWPKSPPDYREVNEEYARHVKTLSEKIMEWLSEGLGLGREAIKEVNGCWYVMNINHYPPYPHSDSFNGLEPHTDINGLTLIITNEIPGLQVFKDDHWIEVEYIPSAIIVNIGDQIMMLSNGKYKNVLHKTTVDKEKTRMSWPVLVSPTYDMVVGPLPELTSEDDPPKFKPIAYKDYVHNKITFLKNKS
